United States Patent 7,625,699 (GENETIC POLYMORPHISMS ASSOCIATED WITH CORONARY STENOSIS, METHODS OF DETECTION AND USES THEREOF) - sequence listing, part 16

SEQ ID NO: 57702 - DNA, 201 bp, Homo sapiens
tatgagcacggcatctaccgggctgttccacatcctccctgtgggactaggggccagggcaatgggaatcagtgcagaaataaagctcatgctgtttgctstgccatgagtaacgaagtcctctgtatctgatcctgggtctcctgttttctgctagcttcctcaaaacttggtagctaactcattaacttacaaggaaga

SEQ ID NO: 57703 - DNA, 201 bp, Homo sapiens
attctcagattcccagccaactggtttcacatgacaagtaaatgagcaacctggaagatgagtggcgtttccacacacagggaagcagatagttccattasgtgacagtgtgtgcacagtttatggaggatgaagcggaaaacctgagccacaaggcagtagaggttggacgagacactcattccgaaggcgggtgtgtat

SEQ ID NO: 57704 - DNA, 201 bp, Homo sapiens
cctgactttctccctggtccaggtgcattttaagcatggaaggtgacacttgccattctcaatggacaaagggagtggggagtgtgggggtgtgctttggrgttagtctctgggttttcgaaacttagcattctcagattcccagccaactggtttcacatgacaagtaaatgagcaacctggaagatgagtggcgtttcc

SEQ ID NO: 57705 - DNA, 201 bp, Homo sapiens
actgcattgactcctgttttctacacagtggtcttcagctacaccttaccaagcaccccttacccagcaaacgtggcttctcttccccaggcagagcagtycgttacttagactaggaaatggctccgagaagctcacccatcaccatttgctctactgcaaaacaggactcattagcaggagctcataaaatgaaactgg

SEQ ID NO: 57706 - DNA, 201 bp, Homo sapiens
ctgtagcaaagatgtactgtttcccactgagaagaatcaaaaatagaaaagtgcttccttgtctctctatattgttattaaaacaagtagatgcattttcrttgaatcaaggcagttttcctttataaaatgtcctatttcatatcactgttcaaacttgacatccacatttgagttggtttaaaatatcactgttttgtt

SEQ ID NO: 57707 - DNA, 201 bp, Homo sapiens
agttccagctcatccaccctgcctctgtggctgagtcggggagaaaaggacaaagtttttctcccgcaactgggccaccaaaccagcagagcctccagccrgggtggtctcgaggaggcccattaccggctggagtgacagagtgtgtcaagcctgcagctcgtcccgtgtctaatggaacagaaacaagcaccctgctgc

SEQ ID NO: 57708 - DNA, 201 bp, Homo sapiens
tgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaag

SEQ ID NO: 57709 - DNA, 201 bp, Homo sapiens
agtgaaaaatcttaagtaccaatgggaagcagggaattcctggggtaaagtatcacttttctggggctgggctaggcataggtctctttgctttctggtgstggcctgtttgaaagtaaaaacctggttggcgtgtaggttccgtatctccctggagaagcaccagcaattctctttcttttactgttatagaatagcctg

SEQ ID NO: 57710 - DNA, 201 bp, Homo sapiens
caagttcaaaatcagtctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtccc

SEQ ID NO: 57711 - DNA, 201 bp, Homo sapiens
caccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcc

SEQ ID NO: 57712 - DNA, 201 bp, Homo sapiens
gatagctgatttgttataaacaaattaccaaaaacgtactggctttaaacaacacatgcttatcatgttgcagttctggggagtcacaagttcaaaatcastctcacctggtcaagatgtcagtagggcttgttccttctggaggctctaggggagaatctgtttccttgcgtttttcatcttctagaggcctcctgcatt

SEQ ID NO: 57713 - DNA, 201 bp, Homo sapiens
tttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgc

SEQ ID NO: 57714 - DNA, 201 bp, Homo sapiens
tgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcagtctcacctggtcaagatgtcagtagggcttgttccttctggaggctcta

SEQ ID NO: 57715 - DNA, 201 bp, Homo sapiens
tccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatt

SEQ ID NO: 57716 - DNA, 201 bp, Homo sapiens
tctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaa

SEQ ID NO: 57717 - DNA, 201 bp, Homo sapiens
actgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatc

SEQ ID NO: 57718 - DNA, 201 bp, Homo sapiens
atttgtgtcctggttggcagatattaagtccacagataccaataattaatatctatggttgattgtaaaaatggccaccaattcttccctgtcccctgcayatgtacatccttgcactgtgaaattgtagatctcgccctccaaaggtgaagttcgtttgtccactccttgaaccaggatggcatgaaacttgatttgacc

SEQ ID NO: 57719 - DNA, 201 bp, Homo sapiens
cttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaaggg

SEQ ID NO: 57720 - DNA, 201 bp, Homo sapiens
tatccaggaggaatgattagtgatctgattcattaatatcccttgttattaagaactgtctgtatttgtgtcctggttggcagatattaagtccacagatdccaataattaatatctatggttgattgtaaaaatggccaccaattcttccctgtcccctgcatatgtacatccttgcactgtgaaattgtagatctcgcc

SEQ ID NO: 57721 - DNA, 201 bp, Homo sapiens
gactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttat

SEQ ID NO: 57722 - DNA, 201 bp, Homo sapiens
gttcaggaacagaactgacaggtattgaagccaaaaattgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaac

SEQ ID NO: 57723 - DNA, 201 bp, Homo sapiens
tcctttcttcttcagtgccacctgccttattttactcacccagaaggaagccgggtccctctttgcccctttgggtgtttgtgaaaagcaagttgtaaacwctgaattctataaactgttggagacagattctggagagacactcaggcttagctctagaaagaaacgggtaagacagaggaggttcagggcaactgtgtt

SEQ ID NO: 57724 - DNA, 201 bp, Homo sapiens
caaaagtactaaatgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgatgacttcttgctgtgtca

SEQ ID NO: 57725 - DNA, 201 bp, Homo sapiens
aagattcctttcttcttcagtgccacctgccttattttactcacccagaaggaagccgggtccctctttgcccctttgggtgtttgtgaaaagcaagttgyaaacactgaattctataaactgttggagacagattctggagagacactcaggcttagctctagaaagaaacgggtaagacagaggaggttcagggcaact

SEQ ID NO: 57726 - DNA, 201 bp, Homo sapiens
tcaggcactttatatccctcatccaggaggatgcaaaaacctggtgtttttcttttttttttttttgcattttccagacgagccaagggatggctcagaarggtgaaggaactcacccgaattgcacagctggtgagctcagagtcaggctccttgcttggtccatctggcttccaaactccaagtctgtctgctccaccc

SEQ ID NO: 57727 - DNA, 201 bp, Homo sapiens
cttgttcttttacaaaaagggtcagcagactttctgaaaagggacagatagtaaatattttaggctttgtggaccatagggcctgtgtcaaaagtactaawtgttaccattttccttactttgttcaggctgctataacagataccataaactaggtagcttataaataacagaaatgtaattcttaaagttctggagcct

SEQ ID NO: 57728 - DNA, 201 bp, Homo sapiens
tacttgttcttttacaaaaagggtcagcagactttctgaaaagggacagatagtaaatattttaggctttgtggaccatagggcctgtgtcaaaagtactmaatgttaccattttccttactttgttcaggctgctataacagataccataaactaggtagcttataaataacagaaatgtaattcttaaagttctggagc

SEQ ID NO: 57729 - DNA, 201 bp, Homo sapiens
acaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttg

SEQ ID NO: 57730 - DNA, 201 bp, Homo sapiens
aagttaaactgatgtctgtgtgtcttcatgtcattaaactttgaatctacggacatgtctttttctttctggcatagtttggaggtcttcattttgtgatwgaatacaaaacaccgagggctttaaggaggcatagtggtatgttcagctgtattttctcataatatagagtcataggaaacctgagccttggcatttgta

SEQ ID NO: 57731 - DNA, 201 bp, Homo sapiens
tgagaaagttaaactgatgtctgtgtgtcttcatgtcattaaactttgaatctacggacatgtctttttctttctggcatagtttggaggtcttcattttrtgattgaatacaaaacaccgagggctttaaggaggcatagtggtatgttcagctgtattttctcataatatagagtcataggaaacctgagccttggcat

SEQ ID NO: 57732 - DNA, 201 bp, Homo sapiens
cccccaaagggggatttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatgg

SEQ ID NO: 57733 - DNA, 201 bp, Homo sapiens
tgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagccacttagtggttc

SEQ ID NO: 57734 - DNA, 201 bp, Homo sapiens
ttccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagccccca

SEQ ID NO: 57735 - DNA, 201 bp, Homo sapiens
cccatgggagctccaactctgtttggtcccaatgtgccctttttgtctcactccttcctcccacacatcctgctccccactcccctaattactcatgattscactaacagccacatcctttcacacctctgagcttttggtcatgctgtaatctctacctgagttccattcctgcctccacccttgcctgtcaaattcctt

SEQ ID NO: 57736 - DNA, 201 bp, Homo sapiens
taaatattttaatgtttgtcgtttgtttgcaaccttgtaattttttcctgtgcagcaattttaactttctatattcaaatatactctgaatgcacagtgartttggcagaataccatttaagtcttgtattttccaaagctagtcaacgtccaactgccaatgttgcctgaacaggaaatatttatacctgaaagcgtcca

SEQ ID NO: 57737 - DNA, 201 bp, Homo sapiens
gtttggggcatgttgtcacctcattgccatctctgcctctgtcttctcaccaccatcttccttgtccatgtctctctatgtcttcaatgttcttcttatarggacaccagtccttggatttagagtccaccctaattcactgtaatcacatcttacctaagtccatctgcaaagaccctatttccaaataaggtcacattc

SEQ ID NO: 57738 - DNA, 201 bp, Homo sapiens
ttatctttgggactgctataatgagatccacttagatctagctataatggaattttgtttagtggttctctgatttaaacatgacttttatccttttcagmtatcgtttcattaacatcactacctctttttaaatcctaatgttgtcatggaagcctgtgtaggggctgaccttgaagtctctgaaagctgaacactcag

SEQ ID NO: 57739 - DNA, 201 bp, Homo sapiens
ggcagcaccactgccatggaaattctccagggccgggatttcactggcaaagtggttgtggtcactggagctaattcaggaataggtaggctcttcacttmgttatttatctttgggactgctataatgagatccacttagatctagctataatggaattttgtttagtggttctctgatttaaacatgacttttatcctt

SEQ ID NO: 57740 - DNA, 201 bp, Homo sapiens
tcagtgggccccagttctttcaggtttaaggaataagcattttggtctatgaaaaatggggttttcctaaagtataagattgtcttatatttataaatgcytgtgttcattgctgtgggttcactgctttctcttttgggcagccatataaataaaagaaccacctacttggacccaagactggcgtttactgtggatgat

SEQ ID NO: 57741 - DNA, 201 bp, Homo sapiens
gcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgtttt

SEQ ID NO: 57742 - DNA, 201 bp, Homo sapiens
tgtagttcccgcaaatctatttacggttttcacaaggaggtcacgaacatgcgttgttttcaatgctgggctagtttcagacttctggcttgttgtgggayggaggagaaagaagacagggcattttgatgtggcccagagaccaaatgaaacaaacgatcctctgattgctcagatgtcctctttgacttggaaagcacc

SEQ ID NO: 57743 - DNA, 201 bp, Homo sapiens
actaaacgatttgttcagattggggaaaaaaattttttttttttttttggttgtggtggcgttggcttttacttggggttgacctttccttatcaaggacrtacaaggtgaatagctgggtgataatatatggtcccatgatcatcaaccaagcaccaacggaagccttttggaagtgcacagtattgtttaacacacaaa

SEQ ID NO: 57744 - DNA, 201 bp, Homo sapiens
aaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtat

SEQ ID NO: 57745 - DNA, 201 bp, Homo sapiens
ttgaacccgggaggtggaggttgcagcgagtcaaggtcacgccagtgtactccagcctgggtgacagagcgagactccgtctcaaaaaaaaaaaaaaaaaraaaaagaaaaagaaaaaggtgtttggaagccatgtcccatgaattccaaatacaattgaggactctataaaggactataaaaaaagttgtaataaattat

SEQ ID NO: 57746 - DNA, 201 bp, Homo sapiens
gcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaaga

SEQ ID NO: 57747 - DNA, 201 bp, Homo sapiens
cattcttcttaaaatacggagcgacataattaaccctctggggagactaatattagtttattagagacaatttctagttctgtttatttttaacactaaaygatttgttcagattggggaaaaaaattttttttttttttttggttgtggtggcgttggcttttacttggggttgacctttccttatcaaggacatacaag

SEQ ID NO: 57748 - DNA, 201 bp, Homo sapiens
acttgaacccgggaggtggaggttgcagcgagtcaaggtcacgccagtgtactccagcctgggtgacagagcgagactccgtctcaaaaaaaaaaaaaaaragaaaaagaaaaagaaaaaggtgtttggaagccatgtcccatgaattccaaatacaattgaggactctataaaggactataaaaaaagttgtaataaatt

SEQ ID NO: 57749 - DNA, 201 bp, Homo sapiens
tattgacctatgtttttaattataactttgggtggtggtctgaaatgaaatgttaagtttgacgcaaaaataggactagtttgtgtaactgatttgttcaraataacagcttacatttctcagagctttttgtatgccaagtgctatgcgaaaccctggatgtacaatattcttatagtagcccctgagaccagtgctagg

SEQ ID NO: 57750 - DNA, 201 bp, Homo sapiens
tgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctcagtggcttgtcataggtgtcaaagacaggagtccagtgtaaggactt

SEQ ID NO: 57751 - DNA, 201 bp, Homo sapiens
ttatttcttttcaatactctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcgtgtgggtgaacacacacacacacacacacacacgctt

SEQ ID NO: 57752 - DNA, 201 bp, Homo sapiens
ttgacaatactttcctttcagtctattttcctgtgtatggggtaagtgttgcccttctgcaactttccttttattttatttatttatttcttttcaatackctgaatatcactggagcagctgcagattcagggcagtatggggtggttcaggaacagaactgacaggtattgaagccaaaaattgaacaataacaacgta

SEQ ID NO: 57753 - DNA, 201 bp, Homo sapiens
catttgcaaaacactttgacaatactttcctttcagtctattttcctgtgtatggggtaagtgttgcccttctgcaactttccttttattttatttatttmtttcttttcaatactctgaatatcactggagcagctgcagattcagggcagtatggggtggttcaggaacagaactgacaggtattgaagccaaaaattg

SEQ ID NO: 57754 - DNA, 201 bp, Homo sapiens
tttatattgctgaaaatgtcatttgcaaaacactttgacaatactttcctttcagtctattttcctgtgtatggggtaagtgttgcccttctgcaactttmcttttattttatttatttatttcttttcaatactctgaatatcactggagcagctgcagattcagggcagtatggggtggttcaggaacagaactgacag

SEQ ID NO: 57755 - DNA, 201 bp, Homo sapiens
ttggagaggcctgtttccatacatagctctttgtcagttgctcacactcggtcaatacttgccttcctttgaggccatctgcactcactgacaatctgatygctcccctgaatggaggtgaaagcatgcaagctaggagttaagatctttaactcagggaagaccctgtctatggaagtgctgagctcttcagtgtcatca

SEQ ID NO: 57756 - DNA, 201 bp, Homo sapiens
ttatatgcctgttccatatgagaacattatgcatatggtgtgatttggtcattccggatggctaaagtgtgagcatacccgtatctcagatttacagaggwgaaaacagaggctcagactggttatgtatatttctctaagtcccccagctattgtttgttgtaggttgggtaccccaggaagtagattctgcaactgaga

SEQ ID NO: 57757 - DNA, 201 bp, Homo sapiens
tctctggaaatctctagcttctcaaactgtttcgtggtggagtgccttttgggcacaggagaaggaaataagagcctcgcgaggtttgggaatgctgcctstagctctcacactgcatgcagaattcctactctgagagctcactttatctcaaaaacccatgcatattctgcatctactctgaattccgcagtgttgtgt

SEQ ID NO: 57758 - DNA, 201 bp, Homo sapiens
attatatgcctgttccatatgagaacattatgcatatggtgtgatttggtcattccggatggctaaagtgtgagcatacccgtatctcagatttacagagragaaaacagaggctcagactggttatgtatatttctctaagtcccccagctattgtttgttgtaggttgggtaccccaggaagtagattctgcaactgag

SEQ ID NO: 57759 - DNA, 201 bp, Homo sapiens
tctgactttccttgactttgatgtctaggtctggatttcaagggctcagaaactctctcatgcatgtagttccctcctgctttgaatctctctgactttcmttgattttgatgtctaggtctggatttcaagggctcacgtgatgaggatagtttctttatcttaagggcaactgatgtggagtcttaattaacactggca

SEQ ID NO: 57760 - DNA, 201 bp, Homo sapiens
ccaagctcattcaggatgctggcaggattcagatccttgaagttgtaagactagggcccctgtttcctactgacttctgctggtggctgccctcagctccsagaggcaacccacattccttgacttttggccccctgcatctcaaagccagcaacagaaactctcttgtgcatggagtcccctcctgctttgaatctctct

SEQ ID NO: 57761 - DNA, 201 bp, Homo sapiens
tcccttgaacctgggaggtggaggttgcagtgagctgagatcacgccattatactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgt

SEQ ID NO: 57762 - DNA, 201 bp, Homo sapiens
aagtgctgggattacaggcatgagccaccatgcccggcccccttttttaaaaaacaaaaaaacaaaaaactcttttgtgttttagaaatggggtctcactmtgttcttcaggctagtcttgaactcatggcctccagtgatcctcccgcctcagcctcctgagtcactggaatttcaggcatgagccactgtgcctggcct

SEQ ID NO: 57763 - DNA, 201 bp, Homo sapiens
gatcctttcagagttactcatacgacttacacattcccatgggagctccaactctgtttggtcccaatgtgccctttttgtctcactccttcctcccacayatcctgctccccactcccctaattactcatgattgcactaacagccacatcctttcacacctctgagcttttggtcatgctgtaatctctacctgagttc

SEQ ID NO: 57764 - DNA, 201 bp, Homo sapiens
aaattgctgaagtgcttctcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcg

SEQ ID NO: 57765 - DNA, 201 bp, Homo sapiens
taaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagactgaccttttcacttactg

SEQ ID NO: 57766 - DNA, 201 bp, Homo sapiens
atcccagctctttgggaggctgaggcaggtggatcacctgaggtcaggagtttgagattagcttgaccaacatagtgaaaccccgtctctactaaaaatamaaaaattagccaggcgtggtggcgcatgcctataatcccagctactctgggcctgaggcaggaaaatcacttgaacctgggagacagaggtttcagtgag

SEQ ID NO: 57767 - DNA, 201 bp, Homo sapiens
cttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatacaaaaattagccaggcgtggtggcgcatgcctataatcccagctactctgggc

SEQ ID NO: 57768 - DNA, 201 bp, Homo sapiens
gtcatatgctgtgtcaggcactttatatccctcatccaggaggatgcaaaaacctggtgtttttcttttttttttttttgcattttccagacgagccaagrgatggctcagaagggtgaaggaactcacccgaattgcacagctggtgagctcagagtcaggctccttgcttggtccatctggcttccaaactccaagtct

SEQ ID NO: 57769 - DNA, 201 bp, Homo sapiens
cttattacctggtgacacgtgtttctagttattgacctatgtttttaattataactttgggtggtggtctgaaatgaaatgttaagtttgacgcaaaaatmggactagtttgtgtaactgatttgttcagaataacagcttacatttctcagagctttttgtatgccaagtgctatgcgaaaccctggatgtacaatattc

SEQ ID NO: 57770 - DNA, 201 bp, Homo sapiens
ttctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagc

SEQ ID NO: 57771 - DNA, 201 bp, Homo sapiens
gtgaagtctagatctccctgctaacttacactgtgctcaaaacacacacacacacacacacacacacacacacacacacacacacactggctgtcctcacygtcaactctagatctccctgctaacttacactgtgctcaaaaaacacacgcacgcacgcacgcatgcacgcacatacacacacacacacacacccatagg

SEQ ID NO: 57772 - DNA, 201 bp, Homo sapiens
aattatgtagtgtctacagagccagtggtttattttgcattgtttatgtcagcattaagcagtattcttacacagtttgtaagtcttaaaactcagtatckactctagtagttgctccaaatgtgatgtcctcataaatcaccgagggatcttgttaaatttggattctgattcagtaggtctaggtggggcccgagcttc

SEQ ID NO: 57773 - DNA, 201 bp, Homo sapiens
ccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacacacactggctgtcctcactgt

SEQ ID NO: 57774 - DNA, 201 bp, Homo sapiens
ggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattatactccagtct

SEQ ID NO: 57775 - DNA, 201 bp, Homo sapiens
cgtgtgaatgtattgcagaaatggacaggacaattctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattt

SEQ ID NO: 57776 - DNA, 201 bp, Homo sapiens
tgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttgg

SEQ ID NO: 57777 - DNA, 201 bp, Homo sapiens
gtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtga

SEQ ID NO: 57778 - DNA, 201 bp, Homo sapiens
tttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtagaaacagtgtttcaccaggttggccaggct

SEQ ID NO: 57779 - DNA, 201 bp, Homo sapiens
tgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgctttt

SEQ ID NO: 57780 - DNA, 201 bp, Homo sapiens
cagcctcccaaagtgcagggattaaggcgtgagccaccgagcccagccggcaaacttactttaaaacacattgcaataaaataaaaagaaaagggattgtsctaagtgagaagcagagatgaaaatgtggaaggatgattgtgagaagtccacattgctccatttggacttcctttttgtagtgggctattagattttgcc

SEQ ID NO: 57781 - DNA, 201 bp, Homo sapiens
gcacgatctggcttacgatgatttctaacatctcaccatctttacttctgtatataaatatatgataagtatacctttatatatgtgacatgtatctttayatatgatatgtatggttacatatctactcactcacacatccacacacacacacacacacacacacacacacacacaccttttttggaaccattgaaaagt

SEQ ID NO: 57782 - DNA, 201 bp, Homo sapiens
aggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtcctaagtgagaagcagagatgaaaatgtggaaggatgattgtgagaagtccacattgct

SEQ ID NO: 57783 - DNA, 201 bp, Homo sapiens
gagaagacagtggattgtttctctgggtggtcaaggaaggcttccaggcagaggaggtttggccatgggtaccaaggggtagagatgggaaccttccaggkacatggacccgatgctgccagcagaggggaaaccatggccctaagggcagagcacactggggcgggggtgggggttcagtgacagtctggtggcctgtgt

SEQ ID NO: 57784 - DNA, 201 bp, Homo sapiens
ctacccccgcccccgggttcaagcaattgtcgcacctcagcctcccaagtaactgggattacaggtgcccaccaccaagcccggctaatttttctattttmaatagagatgaggttttgccatattggtcaggctggtcttgaactcttgacctcaggtgattcacccacctcagcctcccaaagtgcagggattaaggcg

SEQ ID NO: 57785 - DNA, 201 bp, Homo sapiens
tcaggctctcaggccctatccacagatgacctcacaacatgactgttggcttcttcaagactgaaggaggctcccccatgctctgagtcactctcttcagygagggcccagccccttttaagggcctagcgattagatcagtcccacttaggattgaatcccttttgattaatgcaaaaccaactgcgttcaggcctccat

SEQ ID NO: 57786 - DNA, 201 bp, Homo sapiens
caataaaaataaaaagctgtgtgggaagtcagaacttggttgcttcatgtcatatttcctatttttaagatttacagatattaacgactccttgggaaaastggacttcagtcgcctctctccaacaaaaaacgactattgggcgatgctggcttataacaggtccaagctctgcaacatcctcttctccaacgagctgca

SEQ ID NO: 57787 - DNA, 201 bp, Homo sapiens
ctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttc

SEQ ID NO: 57788 - DNA, 201 bp, Homo sapiens
tcaacttgcactctttcctgcatacagcttgtttctctaatgtggctgttctcatgtttacttaatggcccagccatctcctcctcctcctcctcctcctyctcctgctttctattctccttcctcatcattgtcctcttctgcgagttcagaaaattgggttacaatacctacaacgtgcagtgaggacactcttttatc

SEQ ID NO: 57789 - DNA, 201 bp, Homo sapiens
ttcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagagg

SEQ ID NO: 57790 - DNA, 201 bp, Homo sapiens
gtctgactccagaagcactttcctcttttgcctcctaatacattttcttatagggagcatcctgcaatacaactgttaagaccacttaatgttatctttgrattaaaaatggtaccactctcataaatcaatgagtttcataccctaaattatgccagattaagaaaatgaaatctgactgtaaattacttctctaggagc

SEQ ID NO: 57791 - DNA, 201 bp, Homo sapiens
aaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctat

SEQ ID NO: 57792 - DNA, 201 bp, Homo sapiens
tccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtgg

SEQ ID NO: 57793 - DNA, 201 bp, Homo sapiens
gtatacaagtttctgtgtggacatgttctcacttttcttgggtatatacttaggggtggaattgctgggtcatatgatcagtctaggtttaactttttgaygaactgacaaactgctatccacagtggctgcctgtaccattttacagaaaatctctgcttttaatacttctggatgtgttctaaggcactaggcttttca

SEQ ID NO: 57794 - DNA, 201 bp, Homo sapiens
aacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatg

SEQ ID NO: 57795 - DNA, 201 bp, Homo sapiens
tccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggttttt

SEQ ID NO: 57796 - DNA, 201 bp, Homo sapiens
gattacaggtgtgtgctaccacggccggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaatt

SEQ ID NO: 57797 - DNA, 201 bp, Homo sapiens
tgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagcgcttgactgttgttgttttttttaattgtcaaa

SEQ ID NO: 57798 - DNA, 201 bp, Homo sapiens
gaccttgtgtccgtccccgctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctga

SEQ ID NO: 57799 - DNA, 201 bp, Homo sapiens
ttcagtggagtgtgtaaagtttattgctcttggaatcatgtctttatttttaaagtcatcttcactttgtttgtcttatgaatgaaagcatgagcaagtcmattattattcacgcatttgtttgtagttcattgtcagtgtcatctgctttattagtcaggggtttgagaatgtttcttcctttaactcatttattaagaa

SEQ ID NO: 57800 - DNA, 201 bp, Homo sapiens
gcgtctcctcctttgccactcagccccagaggtgcttctgcttccctgcaggcttgccctggagcctggcgctagggccctggggctcccttgctcctgcktgccccctgcgcctgccttcctgctgcctggcctttctcccatctgctttcttcctgagtggcccctggccaggggactcgggtgcatacatggtttcca

SEQ ID NO: 57801 - DNA, 201 bp, Homo sapiens
gaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatct

SEQ ID NO: 57802 - DNA, 201 bp, Homo sapiens
agtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctgg

SEQ ID NO: 57803 - DNA, 201 bp, Homo sapiens
gggtcagttcaggcactgtgcgtaaagcacatagcaccgtgtctagtaggtactctctgttccttaactgtcgttccttgattgctcttaagatacgacartgcctcttatatcggcaccttagaatcacctaggaaatgtcctaaatacacgttttgggtctccatagagaacctactgtagccgactctcaactttggg

SEQ ID NO: 57804 - DNA, 201 bp, Homo sapiens
aaaatgggttgatatgagggtcagttcaggcactgtgcgtaaagcacatagcaccgtgtctagtaggtactctctgttccttaactgtcgttccttgattrctcttaagatacgacagtgcctcttatatcggcaccttagaatcacctaggaaatgtcctaaatacacgttttgggtctccatagagaacctactgtagc

SEQ ID NO: 57805 - DNA, 201 bp, Homo sapiens
ttttcacctgtaaaatgggttgatatgagggtcagttcaggcactgtgcgtaaagcacatagcaccgtgtctagtaggtactctctgttccttaactgtckttccttgattgctcttaagatacgacagtgcctcttatatcggcaccttagaatcacctaggaaatgtcctaaatacacgttttgggtctccatagagaa

SEQ ID NO: 57806 - DNA, 201 bp, Homo sapiens
ctgcaaactacccccgcccccgggttcaagcaattgtcgcacctcagcctcccaagtaactgggattacaggtgcccaccaccaagcccggctaatttttstattttcaatagagatgaggttttgccatattggtcaggctggtcttgaactcttgacctcaggtgattcacccacctcagcctcccaaagtgcagggat

SEQ ID NO: 57807 - DNA, 201 bp, Homo sapiens
tatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaatttttctattttcaatagagatgaggttttgccatattggt

SEQ ID NO: 57808 - DNA, 201 bp, Homo sapiens
cctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatc

SEQ ID NO: 57809 - DNA, 201 bp, Homo sapiens
caggttttaggcaataataagtgagcagtatggcgccctaatagaaggagggatgcctgtggccaatatacacggctcaaagttgaccatgatagagaagytttccctagaaggtctgtgagggaggaggcctgggagagacagcagggtgaccagagtaagtgaagtcaccgaggtgccaatgagtgtggccctgcaggt

SEQ ID NO: 57810 - DNA, 201 bp, Homo sapiens
gcaggttttaggcaataataagtgagcagtatggcgccctaatagaaggagggatgcctgtggccaatatacacggctcaaagttgaccatgatagagaasctttccctagaaggtctgtgagggaggaggcctgggagagacagcagggtgaccagagtaagtgaagtcaccgaggtgccaatgagtgtggccctgcagg

SEQ ID NO: 57811 - DNA, 201 bp, Homo sapiens
caaatatcttactcctgggctgtgctggggatggcagcagagtggggtggttggatgggaaggcgggaaagagctagcttggagatgatacgcttttccayccttgaataacttgggaaaaagtcaggagtgtggaatgaagaattggaatataaaggctgagggcggacctaattttttttttaaggattaagaaaaaag

SEQ ID NO: 57812 - DNA, 201 bp, Homo sapiens
aggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaaga

SEQ ID NO: 57813 - DNA, 201 bp, Homo sapiens
gaggttgcagtgagctgagatcacaccactgcactccagcctgggtgacagagcaagactgtctcaaaaaaaaaaaaaaaaaaaaaaaaattcaacatacsaattttgcgaggacgcaaacatttaatccgtagtactgatgtggatatgatttgagctaagactctgctgttgattctcttcaaaaacttggcagtagcc

SEQ ID NO: 57814 - DNA, 201 bp, Homo sapiens
ttttcaacgagagttcagaaccacaccatacgggcagtagtccgcattttcaacatttcctaacagcacaattgttaggtagctaacaattgaattgactrtgtcaggtagacttatttttcgagttgtgctggttaactgcaatccaagtttaggaagcaaactaccaatttcatttaatagaatgagctaaccaaggca

SEQ ID NO: 57815 - DNA, 201 bp, Homo sapiens
ttccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactatgtcaggtagacttatttttcgagttgtgctggtta

SEQ ID NO: 57816 - DNA, 201 bp, Homo sapiens
tataactatctgcatttcaggtacagtgatctcctttaaaaaggctgcgtcccagcagcatagaccagctttacctcccagcgtagtcttcagacaagttrgggtattgccgaagtccattcttgactttttttaatagtgcaaacaaatcatcttgtttttaggaaaacatgaaattataaagaaattgacttcaatcac

SEQ ID NO: 57817 - DNA, 201 bp, Homo sapiens
gccaaattgaagggtaaactgagttcaccaggcaaactgaggaagggtactcaggctgaaggatcatgggaggggaggagcgtgagttcctcttaagtgartataaaccagggggtaggaaacaacatgagatgaggctggcgagagagaaggatgccaggtgaggtgctgtggtgcgccagagactgcggaagtggcttt

SEQ ID NO: 57818 - DNA, 201 bp, Homo sapiens
aatctttcggtctaagcaaattaatgtcatttttataactatctgcatttcaggtacagtgatctcctttaaaaaggctgcgtcccagcagcatagaccarctttacctcccagcgtagtcttcagacaagttggggtattgccgaagtccattcttgactttttttaatagtgcaaacaaatcatcttgtttttaggaaa

SEQ ID NO: 57819 - DNA, 201 bp, Homo sapiens
ggccccctgcatctcaaagccagcaacagaaactctcttgtgcatggagtcccctcctgctttgaatctctctgactttccttgactttgatgtctaggtytggatttcaagggctcagaaactctctcatgcatgtagttccctcctgctttgaatctctctgactttccttgattttgatgtctaggtctggatttcaa

SEQ ID NO: 57820 - DNA, 201 bp, Homo sapiens
aatcaactcaattaccagccctctcagacattttcataatgttttctggtagttgctctcctgtgaaaatctttcggtctaagcaaattaatgtcattttyataactatctgcatttcaggtacagtgatctcctttaaaaaggctgcgtcccagcagcatagaccagctttacctcccagcgtagtcttcagacaagttg

SEQ ID NO: 57821 - DNA, 201 bp, Homo sapiens
acttttggccccctgcatctcaaagccagcaacagaaactctcttgtgcatggagtcccctcctgctttgaatctctctgactttccttgactttgatgtytaggtctggatttcaagggctcagaaactctctcatgcatgtagttccctcctgctttgaatctctctgactttccttgattttgatgtctaggtctgga

SEQ ID NO: 57822 - DNA, 201 bp, Homo sapiens
accaaggtcatactaatcaactcaattaccagccctctcagacattttcataatgttttctggtagttgctctcctgtgaaaatctttcggtctaagcaarttaatgtcatttttataactatctgcatttcaggtacagtgatctcctttaaaaaggctgcgtcccagcagcatagaccagctttacctcccagcgtagt

SEQ ID NO: 57823 - DNA, 201 bp, Homo sapiens
gttcagaggcagtgaaagcgtgcttctcaggactcattgtccagaagattctgcctacagctggttttacgcagagaagtagcacacaaacccagtccatsatttcttatttgactctgtcctgtttactctgtcagggtgaaaagcacaggccaagctcggctagtcaaagcattactttgtcacaggcaggcttggctt

SEQ ID NO: 57824 - DNA, 201 bp, Homo sapiens
gtattctgttccctctttgctagttcagaggcagtgaaagcgtgcttctcaggactcattgtccagaagattctgcctacagctggttttacgcagagaastagcacacaaacccagtccatgatttcttatttgactctgtcctgtttactctgtcagggtgaaaagcacaggccaagctcggctagtcaaagcattact

SEQ ID NO: 57825 - DNA, 201 bp, Homo sapiens
ttcccactgcagccggtagcatattgcttcataaatgtctataaaaaaatacgaaaaatagaatcagagcaaattcagcatagacctccttgggatgtttwttctttgtttatgttggtgttttgttttgtgttgtttcagctggggtgcagttgtattctgttccctctttgctagttcagaggcagtgaaagcgtgctt

SEQ ID NO: 57826 - DNA, 201 bp, Homo sapiens
aatatatggctttttcctattggaaaaaattagtcgtgtgaactttattcttcaagaaaaagtagtttttatctgccttggaaatgtcaaaaggattcacragtttcacaagtgatgatctgggttgattgctaggaactgtttttagttagtttttttttttttttttttttttcagacggagtcttgctctgttgccca

SEQ ID NO: 57827 - DNA, 201 bp, Homo sapiens
agccagacatggaatcctttcttatgattaatgcagctaaatttcccactgcagccggtagcatattgcttcataaatgtctataaaaaaatacgaaaaayagaatcagagcaaattcagcatagacctccttgggatgtttattctttgtttatgttggtgttttgttttgtgttgtttcagctggggtgcagttgtatt

SEQ ID NO: 57828 - DNA, 201 bp, Homo sapiens
cctaaggtcccagccacctatggttctttggacctgtgattttcgctgaccccgaatgactggaggaactgctgcctgcatccccaacccagccctccttrtcagtcacgtagaaagcagttattgtttccaagttccctgcccttgttaaatgtcagctttgagtgaaaatgttcctaattttactcagagtgcaaagaa

SEQ ID NO: 57829 - DNA, 201 bp, Homo sapiens
gtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtt

SEQ ID NO: 57830 - DNA, 201 bp, Homo sapiens
ccatgagtaacgaagtcctctgtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactcca

SEQ ID NO: 57831 - DNA, 201 bp, Homo sapiens
aaatatgtgtatatatatatttgttagggtaaaacaaagtctataaaaactgttttcctttgttattgcccccaccaaatatttatatatatatacacacctatgtatatatgtatgtatagagagtctattatatatattacatatacataatatatacataatatataatagactctataatatagactctaataatta

SEQ ID NO: 57832 - DNA, 201 bp, Homo sapiens
tttgggctgttattaggtagactctcctgggacattctacacagctcctgcctccttctgtatgtaatatatatattatatatatataaaatatatattakgtatagataatttatatataaatatgtgtatatatatatttgttagggtaaaacaaagtctataaaaactgttttcctttgtcattgcccccaccaaata

SEQ ID NO: 57833 - DNA, 201 bp, Homo sapiens
cctgagtagatgggactacaggcatgtgtcaccatgccaggctaatgtttaaaaatttttcttagaggtagagcctcactttgctgcctaggctgatctaraactcctggcttcaagtgatcctcctgccttgagctcccgaagcgctgggaccaatagagatttctctgagaattaggtcccccactattaataaggtca

SEQ ID NO: 57834 - DNA, 201 bp, Homo sapiens
tgcagactgtataggcttctgcctctcgggaggcctcaggaaacttacagttatggcagaaggtgaaggggaagcaggtaatgtcttcacatggctggcastggaggaagagagaaagtagggaggtggtagatgcttttaaacaaacagatctcaggagaactctttcacaagacagcactagggggatggtgattagaa

SEQ ID NO: 57835 - DNA, 201 bp, Homo sapiens
tcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatg

SEQ ID NO: 57836 - DNA, 201 bp, Homo sapiens
acgagacactcattccgaaggcgggtgtgtatgtgcaaactgtataatttttttcttcttttctatctgctagcaaagtgggtaagttgacccatgacatsgtccactggagggaccacatttgtgactctagcaattaagcctcccttctcatctgtggataaaactgacctcccagtgtgctggagtcaaacatattca

SEQ ID NO: 57837 - DNA, 201 bp, Homo sapiens
acaaggcagtagaggttggacgagacactcattccgaaggcgggtgtgtatgtgcaaactgtataatttttttcttcttttctatctgctagcaaagtggrtaagttgacccatgacatggtccactggagggaccacatttgtgactctagcaattaagcctcccttctcatctgtggataaaactgacctcccagtgtg

SEQ ID NO: 57838 - DNA, 201 bp, Homo sapiens
gtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgc

SEQ ID NO: 57839 - DNA, 201 bp, Homo sapiens
gaaagagagggaactgaacgggatgctttttattttgggctgttattaggtagactctcctgggacattctacacagctcctgcctccttctgtatgtaayatatatattatatatatataaaatatatattatgtatagataatttatatataaatatgtgtatatatatatttgttagggtaaaacaaagtctataaaa

SEQ ID NO: 57840 - DNA, 201 bp, Homo sapiens
atctatatatagatatctatataatatatataatctatatatgatatatatatcttattatatattatatatatagatagatatctatatacagatatctrtatacagatatctatatatatagatatctatatatatagatatctgtatacagatatctgtatatatatatagaaagagagggaactgaacgggatgctt

SEQ ID NO: 57841 - DNA, 201 bp, Homo sapiens
tattttttctagtttttttgttttgcttaataggctctctctctgtctctttctttctatatatatatataatatatagaaagatatataatctatatattgatatctatataatatatataatctatatatgatatatatatcttattatatattatatatatagatagatatctatatacagatatctgtatacagata

SEQ ID NO: 57842 - DNA, 201 bp, Homo sapiens
taaatagtggatgtattttttctagtttttttgttttgcttaataggctctctctctgtctctttctttctatatatatatataatatatagaaagatatrtaatctatatatagatatctatataatatatataatctatatatgatatatatatcttattatatattatatatatagatagatatctatatacagatat

SEQ ID NO: 57843 - DNA, 201 bp, Homo sapiens
cctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccc

SEQ ID NO: 57844 - DNA, 201 bp, Homo sapiens
cactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaag

SEQ ID NO: 57845 - DNA, 201 bp, Homo sapiens
cagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcc

SEQ ID NO: 57846 - DNA, 201 bp, Homo sapiens
acaagtcacagggcttatctccattgttctgaacgatctgtagctaaacaaaaagataaaagctattaatattattaatagttgtagattaccgggaagarcgcatcctaaatcagccattagatttgttcctcatttctttgctttacaaattgtttttctgtatagtattggattttcaataaataaagtatgatataa

SEQ ID NO: 57847 - DNA, 201 bp, Homo sapiens
gcaagtgtgatcattcaggtaatcaaagtaactacagaaacagaggtatggattagctagtcattgcagatgtggcattgagcatataagcgtggtgtacwtcttagaacttcatctggaaatgcctgtgggggagttggatttcaagatcatcgtcaatgtcatgtcactgtaatttcatttacattaatcagattagtt

SEQ ID NO: 57848 - DNA, 201 bp, Homo sapiens
tcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaag

SEQ ID NO: 57849 - DNA, 201 bp, Homo sapiens
atgcggaagccttcgcccccttcttgagggtgtttagggattagatgagtgtcccatctgggtttcccatccctgcagagcccacgtgtggggtgctgagrggtacgtggtgggtgactccctggggagcactgtttggtactgatcactgtcccatcctggcactgcagtcctgggacagtctacacagctcctgcctcc

SEQ ID NO: 57850 - DNA, 201 bp, Homo sapiens
ccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagg

SEQ ID NO: 57851 - DNA, 201 bp, Homo sapiens
tacaagggccggatgcggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaa

SEQ ID NO: 57852 - DNA, 201 bp, Homo sapiens
cgaatggttttccaatcttcaaaccaacctatatcacaaaagcattctgaaaactgggaagagatcacttcacagtttcctgaaccactagaaaaaaaaaatgttcataaatttatagccgctgacattgaagttggagaaaagagcatatctagtacctatgctatgtggagaacactctccatgtctttgaaaaataag

SEQ ID NO: 57853 - DNA, 201 bp, Homo sapiens
gggttttaccatgttgcctaggctggtctcgatctcctgggctctagcaatcctcccacctcggcctcccaaagtgttgggattacaggcgtgagctaccrtgcccggccttacgtttcagcatctttcaatccatctaatacgcagtgccagggaaggtttgtgaaaacatttgaatcacagagtcacaaacagtgagaa

SEQ ID NO: 57854 - DNA, 201 bp, Homo sapiens
aaatcaggatgctcaggaaataccttgtttggaataggaataggctcctccctttttttctcacttgccttgattgctctgtattaaaattcataaaggcycatgaattatcaattagatagcatttggtttgttatttttagtttcttcctatagcaggcatgtatgcatgtgttaaaaatggaagtagcgtcgacatta

SEQ ID NO: 57855 - DNA, 201 bp, Homo sapiens
aaacaaaaaggaggataccaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcact

SEQ ID NO: 57856 - DNA, 201 bp, Homo sapiens
ttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctggg

SEQ ID NO: 57857 - DNA, 201 bp, Homo sapiens
ggtcttctaattctctgtgatgaagttcaaactgaagactgttactagtgtcgtgtttgtttctttttctctctcttttgttttgtttgtataaaatgccrgggatgaagggatccacttaataaaaaggcccattgtgttcagggagcagcctgttctgccaaatcacacaagggcatgtgttttcatgacattattgct

SEQ ID NO: 57858 - DNA, 201 bp, Homo sapiens
gtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgactgaatacattaccacctccca

SEQ ID NO: 57859 - DNA, 201 bp, Homo sapiens
gctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattca

SEQ ID NO: 57860 - DNA, 201 bp, Homo sapiens
gaaaagattactgacgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttg

SEQ ID NO: 57861 - DNA, 201 bp, Homo sapiens
cactttctgttggactgcttttggaaaaagaaccacaagtctctatttttaaaatagaggtacaatgataaaacaaaacaaaacaaaacaaaaaaacaacaaaaaaaaaacccacacaggtctcatcagccaagggatttaaaaatcaaatttaacttcaaaaaactgaagttgatatagcaggatcttggagatgcagtt

SEQ ID NO: 57862 - DNA, 201 bp, Homo sapiens
tgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagcctttaaaagaaccaactctctgggaacaaatagagggagaacattaatctagccatga

SEQ ID NO: 57863 - DNA, 201 bp, Homo sapiens
cacaaatgtgatccttctggaggccagaagatagattcagtgggccccagttctttcaggtttaaggaataagcattttggtctatgaaaaatggggtttkcctaaagtataagattgtcttatatttataaatgcctgtgttcattgctgtgggttcactgctttctcttttgggcagccatataaataaaagaaccacc

SEQ ID NO: 57864 - DNA, 201 bp, Homo sapiens
ccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacc

SEQ ID NO: 57865 - DNA, 201 bp, Homo sapiens
aaagcacacacaatgatggccagagacactgctcagtgtactgtcttccaccgggacagcccactcaccaagggttaggtcctgtgctgactgggtcccgkgtctcctcggaggtcggtttgcatcacgtggatacactaatctacccaagttgacttggagaaccaatctgaaatcagatgggagctcccggaagcaaag

SEQ ID NO: 57866 - DNA, 201 bp, Homo sapiens
tgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatt

SEQ ID NO: 57867 - DNA, 201 bp, Homo sapiens
cattaaataacatgtccaaagtctcccatttcagagacaggggcatttggctccaggtttttctgactctagacagtagtttgtttttagcacatcaaatktctgagacttgtgatgtgttagaaagcacaaaggactttgatcacaagatcaagccccagagggccatgactgcataaaccacaacaactgcgtggctgc

SEQ ID NO: 57868 - DNA, 201 bp, Homo sapiens
acaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagata

SEQ ID NO: 57869 - DNA, 201 bp, Homo sapiens
aatcccagctgctagggaggctgaggcaggagaatcacttcaacccggaaggcggaggtttcagtgagctgagatccagcctgggtgacagagcaagactycatctcaaagcgaaacaaaacaaatgagggtcctcatcagcgtgcctttgacactgtcctctggtcctggtgatctgaatacatcaccacagaactgcca

SEQ ID NO: 57870 - DNA, 201 bp, Homo sapiens
agagcaagactccatctcaaagcgaaacaaaacaaatgagggtcctcatcagcgtgcctttgacactgtcctctggtcctggtgatctgaatacatcaccrcagaactgccagggtacgtgtttcctagcccatagcgagtcccagtgaaagcagagatgagaaagaaaggagggacacaaggtctgggtcctgagttcca

SEQ ID NO: 57871 - DNA, 201 bp, Homo sapiens
tgctggattatctagtccctgaacagccatttatatttttgttacgcttgtggtttttaaatcatcctcatttccttgatcgcatttgcttctcctggctrgaatgtgtaggagacgggtcggggagactgtgcccatttgacaggtgtgaatgcgaacagaggctgcagctggttagaccagggctgtgcaaccctagag

SEQ ID NO: 57872 - DNA, 201 bp, Homo sapiens
gcttgtggtttttaaatcatcctcatttccttgatcgcatttgcttctcctggctagaatgtgtaggagacgggtcggggagactgtgcccatttgacagrtgtgaatgcgaacagaggctgcagctggttagaccagggctgtgcaaccctagagccattgccttgaccacaaagccacagtctcctagtcctaatatta

SEQ ID NO: 57873 - DNA, 201 bp, Homo sapiens
ttaaatcatcctcatttccttgatcgcatttgcttctcctggctagaatgtgtaggagacgggtcggggagactgtgcccatttgacaggtgtgaatgcgracagaggctgcagctggttagaccagggctgtgcaaccctagagccattgccttgaccacaaagccacagtctcctagtcctaatattaagaggtaggag

SEQ ID NO: 57874 - DNA, 201 bp, Homo sapiens
ggagacgggtcggggagactgtgcccatttgacaggtgtgaatgcgaacagaggctgcagctggttagaccagggctgtgcaaccctagagccattgcctygaccacaaagccacagtctcctagtcctaatattaagaggtaggaggtagatagagattgtcccttaagccacattccattcttcatatttttgtaccca

SEQ ID NO: 57875 - DNA, 201 bp, Homo sapiens
gacttaatcttcatgatgtttgtaaagtaatacttcttggagaaacctcccaaatttctatcgacactagacatctcaggatttgaaatgttaagctaacraattgttcatcaggtgtatctccagccctccgtaaacactgccggatggatgaacctacgtaatgatctcctggtgccattttcctgactgtagatactt

SEQ ID NO: 57876 - DNA, 201 bp, Homo sapiens
ttcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcc

SEQ ID NO: 57877 - DNA, 201 bp, Homo sapiens
tgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaa

SEQ ID NO: 57878 - DNA, 201 bp, Homo sapiens
gctccctggaagatggatcttgccttgtggatgtttttctaccgtgacagaagatagaaaggatgaaatagaaagagtgtgagtgaattctgcacccaccmcccccccccagcttccccacctgtaaaatgatttgctcaaagtttgcaaagaatggaggcatattcaaagtgctcagcactgggccggacccatgggtat

SEQ ID NO: 57879 - DNA, 201 bp, Homo sapiens
ccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccaga

SEQ ID NO: 57880 - DNA, 201 bp, Homo sapiens
agtttgtcttggctctgatcacccctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgcccctt

SEQ ID NO: 57881 - DNA, 201 bp, Homo sapiens
gtgttcttgcctggcttattgagctccatggtaaatgttcagaggctgcaggaatgattcaaagtctgactgatttatgtgcattgggcattttgttgatrtcattcagattaatgatggcactgaaaatgtgtaatggaaatgagaagtttgtatcctgcctgctataccatgattccaatttaagagggggtaaaaata

SEQ ID NO: 57882 - DNA, 201 bp, Homo sapiens
agaaatactcccttctggacactggaagggcaaatgaggtgcaagccttttttttttctttcttttcttcttcttcttcttcttttttttttttttttttttgtttttcctcccagcctctctcctttcccattatgcacaatgcgctgagaaaggattcccagtccccctggtaaaaagtctgaaggatgccgaggagtt

SEQ ID NO: 57883 - DNA, 201 bp, Homo sapiens
gttcagaggctgcaggaatgattcaaagtctgactgatttatgtgcattgggcattttgttgatgtcattcagattaatgatggcactgaaaatgtgtaayggaaatgagaagtttgtatcctgcctgctataccatgattccaatttaagagggggtaaaaatattgcactttttaatctattgttttttgaaagagact

SEQ ID NO: 57884 - DNA, 201 bp, Homo sapiens
agagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgt

SEQ ID NO: 57885 - DNA, 201 bp, Homo sapiens
tacagtggctcatgtctgtaattctagcactttgggaggccggggcgagcaaattgcttgaactcaggagttcgaggctagcctgggcaacacggcaaagscctcatctctacaaaaaatacaaaaattagctgggcttggtgacagacgcttgtagtctcagctactcgggaggctgaagtgggaggatctttagagccc

SEQ ID NO: 57886 - DNA, 201 bp, Homo sapiens
gtcactccatagagaggggtttgtggaaatcctttttttttttttttttttttttgcttctttctgtggatctgtttggaaatgtaacattttaaagcccytcttggctggaggattttttatggtaaacataaaacgttcattgaaacattaaacattttacagctgtttttcagcacataaattttcatagacatccac

SEQ ID NO: 57887 - DNA, 201 bp, Homo sapiens
aaaacgttcattgaaacattaaacattttacagctgtttttcagcacataaattttcatagacatccaccccctcactgccacaccccctcatagatttcytcttttcctcctccttctcctcctccctcttcctcctctttttccccccccttcaaatagttccaagaccagagttgagggtgggtgggtagagggctag

SEQ ID NO: 57888 - DNA, 201 bp, Homo sapiens
gttgacctggaatgacctagaccagcagtcacaagctcctgcccatggacaaaatacagccggtacctctttggctatggcctgcaggctcagaatagttyttacattttcaatcatctgcaaaaaagaataaagaggagaatattatttcttgaaggaggaaaatgatatggaattctgatttcagtgtcataaagtttt

SEQ ID NO: 57889 - DNA, 201 bp, Homo sapiens
aaactataatctttctctctgcctcagtttttccacctgtcagtggaggggcatgctcttggatgcctgagtttttcttagactcagcatcctgcagccgmaataaccatgcttcttagtggtcctcttgcgtagcagcctaagaaactccaagtccatctgcgccgaagagtattgaacttggccagagcacttgggatc

SEQ ID NO: 57890 - DNA, 201 bp, Homo sapiens
taattatataaaaaaagcatggaaactgggcattttaattagcaagtacagccttgacacaaataaaggcatggctttggttatgcagtgcatttatttgrttttcttgaaataagaaaaaaagatttcttctccatcaccagagttgctgagtttgacagtgtgaatgagatgacctctaaggcctctacttatagatct

SEQ ID NO: 57891 - DNA, 201 bp, Homo sapiens
tgggcattttaattagcaagtacagccttgacacaaataaaggcatggctttggttatgcagtgcatttatttggttttcttgaaataagaaaaaaagatwtcttctccatcaccagagttgctgagtttgacagtgtgaatgagatgacctctaaggcctctacttatagatctgcacggttgggcctgggagctgtact

SEQ ID NO: 57892 - DNA, 201 bp, Homo sapiens
acagtctgtgctgtgtcctgcactgtccattatctgcaggggtggtactgctgtccccagggaagagaatgctgtccacaaagagccagccatttatactmttaaaagaatacacaggagttgaacaatgagaacacgtggacaacgggaggggggaacatcacacaccggggcctgtctgggggtagggggaaaggggag

SEQ ID NO: 57893 - DNA, 201 bp, Homo sapiens
tttcgagaaggcaatatagaaaatgcagtgggtagcccaggactcctggtccaggtaaagcaggccttgttgctattcccctggaccatgatattacatgytgggatgatggggtcttgtgatactgattaatttaaggctgcatgatgatgagggaggaacaaagatgttcttgagtcagtacctgccagagtggctgta

SEQ ID NO: 57894 - DNA, 201 bp, Homo sapiens
gtctcaagctgctgatttccgggagcaaagctgctgtgggacatgagactctttgaggcagaatacctctcatgcctggagagcattacaggctgcattastctgttttcactctgctgataaagacatacccaagactgtgcaatttacaaaagaaagaggtttaatgaactcacatttccccatgtctggggaggcctc

SEQ ID NO: 57895 - DNA, 201 bp, Homo sapiens
ggcctggtcacatcttctgacctcaagtagtttatagtccaaaaagacattggctctttgggatagaggcactttttgggggagagaaacatgaatgcaaytttttacatagagtatgaaactctgttccaaatctctcaaactcaggttctttgattcttaaggtatttttcactgccgagttgctgtcattgaaacaaa

SEQ ID NO: 57896 - DNA, 201 bp, Homo sapiens
tctctcaaactcaggttctttgattcttaaggtatttttcactgccgagttgctgtcattgaaacaaaatctgtcctggtcaccactgtatgcccagcacstagtacagtgccctgaacatattaggtactcattaaatacttgttccacgaagttgttatttggtattcacgagttttgtctcaattccttttgattctt

SEQ ID NO: 57897 - DNA, 201 bp, Homo sapiens
ctgggacaaggacgatggacaaagttatgggggtgctaaaaacctcagtaatgaagataaatgatattctaatctaatattttaaaaaatcgaggctaggygtggtggctcatgcctgtgattccagcattttgggaggccaaggtggacggatcaccagagttcaggagtttgagaccagcctggccaaaatggtgaaat

SEQ ID NO: 57898 - DNA, 201 bp, Homo sapiens
agttatgggggtgctaaaaacctcagtaatgaagataaatgatattctaatctaatattttaaaaaatcgaggctaggtgtggtggctcatgcctgtgatyccagcattttgggaggccaaggtggacggatcaccagagttcaggagtttgagaccagcctggccaaaatggtgaaatgccatctctactaaaaacacaa

SEQ ID NO: 57899 - DNA, 201 bp, Homo sapiens
cagcctgggcaacacagcgtgactccatctcaaaacaaacaaacaaaacaaaacaaaaaaggtttaagaaatgttctagtaccttgaaaccaaaataggtrtcagatacttggctgttttgttttttcttcttagccattttgacctgtgagattttatgtgatgaaaacataagaatgtggtattacaccctgtgatttg

SEQ ID NO: 57900 - DNA, 201 bp, Homo sapiens
ggtatcagatacttggctgttttgttttttcttcttagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaaacattcagtggctc

SEQ ID NO: 57901 - DNA, 201 bp, Homo sapiens
cagatggagggaaagagaggcgggggattccaggtacagtggctcatgtctgtaattctagcactttgggaggccggggcgagcaaattgcttgaactcasgagttcgaggctagcctgggcaacacggcaaagccctcatctctacaaaaaatacaaaaattagctgggcttggtgacagacgcttgtagtctcagctac

SEQ ID NO: 57902 - DNA, 201 bp, Homo sapiens
gagaggaagcaaagtgagacagaggtggtgtgtgagcgtgtgtttgtgtgtgtgtgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcagg

SEQ ID NO: 57903 - DNA, 201 bp, Homo sapiens
cgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccagga

SEQ ID NO: 57904 - DNA, 201 bp, Homo sapiens
attgcttgaatccaagagatggaggttgcagtgagccaaggtcgtgccactgcactccagcctgggcaaaagagtgagactccatctgaaaaagaaaaaagaataggcacagacaatttacctggatcctcacattgcaatgctgaccactccggaaggagtgtagaagttgcagctcatgcctgcattccaaatggctgc

SEQ ID NO: 57905 - DNA, 201 bp, Homo sapiens
ccatgtggcacatacccctgtacatgtttgccaagactgctatatggtagagcttggaattcttaggagctttatcaggtaattgcaagtcccccacctcyaagaaagcactctctaggtcaagaatcagcaaatgttttctatagaggcccgtaaaattaatattttatactttgtgggtcatatagtctctgtttcaat

SEQ ID NO: 57906 - DNA, 201 bp, Homo sapiens
gaggcaggaggatcacttgagcccagaagttcaacattatagtgagccactgtactccagctgggtaacagagtgagaccctgtctctgaaaaataaaaayaaaaaaaaaaattaagttagaagggagggattacgaccctcatgtgtatcaagaaacaagctccatgaagccccgtaggatggctcagcaccagaacgag

SEQ ID NO: 57907 - DNA, 201 bp, Homo sapiens
aggcaggaggatcacttgagcccagaagttcaacattatagtgagccactgtactccagctgggtaacagagtgagaccctgtctctgaaaaataaaaatwaaaaaaaaaattaagttagaagggagggattacgaccctcatgtgtatcaagaaacaagctccatgaagccccgtaggatggctcagcaccagaacgagg

SEQ ID NO: 57908 - DNA, 201 bp, Homo sapiens
tgtctgtgtgtgtgtgtgtgtgtgtgtgtgtgtttgaataatactcctatgaacattgtaccaatatctattcagatctctgctttcgattcttctgcatrtatacctaggagtgaaattgctgcgtcgtttcgtatctgtgtgcttaaccttttgagaaactgccaaactgtcttcaacagcagccgcatcattttacat

SEQ ID NO: 57909 - DNA, 201 bp, Homo sapiens
gtggattggtaagggacaggtggtgaagactgaaacagggtatccagttaggaagctaccacagtgatccaacccccagcttctgttgaggttgaagaacmtgcatgcccaacctaaatatatgttcaaaggtggttattactgtttgaggtgatgaaagagttttggagatagaagtgatggttgttcaacatcatgagt

SEQ ID NO: 57910 - DNA, 201 bp, Homo sapiens
agccctttcttgtttagtgttgtgtcttctgtgtcaacatctctggaacatagtcaatggcagtacccagtagaagccatatggatactttttctcaagtsttgaaataaattaatggtgtggccatggttctcgtacttcaggtccctgtgagcccctggggtcctacacaacttggggtaatgctatggtcacctgcat

SEQ ID NO: 57911 - DNA, 201 bp, Homo sapiens
cctggggtcctacacaacttggggtaatgctatggtcacctgcatcccctcctctccagccctcacctggttttctcttctccttccaagaaaaaacaccyataccattcttaacatctctggaagctgggggtcaggagagggagatccataaagttcttgtcttccccgactcaagaagcttaagggtacattcactca

SEQ ID NO: 57912 - DNA, 201 bp, Homo sapiens
tggtaccctgagcaattttaagttataaatatgagatcactgaaagtggagttggggaacacgttattatatagtattttcaccacacacaggatacagtmaatgacttcaagagcataggtaacagtaaaatgtagtaaaacaatttagaagtcatgagttttgagtacttagtactttttagtatgatttatttaatag

SEQ ID NO: 57913 - DNA, 201 bp, Homo sapiens
tgggattacaggtgtgagccaccgtgcccagctcagcattattatttttagtctacacacagtgaacttaaatctcctctagaaaagtcagaaggtctacstacaactttaagagttcagccaaaagagaccagtatctactaccgtggacaaccctatttaacatggaggagataagcagaaactgaaaagaggagcctg

SEQ ID NO: 57914 - DNA, 201 bp, Homo sapiens
ggctattatgtgaagttaggaaatatttaaaactctgcctttctaaagaaacagggacacggtgcagaaaagttcatctggagttaggcttgtgtcttgcygtctctttaacggagagttcatgggcagggtacagtctgtgagaaggaatgaaaaccccagggtagatgctaacaaaaatcacttttaaaaaatgtatgg

SEQ ID NO: 57915 - DNA, 201 bp, Homo sapiens
tggtgtccatctgggttagcaaacacatgctcacacgtctgtgcttgctggatttttaagaacttaccagcatttaagattttcttatgaaactgattttwctcaccagggatagagtctcaaagttggaggtattttatgttgttttaaataatatcgtcatcacatgtcattttagaccccaaaagtccactccgaatc

SEQ ID NO: 57916 - DNA, 201 bp, Homo sapiens
agttcctctccaaactgtcaaggacagtgccaagatctgcgaatatagaaagattaagagtttttttctgccttgttgggtcttctttctagcatgccagsaacatttttctcatcttttgaacattagggaataacacccaatgccaccctataatctcgagacagaagtggaggatcctcttaagacaagaaatctttc

SEQ ID NO: 57917 - DNA, 201 bp, Homo sapiens
agatctgcgaatatagaaagattaagagtttttttctgccttgttgggtcttctttctagcatgccagcaacatttttctcatcttttgaacattagggamtaacacccaatgccaccctataatctcgagacagaagtggaggatcctcttaagacaagaaatctttcaaagccaaataatgaattaatccaaagccact

SEQ ID NO: 57918 - DNA, 201 bp, Homo sapiens
cttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaaatgaatcaa

SEQ ID NO: 57919 - DNA, 201 bp, Homo sapiens
tctaatattttaaaaaatcgaggctaggtgtggtggctcatgcctgtgattccagcattttgggaggccaaggtggacggatcaccagagttcaggagttygagaccagcctggccaaaatggtgaaatgccatctctactaaaaacacaaaaattagctgggtgtgtggtagtgtgtgcctgtagtcccagctactctgg

SEQ ID NO: 57920 - DNA, 201 bp, Homo sapiens
atttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctg

SEQ ID NO: 57921 - DNA, 201 bp, Homo sapiens
gggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggaca

SEQ ID NO: 57922 - DNA, 201 bp, Homo sapiens
ctgcttgaacctgggaggcagaggctgcagtgagtcgagatcacaccactgcactccagcctgggcgacagagtgaaactctgtctcggaaaaaaaaaaaaagagtttaattcatgcagagctggctgtgtgggagaccagagttttattattactcaaataagtctcccccaaaactcagggatagagatttttaaggag

SEQ ID NO: 57923 - DNA, 201 bp, Homo sapiens
agggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaa

SEQ ID NO: 57924 - DNA, 201 bp, Homo sapiens
aaatatttattttgagagcaagcacgggggtttatgtgatggctccacagagcagtgaaaagactcccgccctactgctcgcaacctcagatgtccctggscactagcccatctgtatgtctttaaaaaaaataaattaaatttttaaaaacatgactttctggccaggcgcagtggctcatgcctataaccctgcactta

SEQ ID NO: 57925 - DNA, 201 bp, Homo sapiens
tccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagt

SEQ ID NO: 57926 - DNA, 201 bp, Homo sapiens
aaccatttcacaaatatttattttgagagcaagcacgggggtttatgtgatggctccacagagcagtgaaaagactcccgccctactgctcgcaacctcaratgtccctgggcactagcccatctgtatgtctttaaaaaaaataaattaaatttttaaaaacatgactttctggccaggcgcagtggctcatgcctataa

SEQ ID NO: 57927 - DNA, 201 bp, Homo sapiens
gactcatttaaccatttcacaaatatttattttgagagcaagcacgggggtttatgtgatggctccacagagcagtgaaaagactcccgccctactgctcscaacctcagatgtccctgggcactagcccatctgtatgtctttaaaaaaaataaattaaatttttaaaaacatgactttctggccaggcgcagtggctca

SEQ ID NO: 57928 - DNA, 201 bp, Homo sapiens
tttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttaaagtatacccatacccattgtacacatttggtattttttctttaaaaaaaaaa

SEQ ID NO: 57929 - DNA, 201 bp, Homo sapiens
gaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtt

SEQ ID NO: 57930 - DNA, 201 bp, Homo sapiens
aattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgcaattgcttaaaaatggaagttctgaaaataaataaaaagaaacatc

SEQ ID NO: 57931 - DNA, 201 bp, Homo sapiens
caatagaaacaccaagaacatggattcatcaaaggaaaaatgttgaagtttccatttttatgcttcctggtaatccttcagcccttgatggaaatttccaracctaaaccagtgaattaagagtatggggaagaggagccctcatacagttctgttaaatggtcctttaatattcttcttcagagtgacgggtaccccttg

SEQ ID NO: 57932 - DNA, 201 bp, Homo sapiens
ccacaatacgcctccctttggcgtgaaatggggcagaaagtgccccaaacagctgttattttcgcagtgattcattcattcattcattcattcattcatthattcatccacccatccattcattcattcactcatcacatggcaactcatcacccctgtataccagacccagtgccaaatactggggagatgtgtgtgaac

SEQ ID NO: 57933 - DNA, 201 bp, Homo sapiens
gggcctaggcccaagcaaccaggactccctgtagtcaaccccactcctcaatttttggcacccatgttattccacctcaagatcatgtcctcttttaaccyctctgaatatgctcctcctgtgatacccatagggaccctgaacctctagtcctcaagagcagtcattcacccctttggactatggatccctttgcaaccc

SEQ ID NO: 57934 - DNA, 201 bp, Homo sapiens
atgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttg

SEQ ID NO: 57935 - DNA, 201 bp, Homo sapiens
gcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaa

SEQ ID NO: 57936 - DNA, 201 bp, Homo sapiens
ttgtcttctcctctgagcgggaactgggcaattggaggttctttcccctcccgtgctggtgggagaattgtttagtaggtcataaagtggaatctccattycagtctgatccggtcaattctggtaggacttcatccaagcacaaagaaacctttgttttcattcaagacttccctaaaaggtggctgggtgcggtgctca

SEQ ID NO: 57937 - DNA, 201 bp, Homo sapiens
atcgtgtccagcctaaatggcattcttggaagtaaaaccacaggggatctgttggaagtggcatgatggaggaattttaaaagaattgaacaaataaaatrgtcagagctcaaaaattgagtactgcttcgtttctcccaaataaccatcaccagacaaacaggtgtgtgtgtgggtgggggaggtggcctggtggtactt

SEQ ID NO: 57938 - DNA, 201 bp, Homo sapiens
ctgtctgttttcttttctttcaaatgtttcacttaattccctgatataataaggcttccaaattcttggtgtttttctacaaccaagaccttgaacttttkcctctcaggatttctttcatgagaacccattttctggccatttggatatcattgatgagggaattgaagcatttccctattctttagagtttcattaaag

SEQ ID NO: 57939 - DNA, 201 bp, Homo sapiens
ttccagtaacaattgttgcataacaaaccacccccaaatttagtggcttaaaacaacaacatttattttgttcaggaatctgtagtttcagcagggctctsaggaacagcttgtctctgctccagcatcagctgaagcagcttgaaagccagggtctgagatcatctgaaggttgttcactcatgagtctgaggaatgatg

SEQ ID NO: 57940 - DNA, 201 bp, Homo sapiens
gtctcaaggaactatgataagtagcaaacaatatcccagaaaaatctccagtcaaaaatccactggaggccaggtgcgttagctcatgcctgtaatcccarcactttgggaggtcgaggcaggaggatctcttgaggctaggagctcgagaacagtctgggcaacatagcaagtctctgtctctacaaaaaatacaaaaat

SEQ ID NO: 57941 - DNA, 201 bp, Homo sapiens
gctctcaggaacagcttgtctctgctccagcatcagctgaagcagcttgaaagccagggtctgagatcatctgaaggttgttcactcatgagtctgaggawtgatgctgactggtgggtgggacccttgctggagggtctattggctggaacacctacacattgtctccatgtaccctgagcttcctcacaatatggcggc

SEQ ID NO: 57942 - DNA, 201 bp, Homo sapiens
gttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccc

SEQ ID NO: 57943 - DNA, 201 bp, Homo sapiens
actcaacagttgctaatgttttgccatgttttgtcagttcatctatctgtccatctctttgtccatccatccaactacccacttacccatccatccatacrtttatccatccatctacccacccatccgtccatccatccatccatgcatccatccatccatccatcatccatccatgcatgtaagttgcagacatcaaca

SEQ ID NO: 57944 - DNA, 201 bp, Homo sapiens
agtcaatttcatctaggagcattttatggcttatggaaagaaatattctcttagattgaagggcgccagcctgtaatgggcatcagctgattctcagaaaraagaaacaacgtactgttacataattggggcttctccaaagtggcctgaccaaactgtagagctgcttgtttgtctgatacggtagccattagccacatg

SEQ ID NO: 57945 - DNA, 201 bp, Homo sapiens
aaagtggagttggggaacacgttattatatagtattttcaccacacacaggatacagtcaatgacttcaagagcataggtaacagtaaaatgtagtaaaasaatttagaagtcatgagttttgagtacttagtactttttagtatgatttatttaatagtaaccttatataatgtttttcttttaattgttttattgagat

SEQ ID NO: 57946 - DNA, 201 bp, Homo sapiens
tccattttaaagcgttattgaatccatactaacctgatcattacatatttactaattgatgattactaaaaatgtggacctttgtgaatttccgatgtcayagaagggtgttcttaactggaaaagtcagtagccaacattctgggaagtagaggcctcttcctcactgcttcattggtttaaaataaactccaacagaaa

SEQ ID NO: 57947 - DNA, 201 bp, Homo sapiens
cgtggtgtgtgatcttgaccactagcctaaactgctattttatgtccacccatcaacctctacggctgcccctcatttgaacacacaaaatatagttgtgyggcttggtggagccatctaaattccgttaggccatttgccaatgctgctattaggggcgaaatgtcatgcgcttgatctaaatgtacttaggagaattct

SEQ ID NO: 57948 - DNA, 201 bp, Homo sapiens
cacctggatctgttaaatggcagcttagctatgaaatatcatgttctgcccaatcacctaccctgcctcatatgatcagccggtatatttatgtggacacrtgcagccacacttgtttttaacatttgagaatgacagcgtattggcagttcatataagctatcaaatattacatgtcaactcagaaaacatccctaggaa

SEQ ID NO: 57949 - DNA, 201 bp, Homo sapiens
ctgttgtacactgtcccttcaataaaagttgctaacaccaccaccttgcccttgaattctttcctgggcaaagccaagaaccctgttggcctaagccgcarttctggggttcgcctgccctgcatcaccagcacagtggaaggccacaagctcacagcattttcatccgtaaacaaagcttggcaatatctctgatggtta

SEQ ID NO: 57950 - DNA, 201 bp, Homo sapiens
ggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttg

SEQ ID NO: 57951 - DNA, 201 bp, Homo sapiens
agggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgc

SEQ ID NO: 57952 - DNA, 201 bp, Homo sapiens
acattttttcctaaacaacatcaatgtcataacagttttgaagcacatatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatca

SEQ ID NO: 57953 - DNA, 201 bp, Homo sapiens
ttaaacaattactgtatctgatttttcatttttcattttttttttttctggaagaaagagcagatctggataaagtcagtatacaatgtggtctttggtgmcagacccaagttcaagaccaaggtgtatgcatgggtttgttcaagttgtctacccttattatcccctcagtgaaacatgattaaccatgcttaccttgaa

SEQ ID NO: 57954 - DNA, 201 bp, Homo sapiens
gaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctgggccttctgaga

SEQ ID NO: 57955 - DNA, 201 bp, Homo sapiens
tgctgtcctggttttcacactgaaagttccgtatcctaataagcctctcatcctcagcaacggaggacagttgcccactcaaagccttgtgacattctagrgtatcctatttctacatggtgggaatctagaagacggagaaagaatttctcattcccgaaggagcatggattatccttggttgtagtgtttatgtccaca

SEQ ID NO: 57956 - DNA, 201 bp, Homo sapiens
taagactggaatgtgggtgtgtgcactcctcatgttccggtttctgtgatcattcaggcatgcacaggtatcctgatgggtagccaggtcattaggcccaragtcggcagtgtagcatggcaagagaagtcattgcatctccaaactgtgcctaaattgcctgtaatgggttctttgcaacttgcagaaccagatcttacc

SEQ ID NO: 57957 - DNA, 201 bp, Homo sapiens
gacctccatcattcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctga

SEQ ID NO: 57958 - DNA, 201 bp, Homo sapiens
ccgtgtcattgtggtctcctcagagtcccatcggtgggtttgaattgcatatttgttcacttatcccctttctcataccagctaatattcccccaaggctstcattctgaaaataattttcattagtcctgcttgagacatgtgggtggactcagcttggctcacttaatttttccaggtcttttttgttcgcctgtgatt

SEQ ID NO: 57959 - DNA, 201 bp, Homo sapiens
tgactaagactggaatgtgggtgtgtgcactcctcatgttccggtttctgtgatcattcaggcatgcacaggtatcctgatgggtagccaggtcattaggmccagagtcggcagtgtagcatggcaagagaagtcattgcatctccaaactgtgcctaaattgcctgtaatgggttctttgcaacttgcagaaccagatct

SEQ ID NO: 57960 - DNA, 201 bp, Homo sapiens
gcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctacatgtggtctgctcactcagccagtattttccacagccagtctttccc

SEQ ID NO: 57961 - DNA, 201 bp, Homo sapiens
caatatgatggctagtctgtttcatagtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatat

SEQ ID NO: 57962 - DNA, 201 bp, Homo sapiens
tctccaacaaaaaacgactattgggcgatgctggcttataacaggtccaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcct

SEQ ID NO: 57963 - DNA, 201 bp, Homo sapiens
aatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagt

SEQ ID NO: 57964 - DNA, 201 bp, Homo sapiens
tcgcagctggtgggtgtacacactgctgtttaccttggcgaggcctttcaccaagtccatggtaagagaacagcttctggcgccgcaaacaccttgggtcytagagaaacctgcacacttgtgtctccacctttttacctcttgcgggcatgagtctggtctcagtaataacattgtccagcccatcataaagggctcttg

SEQ ID NO: 57965 - DNA, 201 bp, Homo sapiens
tcagtaatagtgttttaaaactccaggcctataataaagtaaaaagtgtgtctgataaaatgggtttttttccttgcttagtgaatgtcttctgtttctckctaaacattgtcacttgccaaaccatgttttctgtttcatactaattttctactggcagtgagaccagcggaatctaagaaattgcatacgaaattcaag

SEQ ID NO: 57966 - DNA, 201 bp, Homo sapiens
caggcctataataaagtaaaaagtgtgtctgataaaatgggtttttttccttgcttagtgaatgtcttctgtttctcgctaaacattgtcacttgccaaascatgttttctgtttcatactaattttctactggcagtgagaccagcggaatctaagaaattgcatacgaaattcaaggattggaaagaagaagaggaagt

SEQ ID NO: 57967 - DNA, 201 bp, Homo sapiens
accacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggt

SEQ ID NO: 57968 - DNA, 201 bp, Homo sapiens
gcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagg

SEQ ID NO: 57969 - DNA, 201 bp, Homo sapiens
ttgaaccatttgacacatttcgctagcattgggaaaatccccattttcctcactatccatttttcttcctctctttccttcctcttttcccttcttcctcttttttttcttttctttccttccctttttccttttctttccttctttccttgccatttaaaacatactgataacttggcagcacagggcagtgattaaact

SEQ ID NO: 57970 - DNA, 201 bp, Homo sapiens
gaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctg

SEQ ID NO: 57971 - DNA, 201 bp, Homo sapiens
gtttgctggctcatgcgtttcatgccttctctatggtaccatacaggcactttgtctcccagtggaatataagttctttgaggccaaggactgtgtcttaytctgtgttgcatccctttggcttcagcctcattgtcttgagtttattaagcatttggaacatttcagctgaatgagtgaatgagtgaatgagtgaagcca

SEQ ID NO: 57972 - DNA, 201 bp, Homo sapiens
tttgaggccaaggactgtgtcttattctgtgttgcatccctttggcttcagcctcattgtcttgagtttattaagcatttggaacatttcagctgaatgastgaatgagtgaatgagtgaagccatcagtcaaatcagaacactgctcacacatgcatcccaagtccagctgtcgaacgtctggaactgagcagtatggag

SEQ ID NO: 57973 - DNA, 201 bp, Homo sapiens
accatgtccccattgaacactgctctgtgctgagtctgcagaatatttaaataaggggttaatttataaagtgagctacgggaaagtttccaggattgtcrtgcgtgtgtctcataaatcggcacaaattgaatctaggtttctaggtttctgtgcccctcagctcctaagtaaaccaaaatttattgagaggtgtatagg

SEQ ID NO: 57974 - DNA, 201 bp, Homo sapiens
acttgcctaagaacacacagcagttctgaaactcaccctgtgctaatctgacctcgtgaagaaattgagcaaactaggctccagggagaaacgaaaacaayaacaacaaaaaatgtattgccaaaaaattgctagcagacatctagaaaaatgtcttcaacttcttttggtaggaaaagaggaaaaattcaaatctgaatt

SEQ ID NO: 57975 - DNA, 201 bp, Homo sapiens
tacatagtgacatgaaaattgtgtattcacattgttctattgatttcgttgagaaagtgaccttgtatgcacacatgagaatttagagatctatatatacygcctggcctcttctttgtaagggtataacagcagtggttaacatgcattttttttttttaacagttagatttactcttcctttgcacagactaatagcac

SEQ ID NO: 57976 - DNA, 201 bp, Homo sapiens
cagctctgagagcaaggccaaatcaccagattgatgcctttggctgtgtatctaaaggacgtgccattgcagctaagtggacctgaatgtacagtaagacytagtggtcaccagaatgcatgccaccccggtgcttctgcatgcaaagggtgcgggccatgtgccagtcacagtggaaaaggcatgcttcgtgtcagcaca

SEQ ID NO: 57977 - DNA, 201 bp, Homo sapiens
ccgaacatcaatcagggaagataaacaatgggaaatgataggtgtacaaaagggaaaatggcaacagcacatgtggagggaaagaccgcagaattctggcrgggttataaatcatacagtcaaataatttccgtgcaattaatatcctcaaattaaaacatacgtttttaaagaaagattttgcagacttttaagctgggc

SEQ ID NO: 57978 - DNA, 201 bp, Homo sapiens
cttccttcacccccaggagcactgaagcagacactgattcctctgcagttgttgggcttttgagctacttccctcctggggagatgcgtgttaactgtttmatgactggcaatgccgtaacagtgagcaagcaatgtgaccttacaaatacatgtgcagaaatgcagatgagtgggcctaaagaatccagactcaacttac

SEQ ID NO: 57979 - DNA, 201 bp, Homo sapiens
ttttattttagataaaatgaaaagatgttactatgcaggtaactttatttattatttgcatgcagtttatcaaatagaattccttggttcagcaaaatgamacctttaagtcttttagcaccaaatgtttgaaattatcatgaaacacattctaatttggcagtgagttcaggagatgaagactgtcctttagttaacatc

SEQ ID NO: 57980 - DNA, 201 bp, Homo sapiens
tgttattttccttttgtatctagcctaacattgactatcttgtcatttcattttcctataaaatgcctccaccaaggctgaatctttgaattgatcactasaggccttttccctagtagtaacattataataaaactttgactcatgctcataactcgattttccaaaaagttttcctttacaggagaaaagaacagctgc

SEQ ID NO: 57981 - DNA, 201 bp, Homo sapiens
gggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtctttcctactcaaaatggtttttatggattctattcttatttgg

SEQ ID NO: 57982 - DNA, 201 bp, Homo sapiens
cttaggggttagaaggggatcaaggaaagtccgagagttggttgtgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagcc

SEQ ID NO: 57983 - DNA, 201 bp, Homo sapiens
gtgctggccttttcactcaagttctctgatgtaactgcccacagtaatcctgtaaggtatggctaatcatttccattttatagattaggaaaccaaggtcmaaagtggtgaattgatttgaccaaaatcacagacccaggaatttcctcagccaagagcctacagcagctgtgtcttaagactgtgccctttcatccaccc

SEQ ID NO: 57984 - DNA, 201 bp, Homo sapiens
gtgcagtgaggatgaatcaacaagtaaatatcatgagaatttcttagattgaagaaatattactcctatttggtgtcaactctgtgctggccttttcactsaagttctctgatgtaactgcccacagtaatcctgtaaggtatggctaatcatttccattttatagattaggaaaccaaggtccaaagtggtgaattgatt

SEQ ID NO: 57985 - DNA, 201 bp, Homo sapiens
ttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggt

SEQ ID NO: 57986 - DNA, 201 bp, Homo sapiens
tggattggtgattttgactaagactggaatgtgggtgtgtgcactcctcatgttccggtttctgtgatcattcaggcatgcacaggtatcctgatgggtarccaggtcattaggcccagagtcggcagtgtagcatggcaagagaagtcattgcatctccaaactgtgcctaaattgcctgtaatgggttctttgcaactt

SEQ ID NO: 57987 - DNA, 201 bp, Homo sapiens
accctggacagatggattttctaaaattacagaggaaactagatctgtaactctgtacatttactcctgtgccagtaacaatggcaatattttaatactgwaataaattttttcttatgcatttgctataaattagtaaatctgtgtaaagctgcttattgcatcatcatgtagaatttctacatcctgcagaagtttaag

SEQ ID NO: 57988 - DNA, 201 bp, Homo sapiens
gtcagctggtgggtgatctccactgaactcctattcagaggctcagtttctctgcaggacagaaatgagaggcacaaaatttcatagctgtcttgcccctyctgtggtctgtaagaatgggaccaggactcctagttgtgaacccgaaaggatttccattaggatcaggaagtgtgagttggcttagaaaaagtaaagaaa

SEQ ID NO: 57989 - DNA, 201 bp, Homo sapiens
cctaggcttggttacaaagggcaatgaagggtcttttctgtccttaagcactcacaggtagcttaacagtaatgccttggattccttccttcaagagcgayagcaggaagcccagcttctctggtagcagagcaggggtcctcaaagcagaccgtgaggtcagaggagcactggagtcaggagtttccatctccaccctgc

SEQ ID NO: 57990 - DNA, 201 bp, Homo sapiens
gtgcttgttaactttgcactctatagccaagtgcgatgatcagaaaatacatacattgaagacaccagaaaatagtgtatggattggtgattttgactaaractggaatgtgggtgtgtgcactcctcatgttccggtttctgtgatcattcaggcatgcacaggtatcctgatgggtagccaggtcattaggcccagagt

SEQ ID NO: 57991 - DNA, 201 bp, Homo sapiens
agaaaatgtctgtcatacattacgtgcctttctctgtctttccctgcccctctcaccttcatcgatcacacttttgcttcacagaggtaagaggaaatcamactcacacagtatcttttgttttctagcaagctagaacacaagattttctagatgcatcttttgagttgatatgcaatattttccttgacagatttgtta

SEQ ID NO: 57992 - DNA, 201 bp, Homo sapiens
gctgtttaccttggcgaggcctttcaccaagtccatggtaagagaacagcttctggcgccgcaaacaccttgggtcctagagaaacctgcacacttgtgtstccacctttttacctcttgcgggcatgagtctggtctcagtaataacattgtccagcccatcataaagggctcttgaacacattttcatcaactttaggt

SEQ ID NO: 57993 - DNA, 201 bp, Homo sapiens
caggaaggcccttccactgaagctacaactggagctaagcagatggataagccaaaaccacctccgttgctgtggccccatctccaccacaaggaagctgragaagggaccccagaaccggaagacaaaaaacttccttcacacactcccttgctaagaggagaagccccaaagaagctggatatggcccttccctcacat

SEQ ID NO: 57994 - DNA, 201 bp, Homo sapiens
taactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaat

SEQ ID NO: 57995 - DNA, 201 bp, Homo sapiens
tgggaagtcagaacttggttgcttcatgtcatatttcctatttttaagatttacagatattaacgactccttgggaaaactggacttcagtcgcctctctscaacaaaaaacgactattgggcgatgctggcttataacaggtccaagctctgcaacatcctcttctccaacgagctgcaccgtcgcctctccccacgcgg

SEQ ID NO: 57996 - DNA, 201 bp, Homo sapiens
agtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaa

SEQ ID NO: 57997 - DNA, 201 bp, Homo sapiens
aaagctgtgtgggaagtcagaacttggttgcttcatgtcatatttcctatttttaagatttacagatattaacgactccttgggaaaactggacttcagtygcctctctccaacaaaaaacgactattgggcgatgctggcttataacaggtccaagctctgcaacatcctcttctccaacgagctgcaccgtcgcctctc

SEQ ID NO: 57998 - DNA, 201 bp, Homo sapiens
tggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattgg

SEQ ID NO: 57999 - DNA, 201 bp, Homo sapiens
gaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatgcctgtaaccgta

SEQ ID NO: 58000 - DNA, 201 bp, Homo sapiens
tttgagatcagtctgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtg

SEQ ID NO: 58001 - DNA, 201 bp, Homo sapiens
tctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctct

SEQ ID NO: 58002 - DNA, 201 bp, Homo sapiens
gcagtctgattgtgcgacagaaaagaaaaacccattttctggggagaaattcaagctggctgcagaaatttgtgtaagtggcaaggaacctaatgttaatstcgaagaccatgaggaaaatgtctccaggccatgtcagagactttcacagcagcccctcctatcagaggcctgaagtcccaggaggaaaaaatgatttca

SEQ ID NO: 58003 - DNA, 201 bp, Homo sapiens
aagcagagcatcaaggtttggaaaatttgcagtctgattgtgcgacagaaaagaaaaacccattttctggggagaaattcaagctggctgcagaaatttgkgtaagtggcaaggaacctaatgttaatctcgaagaccatgaggaaaatgtctccaggccatgtcagagactttcacagcagcccctcctatcagaggcct

SEQ ID NO: 58004 - DNA, 201 bp, Homo sapiens
gtgaggacacatcacttgcacctcagtgtgagtttgaaagtgttttctctggagaataattctgaagaaataggccctccagatatcagtagtgacagggstatcagtaatgttgattactaagttcttgccacaggtagaagccatgctactgcacaagtttcatacttgaagagtggacatctgacacagtgttggtgg

SEQ ID NO: 58005 - DNA, 201 bp, Homo sapiens
aagaggtgacttgggtgctgttaaaggcattcagttttataaaagaagcagagcatcaaggtttggaaaatttgcagtctgattgtgcgacagaaaagaaraacccattttctggggagaaattcaagctggctgcagaaatttgtgtaagtggcaaggaacctaatgttaatctcgaagaccatgaggaaaatgtctcca

SEQ ID NO: 58006 - DNA, 201 bp, Homo sapiens
ttattttaattttttaattgaattcagctttacagtatcttttgtagggggtaattttagcttctttctccgttgaaaacttcaagtaaggaaacacttayattgctagtgagtggccagctggagttgtaggtctaattctttttttttttttaagacggagttgtgctcttgtcacctaggctggagtgcaatggcatg

SEQ ID NO: 58007 - DNA, 201 bp, Homo sapiens
attcagaggttgtttttatagcagcaacacagtaagttgggaagagggacacatttttaacatagacaccaaaagagaggctggaagagttgaccacttaraaatgtcacgagtgtctgtgaatagtgttgggggctgagaggcaagagaagaaaatagtcctaatgttgtacaagtagcaatggaaacaaacttgttaaa

SEQ ID NO: 58008 - DNA, 201 bp, Homo sapiens
acccttctaaccagtgtttgaagtacgtaagacgttcatttccacttctaatgaggaattagaggaacggaattataaaggaattctggttataattgcakgtacttttagagacgatgtctaacagtgcaacccatagaaccaggctgcctggattcaaatcccagctctgctattactgagatctctatgagagctcag

SEQ ID NO: 58009 - DNA, 201 bp, Homo sapiens
ggtctaattctttttttttttttaagacggagttgtgctcttgtcacctaggctggagtgcaatggcatgatttctgctcactgcaacctccacctcctgkgttcaagcagttctgcctcagcctcctgagtagctgggattacaggtgcctgccaccatacccagctaacttttgaatttttagtagagatggggtttca

SEQ ID NO: 58010 - DNA, 201 bp, Homo sapiens
caatggcatgatttctgctcactgcaacctccacctcctgggttcaagcagttctgcctcagcctcctgagtagctgggattacaggtgcctgccaccatrcccagctaacttttgaatttttagtagagatggggtttcaccacgttggctaggctggtgtcgaactcctgacctgaggtgatccacctaccttggcctc

SEQ ID NO: 58011 - DNA, 201 bp, Homo sapiens
atgggcatgtgctgtgtgccattctctccccttatcagtgggttcccagctgcctggtgtacaggagggttaagtagatacctgttgagtgattgtgaatrttttcattcacgggggcagatttgtgtcctactaacaccagacatgtcctgttttcagattacttctttttcaacatctgagtacctataacatctaaag

SEQ ID NO: 58012 - DNA, 201 bp, Homo sapiens
gccactgcactccagcctggatgatagagcgagaccatgtctcaaaataatgataataattgtagtagtagtagtggtggtggtggtggtggtagtagtastagtgaatgccctgactttggggtttgcagtaagctaggattaagtgcttcacagtgaggcacagtggggagctactctgaggatgaattgcctagtaaa

SEQ ID NO: 58013 - DNA, 201 bp, Homo sapiens
ttttgataaatacctaggtgtgaaattattgactcttagtgtttaacttgtaagaatgctgccaaacagttgtctaaagtaattgtatcattttaaccccycgctagaagtgtgtaagagtttatgttgcttcacatcctcatcagcactttgtaatttcagtctttttaattatagcctttttgtgggtgagaaacgcta

SEQ ID NO: 58014 - DNA, 201 bp, Homo sapiens
tcctcttacagttttggttctttccatgagaaagtatttttaatagcaaagtaatgaacaagaaagtattaataagacccaaataataatataaactactmctttactaatggtcattatgtgccatgccctgctctaaacacttgccatgtagtcactaatttaatcctcacaagaattctgtaatgtagtgtagtttcc

SEQ ID NO: 58015 - DNA, 201 bp, Homo sapiens
tagtgtttaacttgtaagaatgctgccaaacagttgtctaaagtaattgtatcattttaacccctcgctagaagtgtgtaagagtttatgttgcttcacakcctcatcagcactttgtaatttcagtctttttaattatagcctttttgtgggtgagaaacgctatctcttgctagttttattttgcattttcctagtgac

SEQ ID NO: 58016 - DNA, 201 bp, Homo sapiens
gaaatacaaaaattagctgggtttggtgacaaacgcatgtaatcccagctgctagggaggctgaggcaggagaatcacttcaacccggaaggcggaggttkcagtgagctgagatccagcctgggtgacagagcaagactccatctcaaagcgaaacaaaacaaatgagggtcctcatcagcgtgcctttgacactgtcct

SEQ ID NO: 58017 - DNA, 201 bp, Homo sapiens
gtttctcataacatttgtgtgtgtgtgggtgggtgggtgtgtgtgaaaggtaggatcacctctctgtgcctcagtctccccatcatccttcggtggtagawcaatgctatctgatgaggccttttttgggatcacccactccaacatgcatgtcctttctctgtcccctcctggtgcctgtattagtctgttctcacattg

SEQ ID NO: 58018 - DNA, 201 bp, Homo sapiens
cagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatatt

SEQ ID NO: 58019 - DNA, 201 bp, Homo sapiens
gtccaatttatctttttcatttgtttagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataa

SEQ ID NO: 58020 - DNA, 201 bp, Homo sapiens
actatttgttcaaagactaatcctcgcgctattcaatttccttggcatctttgtcaaaaatcagttgactatatatgtgtgggtgtatttctagactgttrtactccattgatctaattttttttcttatacttactgctcgattgcctggaagctaggtaataataaggattcaaactttgttctttatttcaagattgt

SEQ ID NO: 58021 - DNA, 201 bp, Homo sapiens
tttccttggcatctttgtcaaaaatcagttgactatatatgtgtgggtgtatttctagactgttgtactccattgatctaattttttttcttatacttacygctcgattgcctggaagctaggtaataataaggattcaaactttgttctttatttcaagattgtttgggttagtttagatactttccttttacatatata

SEQ ID NO: 58022 - DNA, 201 bp, Homo sapiens
aggttgtgtctgagattcagaggttgtttttatagcagcaacacagtaagttgggaagagggacacatttttaacatagacaccaaaagagaggctggaaragttgaccacttagaaatgtcacgagtgtctgtgaatagtgttgggggctgagaggcaagagaagaaaatagtcctaatgttgtacaagtagcaatggaa

SEQ ID NO: 58023 - DNA, 201 bp, Homo sapiens
tctttggagaagaggcccacgttcttttcagattctgatttctccgtgatataaatagttttttaggtgatcacttgtttttaatgtacctacctatctawacctttctctctctctctctctctctgtgtgtatgtgtgtgtgtgtataaaattacatatccagtatgaaacctaaaaataagattttggggcctgtgaa

SEQ ID NO: 58024 - DNA, 201 bp, Homo sapiens
ttggtattgaatctgttgatcaatttgaggaggatcaaaatcctgaaagtgttgagcgttaccatccatgagcatgcatctctccatttatttaaggcttstttatttataaacatttcagtgatatttgatgattttgaatgtggaggtcttatacttttttgttaaattaactcttacacatttgatttttttatgcta

SEQ ID NO: 58025 - DNA, 201 bp, Homo sapiens
aagatatccctaaagacatcctgctggtttcagtggctcatgcctgcaatcccagcactttgggaggctgaggcaggcggatcacttgagctcaggaattygagaccagcctggccaacatggtgaaaccttatccgtaaaaaaaataaaaaattagccagacatcgtggtgcatgcctgttgtcccagctatttgggagg

SEQ ID NO: 58026 - DNA, 201 bp, Homo sapiens
cttcttctccaatttttatggcttttgtttctttttcttgttttaatgcactggctatagcctgtaggacagtgttgaacagaggttttgagacagacatmattgctttattcaggacttctctattatatgtgatcctagttgtatgttttctgtacctatacttcattagattaaggagtttgaatttatttctagttt

SEQ ID NO: 58027 - DNA, 201 bp, Homo sapiens
cttgttttaatgcactggctatagcctgtaggacagtgttgaacagaggttttgagacagacatcattgctttattcaggacttctctattatatgtgatsctagttgtatgttttctgtacctatacttcattagattaaggagtttgaatttatttctagtttgctgagagttcttttataaatgtgttcatatatata

SEQ ID NO: 58028 - DNA, 201 bp, Homo sapiens
cttgtctacattttgaggctcttctattatggaagagggctagagaggccatcagaatttggtttcactagcctttgatccttcctgtttaaggagctcarcatttagcttcacttccctgtcattcatcagaattcattctcagattggaattgtccagtcttagagtgatttttgtccccagtgacacttcccttatat

SEQ ID NO: 58029 - DNA, 201 bp, Homo sapiens
tggaggaggattcaagccccttgcaacggactgaagtgcccaagctctaaatccctgccacccacagcctctgttggccccaggttgtgtctgagattcaraggttgtttttatagcagcaacacagtaagttgggaagagggacacatttttaacatagacaccaaaagagaggctggaagagttgaccacttagaaatg

SEQ ID NO: 58030 - DNA, 201 bp, Homo sapiens
agggggtggaggaggattcaagccccttgcaacggactgaagtgcccaagctctaaatccctgccacccacagcctctgttggccccaggttgtgtctgarattcagaggttgtttttatagcagcaacacagtaagttgggaagagggacacatttttaacatagacaccaaaagagaggctggaagagttgaccactta

SEQ ID NO: 58031 - DNA, 201 bp, Homo sapiens
attttactcacccagaaggaagccgggtccctctttgcccctttgggtgtttgtgaaaagcaagttgtaaacactgaattctataaactgttggagacagrttctggagagacactcaggcttagctctagaaagaaacgggtaagacagaggaggttcagggcaactgtgttgccttccttgactggtgcatgggaattc

SEQ ID NO: 58032 - DNA, 201 bp, Homo sapiens
tgtcgggccatttgttttttaacgaattgccctttcatcttatatgcatgactattggatatgtatcgattactaattgattgcttgcctcatgtgctatmatttaattttcaaaatgtcccttagaagttaatttataaagtgtctattactttaagtacctgttcaatcctgtgatcaagaggaaattcacagagaaag

SEQ ID NO: 58033 - DNA, 201 bp, Homo sapiens
tagaaacttggacagaggaaaatgaaaatgttctattaattccactagcatgagataatcactcttaatattttgttgcatgttcttttctttcttctgartgatagcatttttttcaacaaattgggctcgtaatatataggcacatagatatataattaaaaaaacaagaatttctcatgtcattaaacattgcttgaa

SEQ ID NO: 58034 - DNA, 201 bp, Homo sapiens
accctctgattcaggctcagcaggagcgggagaggatgcataggactacatgttttctgggccaggactggaagcagcatatctcagatccaacctctttmccttggcaaaaattcaggatgtgcaggacgaggaggaaaatgggagtagtgactatttagccagtctttgccacatcccggttcatatctcactccgtca

SEQ ID NO: 58035 - DNA, 201 bp, Homo sapiens
aaggagaagaaaatgaagaaaaatttagaaacttggacagaggaaaatgaaaatgttctattaattccactagcatgagataatcactcttaatattttgktgcatgttcttttctttcttctgagtgatagcatttttttcaacaaattgggctcgtaatatataggcacatagatatataattaaaaaaacaagaattt

SEQ ID NO: 58036 - DNA, 201 bp, Homo sapiens
ttcttgttctcgtatcactcagactaagcagttgatgtaacagataacccccaaatttcagtgatttcacatttaatctgtaaaaaatgaggatttgtttrtagccccaaagacagtctagtttggattatttgaggacctagacttcacctgcacagtggtttcaccatccatccccccatggcctccatggtaccctct

SEQ ID NO: 58037 - DNA, 201 bp, Homo sapiens
cctgtagataatacagtcccattctctggggaaacagatacctccgccagggtcctgatctgaatatgatttggggtgatggaacagaaacacccgaggastgtcgttggggaacaggaaacctgtctgtagtcctggctctgtctccaattggctacgagggcttgtgtgtactctagttctctttccgtgacactgcat

SEQ ID NO: 58038 - DNA, 201 bp, Homo sapiens
tgagttctccataaatgttagttattattttaatattacagcatctgtggaaacagtgggtttatatttcagcgtcctgagaaacactcatcctgaacaaygggaacattggccacatccgccattgtcaattttaaataaaagatatgatgactagttggtgagttgatcttgtaagacttttacagatacccagaacgg

SEQ ID NO: 58039 - DNA, 201 bp, Homo sapiens
agttattattttaatattacagcatctgtggaaacagtgggtttatatttcagcgtcctgagaaacactcatcctgaacaacgggaacattggccacatcygccattgtcaattttaaataaaagatatgatgactagttggtgagttgatcttgtaagacttttacagatacccagaacggctctacttcttcatattcc

SEQ ID NO: 58040 - DNA, 201 bp, Homo sapiens
aggcatttttctgttgactgtgcatgaagccacatagtaataaacagtttccatatccaagcagctaaggcttgtgccttgcaagttaagtggaacatcasgatctatatctcagttttccttatgtttccccagttggcacatcatggccaacaagagagtagggatcattaaggagtttattttcatctttattttatc

SEQ ID NO: 58041 - DNA, 201 bp, Homo sapiens
ctttttctgactagctgattctgctgctgctggatttattcattcttctccctcacaattttggctcgcacatgcttcctttttagctcatgaccgtgcarttcaactcaacctcatggcatctttttatcagctgtccctgctgcaacaggcttagagttggtttcccaattccctagcgcagaaatccactggcatgag

SEQ ID NO: 58042 - DNA, 201 bp, Homo sapiens
cctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagact

SEQ ID NO: 58043 - DNA, 201 bp, Homo sapiens
tcttctcaggcttccaaccactatgtttggaaatgaaatatgccttgaaggaaaaaagctgccaaatgctggccttgcagtttttgcagatcttggccccmaaaattcttagtcatagtgcccttctgatgccttcaaacagatatgggtgtgtatgcacgtgtgttattttgtccatcttttctaattgttctcagtagg

SEQ ID NO: 58044 - DNA, 201 bp, Homo sapiens
ggcgttctctttttctgactagctgattctgctgctgctggatttattcattcttctccctcacaattttggctcgcacatgcttcctttttagctcatgrccgtgcaattcaactcaacctcatggcatctttttatcagctgtccctgctgcaacaggcttagagttggtttcccaattccctagcgcagaaatccact

SEQ ID NO: 58045 - DNA, 201 bp, Homo sapiens
caaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaag

SEQ ID NO: 58046 - DNA, 201 bp, Homo sapiens
agatggttctatgttgtcaggggctgccctgttcatggtaagatgttttgtaatgcctggtgtttacccactagatgccagtaggactctaccccacaacygtggccactgaaaatgtctccagacatttgcttctgtcccctggggatcaaaatcacccctggttgagaacttggggtaatttaagtggtgctccggtaa

SEQ ID NO: 58047 - DNA, 201 bp, Homo sapiens
ccaagtcttttgccctccatggtgcacatgtgatcttggcctgcaggaacatggcaagggcgagtgaagcagtgtcacgcattttagaagaatgggtaagygcttgactgttgttgttttttttaattgtcaaatacacatgccgggctaaccatatggagatttcagtggagtgtgtaaagtttattgctcttggaatca

SEQ ID NO: 58048 - DNA, 201 bp, Homo sapiens
tccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtat

SEQ ID NO: 58049 - DNA, 201 bp, Homo sapiens
aggaacatggcaagggcgagtgaagcagtgtcacgcattttagaagaatgggtaagcgcttgactgttgttgttttttttaattgtcaaatacacatgccrggctaaccatatggagatttcagtggagtgtgtaaagtttattgctcttggaatcatgtctttatttttaaagtcatcttcactttgtttgtcttatgaa

SEQ ID NO: 58050 - DNA, 201 bp, Homo sapiens
acattatagaatattttcacggaaatatttcggatggaattttggctttaattctttctctttttttcctgttcttttccctctccccacaaccacttctstttcattttctgttttgctccttcttttcataagtagctggtagtcagtgttctctttttcttcctgtgagacaggatctccctctgttgcccaggctcg

SEQ ID NO: 58051 - DNA, 201 bp, Homo sapiens
tcctttaactcatttattaagaaaaataaaacgtggtgaacgcccatgattgcaactaggagactgttatgcttatggttgttaagattagaaagaaggargctttaaccctatctctgatttcttacttttctctgtctatgtagaagttgatgttgatacgtgtctacataaatatttactaagggcttgcattagtct

SEQ ID NO: 58052 - DNA, 201 bp, Homo sapiens
ttcccccgtgactgctgcgggggcctaggccaaagatatgcccgagtagaaaatctgacaccagcttcccagttttctcttctgctctctttggctgcaasgcttttaccatggctaaaccattaggccggctctgcagggagggcaagaccacagcagctcagtatttcctgctcagggaaaaaggccaggtcttttgtt

SEQ ID NO: 58053 - DNA, 201 bp, Homo sapiens
ttccctttggtggccatttaggttgtttgcattgttttgctatttgttattccaagcaatggtgtttcacagttctctctttcttgcatcagtctttcttrcgatatcatctgatattgggcctaaactatgctgctgtgagcattctttatttacgtatttgtgagtaaatgcctggggcagaatcttagcactggactc

SEQ ID NO: 58054 - DNA, 201 bp, Homo sapiens
tgcgggggcctaggccaaagatatgcccgagtagaaaatctgacaccagcttcccagttttctcttctgctctctttggctgcaacgcttttaccatggcyaaaccattaggccggctctgcagggagggcaagaccacagcagctcagtatttcctgctcagggaaaaaggccaggtcttttgttggtggaaatccactt

SEQ ID NO: 58055 - DNA, 201 bp, Homo sapiens
cgagtcattttcttttttcttttttttctttttcttttttattttttttttgagactgagtttcactctgtcaccaggctggagtgcagtggcacaatctygactcactgcaactttcacctcctgcgttcaagcaattcttctgcctcagcctcccgagtagccgggactacaggcacgcgtcaccatgcccagctaatt

SEQ ID NO: 58056 - DNA, 201 bp, Homo sapiens
gtctaatttatgtaaaataaattgcatccatttaaatatacaattcaatgagttttgacagatgcacatgcccatgaaaccaacacgaaaataaaaaaaawagaacatttacgtcacctcaaaaagatttcaaatgccacttctgtggtgtatgactctgagtccagacagcctcagctccaggaaaaccctggtctgttt

SEQ ID NO: 58057 - DNA, 201 bp, Homo sapiens
tttgatattttttaaaggaaaaatttgaggcattgacacatgccttttgcttacttgcttggattggtttgatcaactttgttgcggtctaatttatgtawaataaattgcatccatttaaatatacaattcaatgagttttgacagatgcacatgcccatgaaaccaacacgaaaataaaaaaaatagaacatttacgtc

SEQ ID NO: 58058 - DNA, 201 bp, Homo sapiens
aaaaaagtaaaataaagcatgggaagtcccttatacagtttgtgatatgggtacacactcagtgaaatggccattaatactgctgttcttaactctgaaarcagagtgggccatttgaatgctcactttgatattttttaaaggaaaaatttgaggcattgacacatgccttttgcttacttgcttggattggtttgatca

SEQ ID NO: 58059 - DNA, 201 bp, Homo sapiens
aaaaaaacaaacttgaaaagcatagcaggctgccaggacatgtctgagtaccgcgcagatagtggggaatagtctatggattctgcttacaccatggacarccaggctgggccatgggttgtgttttttttcctctcattttatagaaatgttaccaggcatattttccctgtttccctaagaagagcttcctctcagtgc

SEQ ID NO: 58060 - DNA, 201 bp, Homo sapiens
taactgtctcttgcgatcccctcctgcacaactgtggcgttctctttttctgactagctgattctgctgctgctggatttattcattcttctccctcacarttttggctcgcacatgcttcctttttagctcatgaccgtgcaattcaactcaacctcatggcatctttttatcagctgtccctgctgcaacaggcttaga

SEQ ID NO: 58061 - DNA, 201 bp, Homo sapiens
tggctgacagagggagactctatctcaaaaaaaaataataaaaataataaaaaaaaaattacatgaaaaatagagacaaagtctcgctttgttgcctaggstggtcttgaactcctgggttcacgtgatcctcctgcctcggcttcccaaagtgctgggattacaggcacgagctgccacgcctcacctcttgttttcaat

SEQ ID NO: 58062 - DNA, 201 bp, Homo sapiens
cagggctctgcccattagaatctctagggacagaccgaggtttgagagttcctgctcctgatctcaggggaatcctgaattacaggtgttaacctgattakccccagcccagctcttcgttaattacctgaagtgaatgggacagtttccaatactcagcacaaaggcgtgcgcagtgactctgtggcgtactatctattt

SEQ ID NO: 58063 - DNA, 201 bp, Homo sapiens
atggctaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccc

SEQ ID NO: 58064 - DNA, 201 bp, Homo sapiens
ggcacaatctcgactcactgcaactttcacctcctgcgttcaagcaattcttctgcctcagcctcccgagtagccgggactacaggcacgcgtcaccatgyccagctaatttttgtatttttaatacagacggagtttcaccatgttggctgggatagtctcgacctcctgatctcatgatctacacacctaggcctccca

SEQ ID NO: 58065 - DNA, 201 bp, Homo sapiens
ctaaatactccctagaggtttcccattggccacttggggtacaccccttataaatgaagtggtggcctgcaatcagtcttattggttgcagaaagcaaccratcagaggctgaagtgaagttacaaatatcacactcctatgcaaacatctgattggttttggaaagcaaccaatcagaggctaaagtgaaattacagagt

SEQ ID NO: 58066 - DNA, 201 bp, Homo sapiens
ttctgcctcagcctcccgagtagccgggactacaggcacgcgtcaccatgcccagctaatttttgtatttttaatacagacggagtttcaccatgttggcygggatagtctcgacctcctgatctcatgatctacacacctaggcctcccaaagtgctgggattacaggcatgagccaccgtgcccgacctcccgagtcat

SEQ ID NO: 58067 - DNA, 201 bp, Homo sapiens
ttataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatgg

SEQ ID NO: 58068 - DNA, 201 bp, Homo sapiens
accatgcccagctaatttttgtatttttaatacagacggagtttcaccatgttggctgggatagtctcgacctcctgatctcatgatctacacacctaggmctcccaaagtgctgggattacaggcatgagccaccgtgcccgacctcccgagtcatttcttatcttgttgctccaatttccattcccactgacagtgtag

SEQ ID NO: 58069 - DNA, 201 bp, Homo sapiens
tactcaaataagtctcccccaaaactcagggatagagatttttaaggagaatttagtgagaagggggtcagggaatggggagtattgattggtcaggtttragatggaatcagggagttgaagctggcctcttgcactgagtcagttcctgggtgggagccacaagaccatatgagtcaatttattgacctgggtggtgcc

SEQ ID NO: 58070 - DNA, 201 bp, Homo sapiens
gcttgcagtgttcttgggactagcaggagggcgtgtcaaaattgtaaaactctgcctatttgatgtaatatttgaaactagaaaggtaaaattccagggaygctagtgacactatggtaacctgattgtacagtgacattcatgtttaaaccagtcttggaagataatgctgtagcacaactgtttttgcatcattaaatt

SEQ ID NO: 58071 - DNA, 201 bp, Homo sapiens
agtgggttgcgcctgtaatcccagcactttgggaggccaaggcgggtggatcacctgaggtcaggagttcgagaccagcttggccatcacagtaaaacccygtctctgctaaaaatacaaaaattagccaggcatggtggtgtgggcctgtaatcccagctacttgtgaggctgaggcaggagagtcacttgatcccgggg

SEQ ID NO: 58072 - DNA, 201 bp, Homo sapiens
catcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttat

SEQ ID NO: 58073 - DNA, 201 bp, Homo sapiens
cccaagatgatgattatggaaactcaaattttgcaccagaagctgtagttaccatttcattccattgcaccattcataccctgcagagaggatgtgaagtygtaaggccttcttgctctggtgacatctgttaggcttcgtctctatatcatcccccaactccttgacccttgatatttgctggtctacttcccttcaggt

SEQ ID NO: 58074 - DNA, 201 bp, Homo sapiens
ccttagcagacatcatttctctgtttaatctgtctacttgctaattgtctcactgccctccccctccccactggagagtgaatgaaggcttaaggttttgyctgccttggtctctcctgggtcctgagtaccagtggccttacgtggcatttggtagattacatgcttaatgaaaagtgagtgaatgggctgggtgtggtg

SEQ ID NO: 58075 - DNA, 201 bp, Homo sapiens
ccatcccactaatatatttcttaccaggagtacatagtttgttctttaagcaaaaccatatgcatcgtattttaaatggaacagggaggttgttccatgcrtcaacttagtccaaatgtagagggtcaggaaaacaatgatatgagaaaagggccggttactgtctgggaatccataaatactgcttggcaaatggcacat

SEQ ID NO: 58076 - DNA, 201 bp, Homo sapiens
tttcttttttttttttttgcattttccagacgagccaagggatggctcagaagggtgaaggaactcacccgaattgcacagctggtgagctcagagtcagkctccttgcttggtccatctggcttccaaactccaagtctgtctgctccaccccatggcccatctttttaccatgtttagtatcaatgttcatactttgca

SEQ ID NO: 58077 - DNA, 201 bp, Homo sapiens
attcttgcaaatgtttttggtttctctgtctactcattacgtacactctgccagaggttgaaaactcaatgttgagatcacatacatcctgaaaacactgkttaaataaaattttggcctgcatcctgtttttgaaaacttgcaatggcttgccaacgttttcaagttgagaagtttcacaaaaaaaattcggatttccag

SEQ ID NO: 58078 - DNA, 201 bp, Homo sapiens
aagcaaaaccatatgcatcgtattttaaatggaacagggaggttgttccatgcgtcaacttagtccaaatgtagagggtcaggaaaacaatgatatgagaraagggccggttactgtctgggaatccataaatactgcttggcaaatggcacattgcatgcttattccttaggcatccgtttagcaaaataagatgtcaag

SEQ ID NO: 58079 - DNA, 201 bp, Homo sapiens
tggtgccctcacctcttaagacaagcacctatcgttttcctgtgtattccaagaggccagtgtggctggtggaataagatgttttcctgttttcaagatgsagtggactctcttttatttagcagcagtgtctatgtgttaggaatccatgtgagttctctaagtctgggacaacgataggtgtgtctgagtcctgcatta

SEQ ID NO: 58080 - DNA, 201 bp, Homo sapiens
aaggctacagtgagctgtgatcctgtctctacacctcagtctgggtggcagagcaagaccctgtctcaaaaaaaaaaaaaaaaaaaaaaaagtaaaataawgcatgggaagtcccttatacagtttgtgatatgggtacacactcagtgaaatggccattaatactgctgttcttaactctgaaagcagagtgggccattt

SEQ ID NO: 58081 - DNA, 201 bp, Homo sapiens
taactaccttgcttgcctatgggacatgttcccatttcagtgcatacttgacctttaccataaatcacatatttgtaaactgtaccctcctgctgttttaytgggcatggagaagcagtcttttctttttcttgatggcctgggttgaccagatcctgacttttgtggagacattaaagtgctagaaatgataatggtgaa

SEQ ID NO: 58082 - DNA, 201 bp, Homo sapiens
cagtatctattggagttgggcttctgttgctttatttctcggggtctggcatatcccactccctgtcttgagatctcaggacctctgaggggcattgcatktaaagaacaagagcttattaggtatcaaaacatacttcatgaacagctacagcaagacctcgacattccagtgtagagctcttgaaagaccccagtgggg

SEQ ID NO: 58083 - DNA, 201 bp, Homo sapiens
ttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactaaaagtacaaaaat

SEQ ID NO: 58084 - DNA, 201 bp, Homo sapiens
tggtcagagagggctggtatgggaagaggggcaggtggctctcccttagagttactatttgactcacccctgacttcccagaatgtgtcttgagtctattmccctctcatatgggaggggtgacccaagtatgtttgtggcaaccaaaatgtctccaggcattgccagatgtctcttgggggtgcaaatcgtccccagttc

SEQ ID NO: 58085 - DNA, 201 bp, Homo sapiens
ttaaaagtcctggttcaggctgggacttctgctcagggtctcatgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcagg

SEQ ID NO: 58086 - DNA, 201 bp, Homo sapiens
acctgtcccaggccttgtcttccagccccacaaacgtgcacctgcagccggagaccagggggccccgatcaggtggcagggcctttaattggagccacgtktgtataatgagcagcgcacacacacaaaggcgagctaaaaatgtctccacccttctaaatatgggatgccttggccaggtattgagtcagctctgtgacg

SEQ ID NO: 58087 - DNA, 201 bp, Homo sapiens
gagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttgtattatttagagggatccacggagctggcaga

SEQ ID NO: 58088 - DNA, 201 bp, Homo sapiens
gctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggctcaagctattcac

SEQ ID NO: 58089 - DNA, 201 bp, Homo sapiens
ctgggactactgtgatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaact

SEQ ID NO: 58090 - DNA, 201 bp, Homo sapiens
gatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctccta

SEQ ID NO: 58091 - DNA, 201 bp, Homo sapiens
cagtgtttacagaccccaaagcttgctgtcccctgggcaggtgcatgagggggtcccaggcaatcaggctcttctcaaacctgaattatacccggcctcarggtataggggtcaggcagctgtttgacaggattcttgcaaatgtttttggtttctctgtctactcattacgtacactctgccagaggttgaaaactcaat

SEQ ID NO: 58092 - DNA, 201 bp, Homo sapiens
acctgtaatcccaacactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggtt

SEQ ID NO: 58093 - DNA, 201 bp, Homo sapiens
cattgccctccattcagatcttgtcacttaggccttggtagcatgagctattaacagccctccatatttactatttttttttttttttttaactctgggasttcctgttgcagaaattggatcacttacctaaaaagctccccacccccacctttggtgactggtgggtttcatcaccaggaaagcacattgttccaactc

SEQ ID NO: 58094 - DNA, 201 bp, Homo sapiens
gtattgttccatttttgagtattactttaatacattattgataagttaatttagaagtatcaagtgaaaggggaagaaaaacagttttgaataaaaacggwgtttcctctggactattttgccaaatgcatttttattggtagaacgtaagcaaatttaaaaaagcaacaaaagcagtttttatgaatacctagcgtactt

SEQ ID NO: 58095 - DNA, 201 bp, Homo sapiens
acctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgct

SEQ ID NO: 58096 - DNA, 201 bp, Homo sapiens
tttcaatagagttgatatcgggtctatttattttgtgggagtgaagggatagggatagtactgacagcattatgtgattgcagcctcattgataagcatcrgaaataatgactttaacattattttcagatagggagcactcagtaccaaccattatattaggctcatgggctcaacattttgctgtgcttttcatagata

SEQ ID NO: 58097 - DNA, 201 bp, Homo sapiens
atttattttgagagcaagcacgggggtttatgtgatggctccacagagcagtgaaaagactcccgccctactgctcgcaacctcagatgtccctgggcacwagcccatctgtatgtctttaaaaaaaataaattaaatttttaaaaacatgactttctggccaggcgcagtggctcatgcctataaccctgcacttagaga

SEQ ID NO: 58098 - DNA, 201 bp, Homo sapiens
ggccaccatggtgaagccccgtctctactaaaaatacaaaaaattagccagctgtggtggcacatgcctgtaatcccagctactcgggaggctgggacagragaaccactggaacctgggaagcggaggttgcagtcagccgagatctatgccattgcactccagcctgtgtgacagagcaagactttgtctcaaacaaac

SEQ ID NO: 58099 - DNA, 201 bp, Homo sapiens
attgataagcatcggaaataatgactttaacattattttcagatagggagcactcagtaccaaccattatattaggctcatgggctcaacattttgctgtrcttttcatagatactgacacttgtgttttcattttgttgttgttgttgttttccctgccgggaaactgccgcatcctgtgttttcatggcatgatattaa

SEQ ID NO: 58100 - DNA, 201 bp, Homo sapiens
gatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggattatatccccagcactgtaatttagtgtggcagtcaggggaaaacaccttgtagaatttc

SEQ ID NO: 58101 - DNA, 201 bp, Homo sapiens
tgactttaacattattttcagatagggagcactcagtaccaaccattatattaggctcatgggctcaacattttgctgtgcttttcatagatactgacacytgtgttttcattttgttgttgttgttgttttccctgccgggaaactgccgcatcctgtgttttcatggcatgatattaaggaacgatgggtaggatgctg

SEQ ID NO: 58102 - DNA, 201 bp, Homo sapiens
attggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctt

SEQ ID NO: 58103 - DNA, 201 bp, Homo sapiens
cattttgttgttgttgttgttttccctgccgggaaactgccgcatcctgtgttttcatggcatgatattaaggaacgatgggtaggatgctgaggagtaarttgctcgcacttttaaagacttctgcaaaactccacctacttttaggctccttaaaattcagtgactttatgagctggtatagcttcactgtttgtggga

SEQ ID NO: 58104 - DNA, 201 bp, Homo sapiens
catagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgct

SEQ ID NO: 58105 - DNA, 201 bp, Homo sapiens
aaccatacacatccagtagaaaccgaactttacattttgagtttcgatttttttttttcacctgggctagtaatacgtggtaggatactctctcacaatgytaggccacagcagcgagctgcagctcccagtgatcacaagggcaaagaatcgatattctaccaggcacggtgttgcctgataaccttgcccagctgtagg

SEQ ID NO: 58106 - DNA, 201 bp, Homo sapiens
agtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatg

SEQ ID NO: 58107 - DNA, 201 bp, Homo sapiens
ttctgtatagtattggattttcaataaataaagtatgatataaacaagtctgcaaaccagcaagaactatataagccacttgctcaagtcaataagcgcaygctcacaaaggaacgtaaagttctgaagttcttctttggggcgtttgcaaaatgtcctattattgtcacctgcaggtggggggttggatattcctatttg

SEQ ID NO: 58108 - DNA, 201 bp, Homo sapiens
tcacctgtcctttatcttggctggtccaattccataagaagtaaatgctgtgtgtctgcaattcaaaagacccctttcacgggaggctgggagatttttcyatctaaatagcttaattgttactctacagggcaatcataaatgtaaatcgacttaatatgacttgattgttagtaatgactgtgcctctaatgacgctgg

SEQ ID NO: 58109 - DNA, 201 bp, Homo sapiens
cacagctgggagataacggggtggatccaagatttgcagctggtgtgtgggtgatgccggaagattggcctttttcaaggacttagacaagtattgtactsatacattatttgcatttatttgtatgaatacttctgggttcctaatatgagggtacctaaaaagtacatccgctgcgcttcttgtaatctgagggagttg

SEQ ID NO: 58110 - DNA, 201 bp, Homo sapiens
ttgttctttgatcattgtctttgtgtcttctccttttttttttttttcctggccaccgctcgcagtcttgaaccgaatctttcaaactttatatccatgtracctttgtataatgagggctgtgattaactgcagagttttaaagagtgaaagtcaagcataggtggctggctctgaaccatcactcccaataatgtgaaa

SEQ ID NO: 58111 - DNA, 201 bp, Homo sapiens
ctattagcaaaataacagacagtgttatcagtcattgactcagaagatagtttcttaccgtttggggaaagtgcttgtctattcctctccaaagccatttwaaaaaaaaaattgcaccagttctcatcccatcatctgccttgatcaaacatttgcttattggaatcacttcgaaaaggaacttggtatcgttcacatgtg

SEQ ID NO: 58112 - DNA, 201 bp, Homo sapiens
gactgggaagaaaaagaggtttaactggacttacagttccacatggctggggaggcttcagaatcatggtaggaggcgaaaggcacttcttatatggtgtmagcaagagaaaaatgaggaagaagcaaaagcagaaactgcctgataaacccatcagatctcttgagacttattcactatcatgagaataggatgggaaag

SEQ ID NO: 58113 - DNA, 201 bp, Homo sapiens
agtgatttgcccaccttagcctcctaaagtactgggattacagacaagagccactgcgcagacggacatatgaatttttaatttgatatcattgtgatcartttgaagatccacatatggctgagggctactctaatgagtggtgcagctccaaggcagagagatggctgtgattaaccaatgaatgagggaacaaatatc

SEQ ID NO: 58114 - DNA, 201 bp, Homo sapiens
cccaccttagcctcctaaagtactgggattacagacaagagccactgcgcagacggacatatgaatttttaatttgatatcattgtgatcaatttgaagakccacatatggctgagggctactctaatgagtggtgcagctccaaggcagagagatggctgtgattaaccaatgaatgagggaacaaatatccaggcagaa

SEQ ID NO: 58115 - DNA, 201 bp, Homo sapiens
ggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggt

SEQ ID NO: 58116 - DNA, 201 bp, Homo sapiens
ctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgactgggtcccgggtctcctcggaggtcggtttgcatcacgtggat

SEQ ID NO: 58117 - DNA, 201 bp, Homo sapiens
ctgggtcccgggtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcct

SEQ ID NO: 58118 - DNA, 201 bp, Homo sapiens
gtatggtcttaggccctggaataagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaa

SEQ ID NO: 58119 - DNA, 201 bp, Homo sapiens
agctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttaagagttaacctgagtgtctgctgcatagtaggtgctcaa

SEQ ID NO: 58120 - DNA, 201 bp, Homo sapiens
cgtgtgaccttccacatgctttttgatttttcttgaactcacttttcctttgtttgcaaaatagtaacaatattttccttccaagtgatggtgaggatttmagagttaacctgagtgtctgctgcatagtaggtgctcaataaactataacgtctttatttcttttccttccaatgagaagtcacttcctggagggaagcc

SEQ ID NO: 58121 - DNA, 201 bp, Homo sapiens
gtttgcaaaatagtaacaatattttccttccaagtgatggtgaggatttaagagttaacctgagtgtctgctgcatagtaggtgctcaataaactataacstctttatttcttttccttccaatgagaagtcacttcctggagggaagccacctccaggaacagtcctggttcaactcatgaggagggtcactggttgggt

SEQ ID NO: 58122 - DNA, 201 bp, Homo sapiens
ctctgagctctaatttcctcacagggccgcaggactgaggttaaggacctgctgtcactggtacagtggttgaagaaaaggtgaatgaaggaagggcctcrttttactccttgtctcacattcctttctgctacttctctttggctcaccaaaaggagacagaagtttgtgtccatggctgtgaactgccaaagagttgcc

SEQ ID NO: 58123 - DNA, 201 bp, Homo sapiens
gaatgggctgtcctctcctgctactttataaaagccaagtttttgcttctagctggtcgaaggtcctgtgggagctcacgtttttctcaatcactgatgaycatttgagacataatttggagaaggtttctatcaaatcctagttggactgcagtgaaatgttttcaaactagagaagcaccaaataggccatgataaaga

SEQ ID NO: 58124 - DNA, 201 bp, Homo sapiens
ctgcacaaagaatgggctgtcctctcctgctactttataaaagccaagtttttgcttctagctggtcgaaggtcctgtgggagctcacgtttttctcaatyactgatgaccatttgagacataatttggagaaggtttctatcaaatcctagttggactgcagtgaaatgttttcaaactagagaagcaccaaataggcca

SEQ ID NO: 58125 - DNA, 201 bp, Homo sapiens
tggtctcgaactcctgagctcaggcagtctgcccgcctctgcctcccaaagtgctgggatcacaggcgtgagccaccgcgcccagcccatgacttctcttyatgggagagaaaggccaccgagatagtaagtggacatcaggacatggattctattaaatctaacacctttatctttgcatttccatacattttgcttatt

SEQ ID NO: 58126 - DNA, 201 bp, Homo sapiens
acatatattgagcattgaccaggtgcccaatattttaatgtcccatgggtgtgcatcaggtacgctgtggaaggacagatgtcattccttaaaggggctgsactgaattagaccaggggttctcaaagtggggtccctggaccggcagcatcaccatcacctggaaacttgttagagatgcagatcttgggccccgcccca

SEQ ID NO: 58127 - DNA, 201 bp, Homo sapiens
cagggtttcaccgtgttgcccaggctggtctcgaactcctgagctcaggcagtctgcccgcctctgcctcccaaagtgctgggatcacaggcgtgagccascgcgcccagcccatgacttctcttcatgggagagaaaggccaccgagatagtaagtggacatcaggacatggattctattaaatctaacacctttatctt

SEQ ID NO: 58128 - DNA, 201 bp, Homo sapiens
cttttctgactgctcaaaacagggaataataaacagtcagagtgtccaagtaatctgagctagaaagttccttctttcagagaaaagttataaaaagtatwtttgccggatccaaaaaaaatactgtgtatcaactactgagacctgcataatgttttcttagtattctcactctttaaaagaaaaaagaaaacctgtaaa

SEQ ID NO: 58129 - DNA, 201 bp, Homo sapiens
ggggtactgataccagagttcatttgaagtcattggaaaccaaggcatattttcttaaagagacaactgtttttggtgaataggccatgttgtttatagtwaaaacaaacatgaatattctgtaatagaagatatcgtttgcatggtgttttaaagctaaaacttgagttattaaacacccttctctccctggggatgcct

SEQ ID NO: 58130 - DNA, 201 bp, Homo sapiens
aggcacctgccaccacacctggctaattttttttgtattttagcagagacagggtttcaccgtgttgcccaggctggtctcgaactcctgagctcaggcartctgcccgcctctgcctcccaaagtgctgggatcacaggcgtgagccaccgcgcccagcccatgacttctcttcatgggagagaaaggccaccgagatag

SEQ ID NO: 58131 - DNA, 201 bp, Homo sapiens
tcagagtgtccaagtaatctgagctagaaagttccttctttcagagaaaagttataaaaagtatatttgccggatccaaaaaaaatactgtgtatcaactmctgagacctgcataatgttttcttagtattctcactctttaaaagaaaaaagaaaacctgtaaaatttgggaacttaaactttttttgatattttaatat

SEQ ID NO: 58132 - DNA, 201 bp, Homo sapiens
agtgcagcctccgcctctcgggttcaagcgattcttctgcctcagcttcccgagtagctgggactacaggcacctgccaccacacctggctaatttttttkgtattttagcagagacagggtttcaccgtgttgcccaggctggtctcgaactcctgagctcaggcagtctgcccgcctctgcctcccaaagtgctgggat

SEQ ID NO: 58133 - DNA, 201 bp, Homo sapiens
acagtgttatcagtcattgactcagaagatagtttcttaccgtttggggaaagtgcttgtctattcctctccaaagccattttaaaaaaaaaattgcaccrgttctcatcccatcatctgccttgatcaaacatttgcttattggaatcacttcgaaaaggaacttggtatcgttcacatgtgtttataactctcaaatct

SEQ ID NO: 58134 - DNA, 201 bp, Homo sapiens
gccttaccccgctacagagaggccccaagagagaggcctcacaccctctggctccactgaaattcacttcacgtttccaacttggattaaactggcacgamagttcagtcaaatgtcaagtccattttgtcaagggagggaactcattcagaagatgaactagttggtgttacttagatgattaactacttggcattaggt

SEQ ID NO: 58135 - DNA, 201 bp, Homo sapiens
atatggtgtcagcaagagaaaaatgaggaagaagcaaaagcagaaactgcctgataaacccatcagatctcttgagacttattcactatcatgagaatagsatgggaaagaccggcccccatgattcaattacctccccccgggtccctcccacaacatgtgggaatcctgggagatataattcaagttgagatttcggtg

SEQ ID NO: 58136 - DNA, 201 bp, Homo sapiens
tgatcaaacatttgcttattggaatcacttcgaaaaggaacttggtatcgttcacatgtgtttataactctcaaatcttcttcttccaatttttaatcttsatcaccacagctttataacaggaagaacgctcaaagaagaaaaatagaagaagcctgaattttaatttgctatttcttcacacacaaaacaccccaagct

SEQ ID NO: 58137 - DNA, 201 bp, Homo sapiens
ggtatggggtggggaaggggggggggataaagatattaatttggaagcatttgattgctccattattttatcatcttcccatggaaatgttttcataacgycttgttttttaattattattattattttttgagacagagtctcactgagtcgcccagggcggcggtgtgatctcggctcactgcaacctcagtctcccag

SEQ ID NO: 58138 - DNA, 201 bp, Homo sapiens
agatcaggccactgcactccaatctgggtgacagagcaagactctgtctcaaaaataatagtaataataataataataataataataataataataataakaagaatctgactaaggttattaaccattaaggtatgctgtgctaaggagcagggggccccttccatccgtagagggcagaaaggtgcctatcatgtcttc

SEQ ID NO: 58139 - DNA, 201 bp, Homo sapiens
gggagtgtggttgtacttcaacctggaactgtctaactcctaaggttttattaatatctagtccatttctctcaatctaatagtaaatggaagagaagcamcaacttttgttttccaattccttttgaacatttgaaaggttttctgaaaggacttaaagaaaccatagcttccttaccagttcccaaagcttcagtcctt

SEQ ID NO: 58140 - DNA, 201 bp, Homo sapiens
tttgaactctaattagggaaagggaatttggaaccattgtcttctctgagtgtgcagacacgatgttatcattgtgtttacagaggtggtcagattcccakcacagtgtactcccgcacagataaccgtcccatcttgataaaacaatgctctcagccgaatcctaaacacgctgcacaaggaagaccttatgctgacagt

SEQ ID NO: 58141 - DNA, 201 bp, Homo sapiens
gagataagaaatggagcaagggaggggtttcatcccgccgtgttcatttgcttggctgtcctgaaattgcgaatacgcagttgttacctgctcccggtggraggggggggatatttatttggcatcttgcaattgataggagctgagtgattttagtaggtagtttaactccttaaaaacttccagtggtttcatattcta

SEQ ID NO: 58142 - DNA, 201 bp, Homo sapiens
tggctgattcatgtcatgagagatcctgagtcagaaccacccagcagctaagccacttctgaatccttgacccacaaaatatggtaagataccaaatggtkactgttttaagccactatgctctgggggaatttgtgatgtagcggtagataactatcacaggatccatggcctcaaggggagaaggatccttaagagaga

SEQ ID NO: 58143 - DNA, 201 bp, Homo sapiens
tatgtctttatcagcagcgtgaaaacggactaatacagtgaggaaatccatgtgttaggaagggagtgtggttgtacttcaacctggaactgtctaactcytaaggttttattaatatctagtccatttctctcaatctaatagtaaatggaagagaagcaacaacttttgttttccaattccttttgaacatttgaaagg

SEQ ID NO: 58144 - DNA, 201 bp, Homo sapiens
ctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaact

SEQ ID NO: 58145 - DNA, 201 bp, Homo sapiens
ggcagctggagagcgtgcagactcaggagccaagacctgccttgccttccctggagttaatgaatcagtgtgaatgaagagcacagtcttcttttaaatgrcaggggaaccgtgcacttatttaccggcaattctcagattctaattgttccgactacaatgcgtcctgtaaaccgggtagctgggagaaacttcaatgca

SEQ ID NO: 58146 - DNA, 201 bp, Homo sapiens
ccaggacaggtgccctcctcagcggagacaactgtccccctccatcctgcaggagttttgcagccatccttccagccactgcttctctaccggggcaaatyttcccccaagggataattgataatgtctgaggcatttttaattgtcacaacttggggaaggggcaagggattgagggagagtgctcctggcatctggtgg

SEQ ID NO: 58147 - DNA, 201 bp, Homo sapiens
aaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactgcagacctcccaaagctcacgaactgag

SEQ ID NO: 58148 - DNA, 201 bp, Homo sapiens
tttattgtgggacatttagagaatctcagactagcaggtgttagattaaacagaggagaaacggtccttgtggtgataaaacttccctacgcaaggacaartagagaaacaactgtagatgaagcagccagtctcaggctggggcagcacgccctgcgataggttaaggtttattttagacaaatatttaaaatgcagcta

SEQ ID NO: 58149 - DNA, 201 bp, Homo sapiens
agcgtgcagactcaggagccaagacctgccttgccttccctggagttaatgaatcagtgtgaatgaagagcacagtcttcttttaaatggcaggggaaccrtgcacttatttaccggcaattctcagattctaattgttccgactacaatgcgtcctgtaaaccgggtagctgggagaaacttcaatgcatctttgtaatg

SEQ ID NO: 58150 - DNA, 201 bp, Homo sapiens
atccgtcgttccaaatatgagcactttctcttgtcttttctgagctacctattccaagaacacagaggagttgttattgtggttacttgtggtaagaagastacctttctgattggacccagggcagaaaaaagaactttcaggtggaaatacagtcgtggtgtcaggtagtgtgtaacttcgttaagttcagtcatagca

SEQ ID NO: 58151 - DNA, 201 bp, Homo sapiens
caaatgtttacatggggctgtggaccattttgtatcattggaggagaagccagggcacttggcaggggtgttcatgatgataatcaggtggctgggtggastcaccatttgtggcatcctcaaagacttgccaacatagacatttttggggagacagaaacacagaaataattctgcagtgctttaaagaatctgttaaaa

SEQ ID NO: 58152 - DNA, 201 bp, Homo sapiens
gttccaaatatgagcactttctcttgtcttttctgagctacctattccaagaacacagaggagttgttattgtggttacttgtggtaagaagagtaccttyctgattggacccagggcagaaaaaagaactttcaggtggaaatacagtcgtggtgtcaggtagtgtgtaacttcgttaagttcagtcatagcagccgctg

SEQ ID NO: 58153 - DNA, 201 bp, Homo sapiens
cacagaaataattctgcagtgctttaaagaatctgttaaaaatcaagtttctttcagtcatgtatgatccattgggctttatataacttttagcctttgcyttgcagggacagcaaagatgtgagcaaatttgtgcaaacctaatagggtgaaaaattgaggtatgaattagtaaagtcatttgtccttctggaaagagtt

SEQ ID NO: 58154 - DNA, 201 bp, Homo sapiens
cccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcac

SEQ ID NO: 58155 - DNA, 201 bp, Homo sapiens
gcactttaaatgcattaattcagttcatctttatgacaacactatgagatagctaatattatgaatcctattttcagatgaaagactgagtcttagggaasaaacagccgagagatgaaatgccacagggatgtctaggttcaaacagcaacagaggtgcgtaccatagggatgtggaagccttgcttgtcttgttcctct

SEQ ID NO: 58156 - DNA, 201 bp, Homo sapiens
attgtatcagtcagcgtagactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaaga

SEQ ID NO: 58157 - DNA, 201 bp, Homo sapiens
gggatgtctaggttcaaacagcaacagaggtgcgtaccatagggatgtggaagccttgcttgtcttgttcctcttggtataaccccagtgagtagcatagygcctggtcaattggagggatttggtaaatatttactgagtgagtgagagggtaaaacagctgagccatgggagttataacttgggcagcagtaatcctgc

SEQ ID NO: 58158 - DNA, 201 bp, Homo sapiens
gctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagagga

SEQ ID NO: 58159 - DNA, 201 bp, Homo sapiens
tcattctggagcagtgggagccgactgtgatgcagagtggactcataatccagcttgattttgagggacagaaacctgggcctttaggtagaatgaacagsttaaaaggctgcacctgagagtagggggcatatgggtaaatccagctgtacccaagagttgggggcatatgttagccctactgggtaaatccagctgcac

SEQ ID NO: 58160 - DNA, 201 bp, Homo sapiens
tactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctag

SEQ ID NO: 58161 - DNA, 201 bp, Homo sapiens
acttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacaactacta

SEQ ID NO: 58162 - DNA, 201 bp, Homo sapiens
tcatcattaacatgccttatctgacatgtggcaataacttctgcctttcttatgtcatctgcatggttgcagtggatagtcactggacaattgatgaacamctactacatgctagatctctccctggggagagtgcttgtctttgaaacagtcaaaggaggaaggaagaaaagagaggcagaacaattataataaagcaac

SEQ ID NO: 58163 - DNA, 201 bp, Homo sapiens
ccttatctgacatgtggcaataacttctgcctttcttatgtcatctgcatggttgcagtggatagtcactggacaattgatgaacaactactacatgctaratctctccctggggagagtgcttgtctttgaaacagtcaaaggaggaaggaagaaaagagaggcagaacaattataataaagcaacttaacccattgaga

SEQ ID NO: 58164 - DNA, 201 bp, Homo sapiens
aaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaaga

SEQ ID NO: 58165 - DNA, 201 bp, Homo sapiens
gtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaa

SEQ ID NO: 58166 - DNA, 201 bp, Homo sapiens
tgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcataggg

SEQ ID NO: 58167 - DNA, 201 bp, Homo sapiens
ctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaacaaaaataatacctacaataaccacaatatagcaacagcaatcatgttca

SEQ ID NO: 58168 - DNA, 201 bp, Homo sapiens
gcatagggtttggggaggattaaataagataatgtaaatagagtttagcgtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcatt

SEQ ID NO: 58169 - DNA, 201 bp, Homo sapiens
gtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagtgctttatagacctctgatcagcttccagcatcctcttggtat

SEQ ID NO: 58170 - DNA, 201 bp, Homo sapiens
aggagagataagaaatggagcaagggaggggtttcatcccgccgtgttcatttgcttggctgtcctgaaattgcgaatacgcagttgttacctgctcccgktgggaggggggggatatttatttggcatcttgcaattgataggagctgagtgattttagtaggtagtttaactccttaaaaacttccagtggtttcatat

SEQ ID NO: 58171 - DNA, 201 bp, Homo sapiens
tttcctcccctgtaaaacgggttaatatcagcacttatcacatagtttttgagaaagctaaacgtgcttatctatagtggttattattactagaaagaatrtcgtggtgcccccaaacatggatttaacaagcattgatcaaatacctcctatgcccctacgaaccaggtactagaaatccactcctttcacttgcttttg

SEQ ID NO: 58172 - DNA, 201 bp, Homo sapiens
gcaacttgggtcatgccactacagatcgacacccactaaatccttttaatttagtctagtgcaacaagtatttgtgtaagtgtcctctgccctggacaccrgtgaggtcaccgtgggaatggctgggcaggaacaaagccttttgtttccagctgagtttccttttctgaagattgcctgtcctagacaccagttctctgt

SEQ ID NO: 58173 - DNA, 201 bp, Homo sapiens
acctctcctcggccttgcaaagtgctgggattataggtaccccgcctggctgatactttccttagttgttttcagtgtaataacctgtcttcagtctactytttgtccttttctctcctttcctccctgaatactcaagcttccagtgcacagatttctccaaccctgaatgtgactgataccaacaccatactagctctt

SEQ ID NO: 58174 - DNA, 201 bp, Homo sapiens
ttttgcatccctagacatcatcctttttgagagagaaaattccgagtgtcagttttcctttatcggaacctccttttatttgaactaaccacaatgggtcrtaatttataggcccagtcagcgcatcattgctcagatagagtcatttacctacaagtatccatcagttaggtgggggctgctagattttttaagtggaaa

SEQ ID NO: 58175 - DNA, 201 bp, Homo sapiens
ttccaagtagctggttttgcaggcatgcaccaccacacccagctagtttttctatttttagtagaggcggagtttcaccaagttggccaggttgttctcaractactgacctctcctcggccttgcaaagtgctgggattataggtaccccgcctggctgatactttccttagttgttttcagtgtaataacctgtcttca

SEQ ID NO: 58176 - DNA, 201 bp, Homo sapiens
tgcctctctttccttagtcctgtgtgcttccccttgatttcaccaggacaattttataccaatcccttgtattttagaagagcctgatacatttgcaaggwctctctttatattcctgaattttgcatccctagacatcatcctttttgagagagaaaattccgagtgtcagttttcctttatcggaacctccttttattt

SEQ ID NO: 58177 - DNA, 201 bp, Homo sapiens
gagattcttgtgcctcagccttccaagtagctggttttgcaggcatgcaccaccacacccagctagtttttctatttttagtagaggcggagtttcaccawgttggccaggttgttctcaaactactgacctctcctcggccttgcaaagtgctgggattataggtaccccgcctggctgatactttccttagttgttttc

SEQ ID NO: 58178 - DNA, 201 bp, Homo sapiens
ttgtccttactctgacacccactgcaagtttgaggtggtcctcaaacccatcctcatggctgatatttgctagaaggacttgtggcacttagcagaagctrttgtatttacagttacagtttattacagggaaaggatacaggttaaaattagatcggggaagagacaaatggggcaaagtccaagacaagtaccagatgt

SEQ ID NO: 58179 - DNA, 201 bp, Homo sapiens
atgcagtgttttccctgcaaaggagaagaaatatatttcttgcctctctttccttagtcctgtgtgcttccccttgatttcaccaggacaattttataccmatcccttgtattttagaagagcctgatacatttgcaaggtctctctttatattcctgaattttgcatccctagacatcatcctttttgagagagaaaatt

SEQ ID NO: 58180 - DNA, 201 bp, Homo sapiens
tgggcctttaggtagaatgaacagcttaaaaggctgcacctgagagtagggggcatatgggtaaatccagctgtacccaagagttgggggcatatgttagycctactgggtaaatccagctgcacccaagagtagggggtatatgttagggctagtgcgtaaacccagctgcacccgagatatggggtatacatgagtgct

SEQ ID NO: 58181 - DNA, 201 bp, Homo sapiens
atgagggccaggacctcatggtcataaaagtaacattagacctattcctagtaatttgatctaggttggcctgatttttgttgtggtggcagtggtggctrtggttgtcaatttaatggaatgtatttggaaagagcaagcttcttcccaatgcagtgttttccctgcaaaggagaagaaatatatttcttgcctctcttt

SEQ ID NO: 58182 - DNA, 201 bp, Homo sapiens
ggtatacatgagtgctattgggcaaatccagctgcacaggagagtaaggggcatatgttagggctagtgggtaaacccagctgcacctgagagtaggggtrtatgttagggcttgtgggtaaatccagttgcacctggcagttggggcatatgttagggctagtgggtaaacccagccgcaccggagagttgtgggtatat

SEQ ID NO: 58183 - DNA, 201 bp, Homo sapiens
gactctttttttcaggaatatattctgcatatatttcagtgatttttttttttttttgagacagtctctcattctgtcgctcaggctggagtgcagtggcrtgaccttggctcactgcaatttctacctcccgggttcaagcaattctcgtgcctcagcctcctgagtcactgggattacaggcatgcacaacaacaccca

SEQ ID NO: 58184 - DNA, 201 bp, Homo sapiens
tacatgagtgctattgggcaaatccagctgcacaggagagtaaggggcatatgttagggctagtgggtaaacccagctgcacctgagagtaggggtatatsttagggcttgtgggtaaatccagttgcacctggcagttggggcatatgttagggctagtgggtaaacccagccgcaccggagagttgtgggtatatgtta

SEQ ID NO: 58185 - DNA, 201 bp, Homo sapiens
tttttttttttttttgagacagtctctcattctgtcgctcaggctggagtgcagtggcatgaccttggctcactgcaatttctacctcccgggttcaagcrattctcgtgcctcagcctcctgagtcactgggattacaggcatgcacaacaacacccagctaatttttgtatttttagtagagacagggtttcaccatgt

SEQ ID NO: 58186 - DNA, 201 bp, Homo sapiens
agctgcacctgagagtaggggtatatgttagggcttgtgggtaaatccagttgcacctggcagttggggcatatgttagggctagtgggtaaacccagccrcaccggagagttgtgggtatatgttagggccagtgggtaaatccagctccatctgagatatggggtatacatgaatactagtgggtaaatccagctgtac

SEQ ID NO: 58187 - DNA, 201 bp, Homo sapiens
cctcccggattcaagagattcttgtgcctcagccttccaagtagctggttttgcaggcatgcaccaccacacccagctagtttttctatttttagtagagrcggagtttcaccaagttggccaggttgttctcaaactactgacctctcctcggccttgcaaagtgctgggattataggtaccccgcctggctgatacttt

SEQ ID NO: 58188 - DNA, 201 bp, Homo sapiens
attggtaaaaacatatatcagagtccttttgactgtttagaaagtgttaatttactccacgattatccattcaacatttattagttggcttctgtgtgggwgagtaaccattaataccttgaataagtttataatctggtcattctgtagagcttcctatatgatgtcttctgtttaagtatttctgtaataccttataga

SEQ ID NO: 58189 - DNA, 201 bp, Homo sapiens
cacctgagagtaggggtatatgttagggcttgtgggtaaatccagttgcacctggcagttggggcatatgttagggctagtgggtaaacccagccgcaccsgagagttgtgggtatatgttagggccagtgggtaaatccagctccatctgagatatggggtatacatgaatactagtgggtaaatccagctgtacacgag

SEQ ID NO: 58190 - DNA, 201 bp, Homo sapiens
tgttttccttaaactctgtgcacatgaatatttgtggtatatggcttaattgtaagcgatcaggcatcaatggctttttatgaggcaaaatctactttctrcatttgcgtgtgccattattatagattgctgatgtttgccaatggatattcttggaagtcgtcttctggtttaaatgcagttaagtatttaaaaataata

SEQ ID NO: 58191 - DNA, 201 bp, Homo sapiens
gtccttttgactgtttagaaagtgttaatttactccacgattatccattcaacatttattagttggcttctgtgtgggagagtaaccattaataccttgamtaagtttataatctggtcattctgtagagcttcctatatgatgtcttctgtttaagtatttctgtaataccttatagacatctcttttagactactagtg

SEQ ID NO: 58192 - DNA, 201 bp, Homo sapiens
tggggtatacatgaatactagtgggtaaatccagctgtacacgagagtagggggcatatgttagggctagcaggtaaacccagctgcaccccagagcaggkgtatacatgagtgctagtgggtaaatccagcagacgtccggactgtgcttgagggtgtcatcgagagagagaaggttgatccgaagttagtaaaggcttt

SEQ ID NO: 58193 - DNA, 201 bp, Homo sapiens
gaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtg

SEQ ID NO: 58194 - DNA, 201 bp, Homo sapiens
ttggaggtaagtataaaaaccttcttgttttctactacttaaagctgaaaacccagcttgggttggctttgcttctaatatccttcttcctttttgtttcrtaagtaattgtcctgaagcctgtcgagataaatgtatactgaaagagaaagacacagaggagagacaggcatacagagaaagagagacacgcagacacac

SEQ ID NO: 58195 - DNA, 201 bp, Homo sapiens
tgagcccaggagtttgagaccagcctgggtaacatggcaaaaccttacctctcaaaaatttacaagcttagccaggcatggtggtgcccacttgtggtttyagctacctgggaggctaaagtgggaggatatcctgagcccaggaggtggagattgcagtgagccatgctcgtgccattgcatttcagcgtgggtgacagt

SEQ ID NO: 58196 - DNA, 201 bp, Homo sapiens
ccccatcaacatgatggcccttggaaaggactcttttagcctccgcgagttccttttccgcaccaggctccacttacgaaggactgcaaaaacttgctaaygtcatcagtctgaaaggattgagctgtaaaatgtgttatgggggcctaagcaacgcatctggaatttagccttcccaagttcaaatccggtttatgccac

SEQ ID NO: 58197 - DNA, 201 bp, Homo sapiens
ctcgtgccattgcatttcagcgtgggtgacagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcag

SEQ ID NO: 58198 - DNA, 201 bp, Homo sapiens
atgaacctgggaggcagagcttgcagtgagccgagattgcgccactgcacttcagcctgggtgacagagcgagaatctgtctcaaaaaaaaaaaaaaaaaraaagaaagaaagcaaaggttttttcctcccaagaactcatggtccaagttttggtttttaaatatgcatctatgacagcacggatcacatagtgcattga

SEQ ID NO: 58199 - DNA, 201 bp, Homo sapiens
tggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttc

SEQ ID NO: 58200 - DNA, 201 bp, Homo sapiens
ttaatagtaataataatatctaccacccactaggggtctatgtgtgtatgtgttgggggcggtgtggctggggagggaagcaaggcctgtattatggcccragctcaagaatattcgggcaagagcagatacaatgcctgtatttctcatcacttttgggtggcataggaccagttggttatgagcgtgaaaggttttctt

SEQ ID NO: 58201 - DNA, 201 bp, Homo sapiens
atttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggag

SEQ ID NO: 58202 - DNA, 201 bp, Homo sapiens
cttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccatttt

SEQ ID NO: 58203 - DNA, 201 bp, Homo sapiens
aattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccgttctggagagcctttgattataacatca

SEQ ID NO: 58204 - DNA, 201 bp, Homo sapiens
tgaaaaatctcttcctttcctatcgtgaattcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcggga

SEQ ID NO: 58205 - DNA, 201 bp, Homo sapiens
ttctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccacgcccgactgctttattt

SEQ ID NO: 58206 - DNA, 201 bp, Homo sapiens
tcaccgtgttacccaggatggtctcgatctcctgacctcatgatccacctgccttggcctcccaaagtgctgggattacaggcgtgagccaccacgcccgrctgctttattttcctttgtgttcctaatacctggcccagtgtctggcaaatggaaagttcccctggatgtagttgggtgacactatgagtgtatcgttag

SEQ ID NO: 58207 - DNA, 201 bp, Homo sapiens
ttttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatctgtgcaccagtaaagggttctgatgtgtgataaatttat

SEQ ID NO: 58208 - DNA, 201 bp, Homo sapiens
catcagccattaagaaaaaggtatgcagtctacatgcctcttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggactttgga

SEQ ID NO: 58209 - DNA, 201 bp, Homo sapiens
tagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatg

SEQ ID NO: 58210 - DNA, 201 bp, Homo sapiens
tttatatttttagctaaattaaaatactcacattcccattattttttagaggttgtaagctaagtaataacattctagaaactctctgttttttgaaaggkcatcaccactgttgaaggcgctaatgggagatcctaagtttcaggctctgctacagacgtcaggtcccctaggagttgggctgcctttgctctcctctcc

SEQ ID NO: 58211 - DNA, 201 bp, Homo sapiens
agagtgtgctgtgtcagggtgtttcattgcattttcatatttgtcatttctctttggagcgtgtcttttggtgccacggaaaagggctggattttctatcrggtacaataggtacctgcagggcttagggtacaagagcttgtcggggacctgcacacatgtttgagacctgtaaaaatattgctggctctgaattatgga

SEQ ID NO: 58212 - DNA, 201 bp, Homo sapiens
gacctcggtgctcacggtaatgcttccttccaccatatcagaaggtcctcagcagccgcagccacttaacatgctcggtgcttctctgtaggaggattttkaaaaagcaggaactgtcagggtcccaaatgttcagtggcacttcagccagaggtaggatagggattttgaagtgtttggagaagtgttttcatatttgaa

SEQ ID NO: 58213 - DNA, 201 bp, Homo sapiens
aagctctcaaagtgactttttattttattttttatttttacatggagtctcgctctgttacccaggctagagtacagtggcgtgatctcagctcactgcartctccatctcccaggttcaagtgattctcccgtctcagcctccagagtagctgggattacaggcacccaccatcacgcccagctaatttttgtattttta

SEQ ID NO: 58214 - DNA, 201 bp, Homo sapiens
ctacaagtggagcgtgatttcatctttcatcaagagaagcagcttttcctcctcttgtatccgttttcttccttttctaactatcaaggtcatgcggtatstgccattttgcatattcttgctttgcttcatgttttccttaaactctgtgcacatgaatatttgtggtatatggcttaattgtaagcgatcaggcatcaa

SEQ ID NO: 58215 - DNA, 201 bp, Homo sapiens
gtttaacctgacagttgatcaattgatatcctttgacttgttggaattttattctttacattcgtcttttaaaaagctttattttatgccagatgcagtgmctcatgcctgtaatgtcagcactttgggaggctgaggcaggtggatcacttgtggtcaggagtttgagaccagcctggccaatatggcgaaaccctgtct

SEQ ID NO: 58216 - DNA, 201 bp, Homo sapiens
ctgtgtcacctcagcatttaatttacttccgtcacaaaactacttgaagttgtcccaggctagttggtcctattaattacaacctagagggattctattartaaactaatggattacagtacctaaatggaagccagcagatgactttggaaggactgatccgcaagggccttctgtgtgaagattaaatgaagcttcctt

SEQ ID NO: 58217 - DNA, 201 bp, Homo sapiens
aggctgaggcaggtggatcacttgtggtcaggagtttgagaccagcctggccaatatggcgaaaccctgtctctactcaaaatacaaaaagttagccgggygtggtggcacgtgcctgtaatcccagctactgaggaggctgaggcaggagaattgcttgaacttgggaggcagaggttgcagtgagccaagatcgtgcca

SEQ ID NO: 58218 - DNA, 201 bp, Homo sapiens
catgtagaggttggcaaaggggacaggagactgtgggatgattagtatattcttatttggcctgggagggaaaaaaaatctttcatttccaacaatattcwttctctgtgtcacctcagcatttaatttacttccgtcacaaaactacttgaagttgtcccaggctagttggtcctattaattacaacctagagggattct

SEQ ID NO: 58219 - DNA, 201 bp, Homo sapiens
ggctgacacaggcagatcacttgaggtcgggagttctagaccaacatggtgaaaaccagtctctactaaaaatacaaaaaattagctggccgtggtggtgygcacccgtagtcccacctacttgggaggctaaggcaggagaattgcttgaaccgcggaggcagagattgcaatgagccgagatcgcgccactgcactcca

SEQ ID NO: 58220 - DNA, 201 bp, Homo sapiens
gctcagtctttgaagggttacagaaacagtttcactagaaggtgtgacattgtgtaacagaaatcggttccttaacctgccaaagggaagaaaatagtgcrgaatcttttctccaggtttcaggacccatgtctgttgtccttcctttaccttaacttcagcagggcaagaatggttcaagccacattagaaagcagttac

SEQ ID NO: 58221 - DNA, 201 bp, Homo sapiens
taaaggcttactgggtatcagggctgctttcctttataatcttttacccgtcttatgggggatgaacagaaacacactttagtgctagaaaagctgggccyaaaagaccagtctcctgtcccatacttggacatttattgttctttttgggcaaggtgaaaacttgaaaccaaaagtctgttgagtttggaagacttgact

SEQ ID NO: 58222 - DNA, 201 bp, Homo sapiens
tctgttgtccttcctttaccttaacttcagcagggcaagaatggttcaagccacattagaaagcagttactttctcacccaattttaaaggagaaaggtaratgcggtgggttctagggatttcagtgacgtaacaggtgtttcccaggcattaagacctagtaaggtttccatttccattaggtattatggatgcattcc

SEQ ID NO: 58223 - DNA, 201 bp, Homo sapiens
ccaattttaaaggagaaaggtagatgcggtgggttctagggatttcagtgacgtaacaggtgtttcccaggcattaagacctagtaaggtttccatttccrttaggtattatggatgcattccaagaatttaattactataacatcacttcattcattgtaattccttactagagttatgagaacttgggattgtgtggtt

SEQ ID NO: 58224 - DNA, 201 bp, Homo sapiens
caagaatttaattactataacatcacttcattcattgtaattccttactagagttatgagaacttgggattgtgtggtttcttattcaatcgattaaaagstacttgctatagttttctaactagctatttatatgaaatttagtacttgtcaatatgtattaaatcaatacagttatatttatcaaagtggtgagaagag

SEQ ID NO: 58225 - DNA, 201 bp, Homo sapiens
tacttgtcaatatgtattaaatcaatacagttatatttatcaaagtggtgagaagagtttacatctgaacatagaatagattgcttgccttggccgggcgygggagctcacacctgtaatcccagcactttgggaggccgaggcgggcagatcacgaggtcaggagatcgagaccatcctggctaacacggtgaaaccccg

SEQ ID NO: 58226 - DNA, 201 bp, Homo sapiens
gggattacctggaaagggtggggcaattttggggggtcaagaaaatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgac

SEQ ID NO: 58227 - DNA, 201 bp, Homo sapiens
gtcctacaactggtgagctgtgagctgtaaattgtggaactaatttttatactgccaatctgaggccttttctgacctcatcgctgccactgtaaaatgarttctagccccagaccatgacatgcctactagcttagctctaaccaaaaagatttattatcccaagagttgtgaaaatgtggaagaactagaactgtcatt

SEQ ID NO: 58228 - DNA, 201 bp, Homo sapiens
gctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaac

SEQ ID NO: 58229 - DNA, 201 bp, Homo sapiens
caagactccgtctcaaaaaaaaaaaaaaaaaaaaaaaaaaagtgccatgtatattttgattacaaaaaatttcatgcggtgttactttctttttattggtrgagggtctttatgttttatttttttgagacagaatctgctccatcactcaggctggagggcagtggcaggatcgtagctcactgtaacctcgaattccta

SEQ ID NO: 58230 - DNA, 201 bp, Homo sapiens
ttgtagctcctgtgaagattcaggaattttttttttcttctatttgcaagctttagtcctaggcatggaaaaagaactttgaagaaaacctgagagatatsagtgtaaaacaagagaatgattccctctggggtgctggtagtgggggcttaatttcctaaaggcttactgggtatcagggctgctttcctttataatctt

SEQ ID NO: 58231 - DNA, 201 bp, Homo sapiens
tttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgctcagtgggtatctgttgaacc

SEQ ID NO: 58232 - DNA, 201 bp, Homo sapiens
agcaggagataaaaaggcatcagttccattccatatccaagtctgagtccaagggcaggagaagctgatgtctcagcttgaagtcaggcatagagaggcarttctttctcactcagccttttattttattcaggccttcaacagattgtatgaagccacccacactgggaagggcagtctgctttactcatagtactaatc

SEQ ID NO: 58233 - DNA, 201 bp, Homo sapiens
ttgcatactgacctttctgctcttttatgctgcctgctctctaatattgtccaaaaaccttctctaaagaaagtacacaaatggagagagggggaattggrcatgccattgggagaacaaatttatttagatatctttggctgtgttgacagaagctgcccaattatacccaatatacaaattttaaatgcatattagtca

SEQ ID NO: 58234 - DNA, 201 bp, Homo sapiens
atatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatatagactct

SEQ ID NO: 58235 - DNA, 201 bp, Homo sapiens
tatgtaatatataatatattctatgtaatatataatatattctatgtaatatatattaatatgtagggaatatgttacatattatgttgagagtgtatatrttatatatgggtttctatatattataataaacccatatataatatacataatagactatacacatatacagctaatatatatacacaatagtctagtata

SEQ ID NO: 58236 - DNA, 201 bp, Homo sapiens
accaccattctcccctactttgtctatgaattcgactactcttggtacctcatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttgg

SEQ ID NO: 58237 - DNA, 201 bp, Homo sapiens
gactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctg

SEQ ID NO: 58238 - DNA, 201 bp, Homo sapiens
tttgctcaggaagaagagcaaatggatttttgttaagaagctggcagtctgtcacaggagctacttgaggatacacacagttttctccccattagcatctscagtctctggtataaacttgagtcttctctttggtccctgataaatatacatagaatgtatggatgtgagaaagttaaactgatgtctgtgtgtcttcat

SEQ ID NO: 58239 - DNA, 201 bp, Homo sapiens
tttattttactataaatatgggataattatagtttttactgcatagttttgttatgaggagtaaatgagtcactatttctgagacacttcgtgcctggcasagaacgagcactgtgtgtgtgttacagaaatatatgtgggtgggtgtgtttctgttttccgtaattccagctaggcaaagacatatttaacaaaagcctt

SEQ ID NO: 58240 - DNA, 201 bp, Homo sapiens
tttcctggcttgcagctgcaactatctgacctctgcgtctgtcctcccacggccttctccctgtgtgtttctggatctcttctcctttgttatcaggacastggtcacattggattaagggcctaccctattccagtctgactgcatcttaactgtttaactctgtattccaatctaattacatgtctatttccaagtaac

SEQ ID NO: 58241 - DNA, 201 bp, Homo sapiens
gcgcatttgagacaggttgagggttcaagctgtccaatccctgctcatctgcagcacaccaaggaatgtggactaatgaaaaataaactgcatgcatgcartgcccatcacactgcctgcattttctaatcttcacaataactctgtgttgagaaatattcctgtctgtaatcccggcactttgggaggctgaagcgggca

SEQ ID NO: 58242 - DNA, 201 bp, Homo sapiens
ttcaccatgttggccaggctggtcttgaactcctgacctcaagtgatcggcctgcctcagcctcccacagtgatgggattacaggcatgcgccaccatgcstggctaatttttgtatttttagtagagatggggtttcactatgttggccaggctggtctcgaactcctgggctcaagcaatgcactggccttggcctccc

SEQ ID NO: 58243 - DNA, 201 bp, Homo sapiens
gggagcaggggaggaaccatctgaggtgtttttttttttttttttagatttctcattgctgagaacagttccagctctgctgaccaaaggctgagtgtccytttattagtctgagcccctagagaaaccaaagaggcaaccctcgagccaactgacagccagctgtggggttggaccctgtttttcatacagtgagcactc

SEQ ID NO: 58244 - DNA, 201 bp, Homo sapiens
cctgcctcagcctcccacagtgatgggattacaggcatgcgccaccatgcctggctaatttttgtatttttagtagagatggggtttcactatgttggccrggctggtctcgaactcctgggctcaagcaatgcactggccttggcctcccacattgctgggattacaggcgtgagccaccatgcctggccccctttcact

SEQ ID NO: 58245 - DNA, 201 bp, Homo sapiens
tctctaacatgcacatggccagaaaaatagcttggacattctgttcaaccctccacatcaactggtcagtttagtctttaaaaggtgataggcctgttgtsgtggctcacgcctgtaatcccagcactttgggaggctgaggcaggtggatcacttgagccccggagttgaagaccagcctgggcaacacggtgaaactaa

SEQ ID NO: 58246 - DNA, 201 bp, Homo sapiens
tctgagctgtgagtccttcctgtgcaccaggcatggatggcaaggcacgattgataatgttccctcttatctcgaaatgtccactctctctcccatgcacrgggagtcaagctgtgctcttcaaacacaaattccttctcccacttcctgggtagttatgctcttttcttccctgaggttgctaattgtgggcagtacagt

SEQ ID NO: 58247 - DNA, 201 bp, Homo sapiens
tgtgttactaaagttctcttagatactttacatttcctttcacggatttccaaaatttctttctttgagaatgtcaggaccagtaggaggttcagcacgcrttgccagagaaatcacagatgactaattggaatgcctcagaatcattctccttttgtttcacctaatttccacacttacgaagtcaaactctcagttaaa

SEQ ID NO: 58248 - DNA, 201 bp, Homo sapiens
cagggatagagtctcaaagttggaggtattttatgttgttttaaataatatcgtcatcacatgtcattttagaccccaaaagtccactccgaatctctgcktatggaattgaggaggggtgaggctgtcagaagccgagggacttggccaaggtcacatggctttggacggcccccctgaaccttggagctcatgttctgt

SEQ ID NO: 58249 - DNA, 201 bp, Homo sapiens
aattagctgcgcgtggtggcgcgtgcctgtagtcctagctactcaagaggctgacatgggaggattgattgagcccaagaggtcaagacggtagtgattcrtggtcacaccactgccctcaaccctgggtgacagggtgagaccctgtctctaaaaacaaaagcaaagtctactaaaaattcactggagctatgagaaatc

SEQ ID NO: 58250 - DNA, 201 bp, Homo sapiens
aaaaattagctgcgcgtggtggcgcgtgcctgtagtcctagctactcaagaggctgacatgggaggattgattgagcccaagaggtcaagacggtagtgaktcgtggtcacaccactgccctcaaccctgggtgacagggtgagaccctgtctctaaaaacaaaagcaaagtctactaaaaattcactggagctatgagaa

SEQ ID NO: 58251 - DNA, 201 bp, Homo sapiens
acacaaaacccagcgtggtgattttggcagccttgccatgcatctctaacatgcacatggccagaaaaatagcttggacattctgttcaaccctccacatsaactggtcagtttagtctttaaaaggtgataggcctgttgtggtggctcacgcctgtaatcccagcactttgggaggctgaggcaggtggatcacttgag

SEQ ID NO: 58252 - DNA, 201 bp, Homo sapiens
cagagcatttatctttgatgctgggaatgcgttcattttctttatcttgccattactgtacctctattgggaaatttactctctcttcatagataggatcmgattcagtacatatttataaaaccacacttacatttaaatacaggcctttcccatttcacagtgtttctagctcccctttccaatacatctctctctctc

SEQ ID NO: 58253 - DNA, 201 bp, Homo sapiens
aaacaaacaaacaaaacaaaacaaaaaaggtttaagaaatgttctagtaccttgaaaccaaaataggtatcagatacttggctgttttgttttttcttctwagccattttgacctgtgagattttatgtgatgaaaacataagaatgtggtattacaccctgtgatttgaattttccatactccattccattctatatgtc

SEQ ID NO: 58254 - DNA, 201 bp, Homo sapiens
ccgggaagagcgcatcctaaatcagccattagatttgttcctcatttctttgctttacaaattgtttttctgtatagtattggattttcaataaataaagkatgatataaacaagtctgcaaaccagcaagaactatataagccacttgctcaagtcaataagcgcatgctcacaaaggaacgtaaagttctgaagttctt

SEQ ID NO: 58255 - DNA, 201 bp, Homo sapiens
aatttctttcagaagtcagtactggacattcccttatttcaccttgagctacacatcccatagtcagcttagccctgtccctggtgcgggggagcaggackgttgcctgtatcccttagtcattgccgcaggcttgctgcatcacaaaccaccattagacctcagtggcccgcagcaataaacattcgattctcgccatct

SEQ ID NO: 58256 - DNA, 201 bp, Homo sapiens
aagaacattttgtgaatgtttaaatatcctaagacccactaaggaagtttgtggcaatatttgctcaaagacagtatatataataaatactttagactggytaagagaatggctctgaatgtctacctagctatcacatttagaaacgccccttgccttccttccaggactttcttccttaatcaggattgacttaactgt

SEQ ID NO: 58257 - DNA, 201 bp, Homo sapiens
cagcattgggtgtggctctggggattcattctagtgggcaagtctcatatttctcaacctcaggtttttcatctgtaaatggggacaatactgacatctasctaatgtccttgaggatggaatgagatattgagtataaagtatctagtagagtggctagcgtatagtgagtacccaataaatgcaatagatgttggcttt

SEQ ID NO: 58258 - DNA, 201 bp, Homo sapiens
cctggcatactgcaaatatctatggttgataaattaatgttatcatcatcacgtaagcatcttgggaagtctgtaagtaatgggagttggaggcttaacastgatctttgagctggcgatttttccagccaactcattttggacgttggtgcttaagcatatcctgttttcgagggtggtgttggtggtggaggaggtgat

SEQ ID NO: 58259 - DNA, 201 bp, Homo sapiens
agatcgcgccactgcactgcagcctgggcgacagtgaaacttttgtctcaaaaacaacaacaacaacaacaacaaacaaacaagaaacaaaaaatacataraagaggccttctcttcacaagtttttcttattgttttttgtttttttaagggaggaaatttctttcagaagtcagtactggacattcccttatttcacct

SEQ ID NO: 58260 - DNA, 201 bp, Homo sapiens
tcttgggctggctcattacaggccactctgtctgaggaacactcaggtttgcaaaccgtttcttaaaattacaggatacctagggacctgttggggtgggwgggaagaaccctatgggcagaaatgtgactttctgtagcaaagatgtactgtttcccactgagaagaatcaaaaatagaaaagtgcttccttgtctctct

SEQ ID NO: 58261 - DNA, 201 bp, Homo sapiens
cccgtctctactaaaaatgcaaaaaattagctgggatttggtggcgcctgcctataattgcagctacttggaaggctgaggcgggagaatcacttgaaccrgagaggcagaggttgcagtgagccgagatcgcgccactgcactgcagcctgggcgacagtgaaacttttgtctcaaaaacaacaacaacaacaacaacaa

SEQ ID NO: 58262 - DNA, 201 bp, Homo sapiens
gaacctttctcttataaggatactaatcccatcgtaccccgtcccccatgatctcatttgaaattagtcacctcccaaagccccacctccaagtactgtcmcactggggcatagggcttcagcatatgaatttgggggagctggggagaggaacacatacatttagtccataacaactatctcacttacctctctactaag

SEQ ID NO: 58263 - DNA, 201 bp, Homo sapiens
acggcagtctcaggtttatgtattaggaagcattcagcaggcaggagcagccgatctgagactggcatgggcagtggagacatcattcatctcctgaaacrtaatttggaggagactgttccagggctggctgagtgactccttgatgtcagcactttgccctgtcgtggtcttggcctttctcttgtgttccccagatgg

SEQ ID NO: 58264 - DNA, 201 bp, Homo sapiens
acctgtagtcccagctgcttgggaggctgacgagtaaggatcacttgagccagcatggtggaggctgccatgatcatgctactgcactccagcctgggcarcagagccagaacctgtcttgtaaagaaaaggaaaaagagagagaagggcagaaagaaagaagggaaggaagaaaggaaaattgggcccaggaatgatctt

SEQ ID NO: 58265 - DNA, 201 bp, Homo sapiens
agggaaggaagaaaggaaaattgggcccaggaatgatctttacaatgcctgacaaccaagagaagaagggaaatgagcttcacattgcctgcaagctctarggtgacaagagccaagagaaattattgttactgtagtgatgttccactgaggatcataaagtactttattactctactgagtatggttattggatatgtg

SEQ ID NO: 58266 - DNA, 201 bp, Homo sapiens
gatgctgggaatgcgttcattttctttatcttgccattactgtacctctattgggaaatttactctctcttcatagataggatccgattcagtacatattyataaaaccacacttacatttaaatacaggcctttcccatttcacagtgtttctagctcccctttccaatacatctctctctctctttctctctctctctc

SEQ ID NO: 58267 - DNA, 201 bp, Homo sapiens
ttattagctctgctatcagagtgatgctgtggctggagaagatggagacccatgtgttcaggctgtgagcataggcagatcctttctaatgcagaaggtgyagacacagggcacagaactgccaactgtggctgctgacacctgtctgactttgactgggttagtgacaaagaaatgactttccttttgtatgttagccct

SEQ ID NO: 58268 - DNA, 201 bp, Homo sapiens
taacataataccatagactgggcaggttaaacagcagacctctattcctcacagtctagaggctgggaagtccaaggtgaagccatgggcacattctgtgsctgcctgaggctctctttctggttcccagatggatgcctttgtgtgtcctctcatggcagagagaggaaggggtctggaacctttctcttataaggatac

SEQ ID NO: 58269 - DNA, 201 bp, Homo sapiens
ttatccatgccatctgaaatcctccttcctttttaacaaggcaagtagaaaacgaaaacaacatcaaaggatacactacacaattgttggagccctaggamccgagagaagagtacaagcaggttcttgaactgttctctccccagcaactataactggaaggaacctcagtttgtccattcattcattcatcagagcagc

SEQ ID NO: 58270 - DNA, 201 bp, Homo sapiens
gtagcctcaacctcctgggctcaactgattctctcatcttagcctcctgagtggctgggaccgcaggttcatgctaccgtgcccagctaattgtttaattytttgtagagataggatctctccctttgtggcccaggctgatctcaaactcctgagctcaagcgatcctactcactcggcctcccaaagtgctgggattac

SEQ ID NO: 58271 - DNA, 201 bp, Homo sapiens
atgaactcatgggaagcaaacacacaccctccctccgatccaccaggcactcgggtttcctgtgtgtctggtgatgtgctgggtgttgtggatctggactsaacggcagtctcaggtttatgtattaggaagcattcagcaggcaggagcagccgatctgagactggcatgggcagtggagacatcattcatctcctgaaa

SEQ ID NO: 58272 - DNA, 201 bp, Homo sapiens
caaggacataaacatttactcctgtggtgttatgatatatatagggttcctggctcataactctcatagcccttgttgcagtctattgttacaatattgcstgtgttaggcatcaggaaacagaatctctttgtctcctgtccttctttcacctgccccaaggcaggactctaatctttcccacctttttgattgtgagtc

SEQ ID NO: 58273 - DNA, 201 bp, Homo sapiens
gtttttatatgcagtttgtatttatccatgccatctgaaatcctccttcctttttaacaaggcaagtagaaaacgaaaacaacatcaaaggatacactacmcaattgttggagccctaggaaccgagagaagagtacaagcaggttcttgaactgttctctccccagcaactataactggaaggaacctcagtttgtccat

SEQ ID NO: 58274 - DNA, 201 bp, Homo sapiens
aaatcctttgcaaacattttctctcaatctatgggtaggcttttttactctttttatagtgtcttttgatgaacaaagattttaaatcttgatgaagtccmctttatctattttggatgttgttgcttctgtttttggtgttgtatctaagaatccattgccaaatccaaggacataaacatttactcctgtggtgttatg

SEQ ID NO: 58275 - DNA, 201 bp, Homo sapiens
tagcctagttttccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcact

SEQ ID NO: 58276 - DNA, 201 bp, Homo sapiens
cagtcctcagtgtaccccaggaaagaggaaactgagtctccatgtggctttctgtctggcctttctcttttgcttgccttgtgctttgaatgcaggcctgmtgtttgcctgtggacctcaggatttgtaaggccatctccacccacctacagctaagtttcccaagagccgatctccagccgaagtccaaggttccttgat

SEQ ID NO: 58277 - DNA, 201 bp, Homo sapiens
aggtaagcggctagcacagtgctcagcatgcatgaaggactctttcattatcgttattaactgatgtttttaacttatacattgaaatgtggaaacaagcsttgcttctattgaatgacttcttgaaagtgccagtctgatccttgaccttcaggtgcatctctaaattctttcatgtcagggtctctgaaatctgaacac

SEQ ID NO: 58278 - DNA, 201 bp, Homo sapiens
cttacaatccgttgcagaaagcctagctccccagcttctcctgaatctacgtttttctattttgtctgaactagccaaggtctctggagtttgctgttatmttgcttcagagaaattagtgacattgaaaggctgttgtcttttttagtgtacttttggttgttaggagaaatttacaaggccatttttttctcccgtctc

SEQ ID NO: 58279 - DNA, 201 bp, Homo sapiens
gctcactgcaaactacccccgcccccgggttcaagcaattgtcgcacctcagcctcccaagtaactgggattacaggtgcccaccaccaagcccggctaakttttctattttcaatagagatgaggttttgccatattggtcaggctggtcttgaactcttgacctcaggtgattcacccacctcagcctcccaaagtgca

SEQ ID NO: 58280 - DNA, 201 bp, Homo sapiens
ataaatatatacatatatgtgtatatatagattttgttttttgagacagggtcttgctctgtcactcaggctggagtgcagtggcgtgatcatggctcacygtagcctcaacctcctgggctcaactgattctctcatcttagcctcctgagtggctgggaccgcaggttcatgctaccgtgcccagctaattgtttaatt

SEQ ID NO: 58281 - DNA, 201 bp, Homo sapiens
atatatatatatttatataaatatattttatatttaaaaatatttatattttatatatttttatatatttatgcaagtatatatctaaatatataaaatakatataaatatatacatatatgtgtatatatagattttgttttttgagacagggtcttgctctgtcactcaggctggagtgcagtggcgtgatcatggctc

SEQ ID NO: 58282 - DNA, 201 bp, Homo sapiens
caagaaatgcggcagctgcttctagccgctccatccttccttttcccagtgcgcactaaccctccagagccttccgcatctgctatgcagcattggccacrccagtgggatgcaagaatttatcccttctgttgatgcaattaaagctaatggatctcatatatatatatatatatatatatatttatataaatatatttt

SEQ ID NO: 58283 - DNA, 201 bp, Homo sapiens
gttgctgtactagatgaataatgtccccccaaattcgtgtctatctggaacctcagaatgtgacctcatttggaaataaggcctttttaattaaaaaaaawtttttatttaaaaaacagagatagagtcttgccatcttgcccaggctagtctcaaactgttgggctgaagcagttctcctgctttgacctcctaaagtgc

SEQ ID NO: 58284 - DNA, 201 bp, Homo sapiens
cacagctggagtttaggaaggccaggcagcgtgtgttgaatgccagccactcttctacccagggtcatatccttggatgtttttctgtgcatctgtctttyccgaccctcccgtgattctggaaggaaacacctttccaagctccccagtgaccctggttcatcccggaaatatgcaggaaaagcattatgagcattgcag

SEQ ID NO: 58285 - DNA, 201 bp, Homo sapiens
ctcacatgtaggtcacctacgggagcaggggaggaaccatctgaggtgtttttttttttttttttagatttctcattgctgagaacagttccagctctgcygaccaaaggctgagtgtccttttattagtctgagcccctagagaaaccaaagaggcaaccctcgagccaactgacagccagctgtggggttggaccctgt

SEQ ID NO: 58286 - DNA, 201 bp, Homo sapiens
gagtttgagagcaatctggccaacatggtgaaaccctgtctctactacaaataaaaaattagccgggtgtggtggcgtgtgcctgtaatcccagttactcsggaggctgaggcaggagaatcgcttgagcctgggaggcagaggttgcagtgagctgagatcgtgccactgcgctccatgctaggtgacagagcaagattc

SEQ ID NO: 58287 - DNA, 201 bp, Homo sapiens
gccatgttggagagggatccaacatttattatccccattttacagatgaagaagttaaggtggccaggcatggtggctcatgcctgtaatcctagcacttygggacactgaggtgggtggatcacttgaggtcaggagtttgagagcaatctggccaacatggtgaaaccctgtctctactacaaataaaaaattagccgg

SEQ ID NO: 58288 - DNA, 201 bp, Homo sapiens
ttgcctgatcgcctctccacccctgctacgtgtaatagaaaggtagggccatgttggagagggatccaacatttattatccccattttacagatgaagaasttaaggtggccaggcatggtggctcatgcctgtaatcctagcactttgggacactgaggtgggtggatcacttgaggtcaggagtttgagagcaatctgg

SEQ ID NO: 58289 - DNA, 201 bp, Homo sapiens
ttaactttcagaggagccaccaaattgttttccacggaggctgcaccattttatatttccacttgcagtatatgaaggttccaatttctccacatccttgmcaacactttattttctgttttctttgaaggtatgaaattgtatcgtggttttgatttgcatttccctcatgattaatgatgttgagtatttttatgtggt

SEQ ID NO: 58290 - DNA, 201 bp, Homo sapiens
agccttcatctgttttcctgcagatgcccggctcgtggttaacccaagcaagaggtagttaaacggccccgcagattgccagtgactccgggaatgcctargtttatgtatggattaacacagtgatagaccctgagtagcaaaagacgaagactaattacctgacagagctcccctccactcgcctgggtcattgaaatt

SEQ ID NO: 58291 - DNA, 201 bp, Homo sapiens
acaccagactaatgcttctgacttttccatggtgccccagcagcaggctggagggaagggcgggggcggtcagaggagagatagagcacttcagattccamtcgaatacattagagcattagagcttttctcttcctcagggtgctctctctctctgggttgggaggagatgtggcatttctaggaattcacagtaaaatc

SEQ ID NO: 58292 - DNA, 201 bp, Homo sapiens
aaaattcaaaaaattgcaacctgaggcataaatgggttttaagctccatacagtaaaacctagcatatgaaaacagttctggctgatgggttggtagaagkgatagatatagatacatatatacacatatatgcacagtaatagatataggtaaagaccttgatatatgtacatatattgtatgatacatatccatgcata

SEQ ID NO: 58293 - DNA, 201 bp, Homo sapiens
ccgcacccggccctgtttttgcatttttagtagagacgggttttcaccaggttggccagcctggtctcaaactgttgaccttaggtgatctgcctacctcsgcctcccaaagtgctgggataacaggcgtgagccactgcgcctgtctacattttctgtctttactggtattatggtgggaacccataaaccactgcgagg

SEQ ID NO: 58294 - DNA, 201 bp, Homo sapiens
ctcaggatgaggatgttcaatttgtactgctggtggagctgcctttccattaagtgagtctttctccaagggaacagaagtcttaggttgttgatctggckgtcagaacctaggacaggcaaggcagtgggctgttgtagaggagatgaagctgatcagagcacacccacaccagtgacaaccggtcaggacctgggaagg

SEQ ID NO: 58295 - DNA, 201 bp, Homo sapiens
tgcgcctgtctacattttctgtctttactggtattatggtgggaacccataaaccactgcgaggcagataccattttaagcaggaaaccttatttttttcygaagcacatttaaaaatattttccagtttatctattaaacatcctcctttgcttctggagatcctctgaaagatttatctctttcgattcatctgtaaag

SEQ ID NO: 58296 - DNA, 201 bp, Homo sapiens
ctttgatgtgtgtaggtaagcggctagcacagtgctcagcatgcatgaaggactctttcattatcgttattaactgatgtttttaacttatacattgaaakgtggaaacaagccttgcttctattgaatgacttcttgaaagtgccagtctgatccttgaccttcaggtgcatctctaaattctttcatgtcagggtctct

SEQ ID NO: 58297 - DNA, 201 bp, Homo sapiens
ccttactgttgaagacttgtggaaaagggacatggcccagggaaccagagtggtttgggaaagcactttgtcaagaggcttggggaccccagggtggaagytgccatgcgcatgaggctgtgttagcagaggcagtggcagaagaagacattgcaaacctgcaaaagcaacctctgaggatgggtagacatatacttcatt

SEQ ID NO: 58298 - DNA, 201 bp, Homo sapiens
gcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggag

SEQ ID NO: 58299 - DNA, 201 bp, Homo sapiens
tccactgtttatcctggtgaccttaggcaagtcatttaatttccttgagttttggtgtaagtattgatggagcagaccatcaataactgttcttatgtctrttattaccatgtgtctgtctacatgtttgtttgtaaattctctgtgggtaaaagttctcttttcatccccttgcctcagcacggagcccagagccagact

SEQ ID NO: 58300 - DNA, 201 bp, Homo sapiens
ctgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactgggga

SEQ ID NO: 58301 - DNA, 201 bp, Homo sapiens
gtctggatatgaattccaaagaccactggactttggaatattcgtaggtctctgaaaattcagacccacagaggccttaccccgctacagagaggccccargagagaggcctcacaccctctggctccactgaaattcacttcacgtttccaacttggattaaactggcacgacagttcagtcaaatgtcaagtccatttt

SEQ ID NO: 58302 - DNA, 201 bp, Homo sapiens
accttgtagcaagggggaaaaaaagagcttcttgacatctttttgaagaatggcgctctttaaaaaaacataagggaactttttttttcaaacactgtaaygagggtattcaagtctgcaggcaaaacagagctgtttgaaaagacattagcctcgaaaccgcactgtgccagaatagatacagctacgtcaaaatgccgc

SEQ ID NO: 58303 - DNA, 201 bp, Homo sapiens
aaaaaaaaaatcgggaattagcgtgtagctattaggcgtagattcctgcctaaggtctggatatgaattccaaagaccactggactttggaatattcgtargtctctgaaaattcagacccacagaggccttaccccgctacagagaggccccaagagagaggcctcacaccctctggctccactgaaattcacttcacgt

SEQ ID NO: 58304 - DNA, 201 bp, Homo sapiens
tggaaaaaaaaaatcgggaattagcgtgtagctattaggcgtagattcctgcctaaggtctggatatgaattccaaagaccactggactttggaatattcrtaggtctctgaaaattcagacccacagaggccttaccccgctacagagaggccccaagagagaggcctcacaccctctggctccactgaaattcacttca

SEQ ID NO: 58305 - DNA, 201 bp, Homo sapiens
cctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacc

SEQ ID NO: 58306 - DNA, 201 bp, Homo sapiens
aataactctgtgttgagaaatattcctgtctgtaatcccggcactttgggaggctgaagcgggcagatcacctgaggtcaggagtttgagaccagcctggscaacatggtgaactccccccaaccaacgacccttcccatatctactaaaaatacaaaaattagctgggcatggtggtggggacctataatcccagctact

SEQ ID NO: 58307 - DNA, 201 bp, Homo sapiens
agcattcacacaggcactaagacggtgagtactcactacttagcgctgtcaacatcatctccgtccacatcaatgtcgtcatcgtccttatgaaaagccckgggcatcattttgcccttgagctggatgtccatgttggaaaaacagctagtggaaggcgtgcccaaatctcagaagttggcgtttccttgcagatatcat

SEQ ID NO: 58308 - DNA, 201 bp, Homo sapiens
acaaatcttgtttttgtctttttattgaatttaaccactattgacttgcgacttgcggcaatcaccagatcccagatctctgtgtttggagctacacgtcyttctgaatcgaggaggtggggcactgatttttcttttatcactgacttccccgaagtgggaagttccagtgcttaacaagtttcattaagaacacagcta

SEQ ID NO: 58309 - DNA, 201 bp, Homo sapiens
ttggttatttctttattcaagggttgttgagaggatgaagtgctaaaaatgcttgaccagcattcacacaggcactaagacggtgagtactcactacttakcgctgtcaacatcatctccgtccacatcaatgtcgtcatcgtccttatgaaaagccctgggcatcattttgcccttgagctggatgtccatgttggaaaa

SEQ ID NO: 58310 - DNA, 201 bp, Homo sapiens
ctgggtaaaataaatatgatataaaacagacacaaataagaatatatagatgatgttaatttcttcagagcttcccggtgttacgtcttcaagaatatgaygacaggggaacagcccagtgtggcagtcatgtgacgacatgagcattggaaccagccacatctcagttggcaacacgtatctgtgtcttactagcttggc

SEQ ID NO: 58311 - DNA, 201 bp, Homo sapiens
gtgacgacatgagcattggaaccagccacatctcagttggcaacacgtatctgtgtcttactagcttggccactgtcacgtcactcagcctctgttttctmatctgtaaaatggggaaaattatagatgcttcagaagatatttgctatcactattaaatgaaaacaagcatgtcatcagtgcttattatttttgttgctt

SEQ ID NO: 58312 - DNA, 201 bp, Homo sapiens
ggtgatcctgctgcttggcagcatcttcccagcgtacaacagaggaaaactgcctgttgtagttaaaaaaaaaaagagagagagagagagagactgatacmcaaagagaatcagaaaggagtagagatgaaacaaagatagagctagcatgattgcaagctgaggacatacgaggagtccctgggtcagctgggccataca

SEQ ID NO: 58313 - DNA, 201 bp, Homo sapiens
taatacaaaagttttccccataccaactagtagtgtaagttgatttcatatccttttatttcataaagttttgcttatcgggtttgtcatcctctatttgmaattaaaatgtgtggtctcgagatgaccttaaagtatctgacccccaaatctaatcactcctagcatctgtgaaaattgacaaatatgtcaggtataact

SEQ ID NO: 58314 - DNA, 201 bp, Homo sapiens
cttggccaaatatccgagtgtggaagctctcactgtgaacctgctaacatacatttcagtgtctacaaaatgtcttttgagagaaaacagcagggacattygtgagctcttttttttttctaaccactttcccagtgagacttcagttttcattctccccttagcagctttcaaatatgtacgtaacacaaatgttacatg

SEQ ID NO: 58315 - DNA, 201 bp, Homo sapiens
agcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggatta

SEQ ID NO: 58316 - DNA, 201 bp, Homo sapiens
atttctttatcgtaagcacacttctctacattacctttataatccaacaactctgctattagtaaattatagaaacaacttttgtaacactatcttgtttscagagtatatgaaaaatttgaagttaaaattcagctccacgaatactgcagtggtgagaaaatggcgacaaagattagtcttctgtgagaagtctgctaa

SEQ ID NO: 58317 - DNA, 201 bp, Homo sapiens
ttaagttttttataggagtcattaatctccctcagcctcagtttccctatctgtgaagtgagtctaaccaggatgataatgaagagttaggtcaagtgagrttggcagccagacacccaccaccagctgtaacataagaacagatgttctctccagacccccaggtcagctgaggtcgctctgcttggaataatgaactgc

SEQ ID NO: 58318 - DNA, 201 bp, Homo sapiens
tatacaatgtcagtgctctgagctcattaggcgtcatctgagacagtggctgtaggggaggggaggtaggctctgagtcaagcagacctggaattttcttyatgggccattaggaactgtgtgacgctggggcatctgacttcacctttctgagtcttagtttccttacctgttgaataggtctaatgatatcattatggc

SEQ ID NO: 58319 - DNA, 201 bp, Homo sapiens
gttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcag

SEQ ID NO: 58320 - DNA, 201 bp, Homo sapiens
tggctggaggtacccctcagctcctagaggcatcaacagttcctgaatatctgggcttttcccacaaagcagcttccttcatcaagccagcaacaagagtytctggggcaagttggtcaacaagatggtgtcttacatgcccaatgtaatcatggaagccatgtatacctcatcacatttgccagatttctgctgattaat

SEQ ID NO: 58321 - DNA, 201 bp, Homo sapiens
cctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagg

SEQ ID NO: 58322 - DNA, 201 bp, Homo sapiens
gctcttatttttaagtcatccttatctctttcacttattccctcattcaggcaccaaaaatgctgtttgactgggagagcaagtggagctgttcaaagttstagggacagccgggcgcagtggctcatgcctgtaatcccagcactttgggagggcgaggcgggcagatcacaaggtcaggagttcgagaccagcctggcc

SEQ ID NO: 58323 - DNA, 201 bp, Homo sapiens
gccaaaatattcttttcaaagtgattagaagtaggagaagcttgctctctttttattggcacttctgtcttacatgcactttttgatttaaattattctgkcttctatgaaatgacagtgattggaggtggtttatttttttttaagtctgcttactcggaaaaataaaacaaagttgacaacctgatttcagacctccca

SEQ ID NO: 58324 - DNA, 201 bp, Homo sapiens
gtttcagtgcctgacacagttgtattcctaagacatagttgggaccagacctcaagaaaatagccaacaaatactgggtgaatgaacgaaagaggccataygcagtcagcccccctctctctgggttctacatatgtagatttaactaatgacagattaaaagcattcgaacaaacggagggtggtatctgtactgaaaat

SEQ ID NO: 58325 - DNA, 201 bp, Homo sapiens
cctctttaaggataagactttctgatttttcaactggatttaccattgtggcatctgcacatgagcagactgactgctttttggccctacctggagcctgrgtcctcaggtagctgacccgagagaccgtggagctgcttgtgatatacaatgtcagtgctctgagctcattaggcgtcatctgagacagtggctgtaggg

SEQ ID NO: 58326 - DNA, 201 bp, Homo sapiens
gatgggtctttgtttagaggaagctctttatcctggtacgctggaagttggcatagtcttagcagttagtccagatgtgaatttcaggattattctgtgartcttccaagtcctgtctcagcagtgaaataggctcagtgtagcttatgtctaggtggctgagttcattttctagtctaggtaaagggcacctcctgtaat

SEQ ID NO: 58327 - DNA, 201 bp, Homo sapiens
tctttcttttttttttttgaggtggagtcttcctctgtcacccaggctggagtgcagtggtgggatcttggctcactgcaacctctgtctcctggcttcaygccattctcctgcctcagccttccgagtaactaggattacaggcatccgccaccatgcttgggtaatttttgtacttttattagagacagagtttcacca

SEQ ID NO: 58328 - DNA, 201 bp, Homo sapiens
ctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaagg

SEQ ID NO: 58329 - DNA, 201 bp, Homo sapiens
cccagcctgattcctgttttacatattaaaaatttcatctctccaatcttcgaagaatccgtagtccatttttaagtagctcttgtcttccaaaggtatgsgatgtgcctacctaatgctcttcctggatgggagaatattaccaaaaacgtttggtcgactaattttatgacagtttccaactacaatttttttcctctt

SEQ ID NO: 58330 - DNA, 201 bp, Homo sapiens
gtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgatt

SEQ ID NO: 58331 - DNA, 201 bp, Homo sapiens
tgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccc

SEQ ID NO: 58332 - DNA, 201 bp, Homo sapiens
tggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaa

SEQ ID NO: 58333 - DNA, 201 bp, Homo sapiens
atattaattattaataaaatccaactccttaataatacaatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaa

SEQ ID NO: 58334 - DNA, 201 bp, Homo sapiens
actaatattctctctgactataattgtaaaacagtagatgtctttcaccaagcgctaacattatattaattattaataaaatccaactccttaataatacwatcatagttaccatttattgagagcactcttctgaacattttgcattctttatttaatcttacctacaaccttattaagtagacattatcttcatcttat

SEQ ID NO: 58335 - DNA, 201 bp, Homo sapiens
cctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctt

SEQ ID NO: 58336 - DNA, 201 bp, Homo sapiens
gtggccctgaagagggtgggaatgtctcatccccctgtgggcttagaagaaaaccagaggtctgtgcacactatggatttttactacaatgatgccctttyacatacagcgagaaggattaagaggtactgtattgttggttgataaagtcaaacttgtgaacagagcaaaagggcattgcttggtcattgcagcttccac

SEQ ID NO: 58337 - DNA, 201 bp, Homo sapiens
tacttcttggagaaacctcccaaatttctatcgacactagacatctcaggatttgaaatgttaagctaacaaattgttcatcaggtgtatctccagccctycgtaaacactgccggatggatgaacctacgtaatgatctcctggtgccattttcctgactgtagatacttgggtaaggaggagactttgactctagatga

SEQ ID NO: 58338 - DNA, 201 bp, Homo sapiens
aacttgatatggaaggtcttcacagattaaaacgaaggaaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtat

SEQ ID NO: 58339 - DNA, 201 bp, Homo sapiens
agggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacaccct

SEQ ID NO: 58340 - DNA, 201 bp, Homo sapiens
agagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgctt

SEQ ID NO: 58341 - DNA, 201 bp, Homo sapiens
atcaggccttgggagatgcaaacagtttgcccttggaccatgtcttctgctttcatccttatgctctcaacagatcatgccaaggtcctgtgttcaccgcsttcctgagtccccattcagaggctcaagaattgagacaaaagggcatcctgcaaatttgctgccctggaagctgtgctgggggagccagtagagacttca

SEQ ID NO: 58342 - DNA, 201 bp, Homo sapiens
tggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcagtccacccgcctt

SEQ ID NO: 58343 - DNA, 201 bp, Homo sapiens
attctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtc

SEQ ID NO: 58344 - DNA, 201 bp, Homo sapiens
ggttggcgtttcagtgcctgacacagttgtattcctaagacatagttgggaccagacctcaagaaaatagccaacaaatactgggtgaatgaacgaaagasgccatatgcagtcagcccccctctctctgggttctacatatgtagatttaactaatgacagattaaaagcattcgaacaaacggagggtggtatctgtac

SEQ ID NO: 58345 - DNA, 201 bp, Homo sapiens
acagggacaagaaataaataactttgatgcaaatcctgggaagactctggaacaacatggaggcacctatgttaactctatttcattttggaaaagttgastagacaaaaggtgcagagtagagtatgcagtgatttcagggtgttgggctctgacaagatgatgccgacttagacagtgttagtcaacatcaaatgtctg

SEQ ID NO: 58346 - DNA, 201 bp, Homo sapiens
ccagaggtctgttttcatcacatcgtatcaagcattccaccttcatcatgactcttcactgttgatggtgactctgattcacctggtcaaggtagtgttcrttaggtttctccactgcacacttagtctttccctctactttccacactgctgcctttggaggagtgttgctgtgcccagctcatgcttgtggagtgggga

SEQ ID NO: 58347 - DNA, 201 bp, Homo sapiens
tctcagttaatgcccacaaatttctgaactttgaacataaataccctcactgcaatacatgtttttctttctctctctttctttctttctctttttttttytttttttttttttgaaaaacttttttggagcagcacctgcatgttgtaaaaacacaaaataaaaaaaaaataaataaaagcagaccccttggttcagata

SEQ ID NO: 58348 - DNA, 201 bp, Homo sapiens
catgtacaacagcgcctgtgctgggcctgctaggagtcgatattttctggctcaaagaagttccaaaagaattcaaagccagtgtgtctctttctctggamggccaagtgatgcaggtaccacgcttaggtctgctggtgtttagcttgacttaaaacccagccagggaaatatgtttcactttgctggggtgcaggtgga

SEQ ID NO: 58349 - DNA, 201 bp, Homo sapiens
ttatttgtcttttggcttgtatcccacctgttcactttttaccatagctaacctttctaagtggtcaggtgggactcatggagattttccgttctttggaractagcagcgactgcagattactcatcagctgtctccttgagtccacaatgccgggcggtggacgggcttcctgcctcctggcccagggcccctttgccg

SEQ ID NO: 58350 - DNA, 201 bp, Homo sapiens
tattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagctt

SEQ ID NO: 58351 - DNA, 201 bp, Homo sapiens
gtggcgggcacctgtagtcccagctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaaaaagacacgtacacagacaaatgttctgacagaaat

SEQ ID NO: 58352 - DNA, 201 bp, Homo sapiens
tctagtggatattttgttaaaaaaaaaaaatggggtctcattctgttgccccggctgcagtgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagc

SEQ ID NO: 58353 - DNA, 201 bp, Homo sapiens
ctgagtttctgtggatttctataggctcctgcaaattttatctagtggatattttgttaaaaaaaaaaaatggggtctcattctgttgccccggctgcagwgcagtgacatgatcataactcatggtgacctcaaattcatgagcccaagcgatcttcccacctcagcctgagtagatgggactacaggcatgtgtcacca

SEQ ID NO: 58354 - DNA, 201 bp, Homo sapiens
aattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatca

SEQ ID NO: 58355 - DNA, 201 bp, Homo sapiens
cgagcatgctctgaactcctgaactgctcattctgttctctgagagaattgctcaagctgcagtttatcattatatgcctccaaagactttgtgtttcctrtgtttgacatcgagatagaatttttcataaccctttactagtaataaatttgattgttaagggaccgggttaatcttatttctaataccagcatctgatt

SEQ ID NO: 58356 - DNA, 201 bp, Homo sapiens
gaatgactccatggatgacctttccgtgcctttgtctgtagcctgccctcctctttaactgaacaccttccagacgagcatgctctgaactcctgaactgstcattctgttctctgagagaattgctcaagctgcagtttatcattatatgcctccaaagactttgtgtttcctgtgtttgacatcgagatagaatttttc

SEQ ID NO: 58357 - DNA, 201 bp, Homo sapiens
ttgttattgtaaaagcatcatgcaccaggtaaaatgtttaataacacagagaaatctaattgtcaagtatcttctcaacacacattaatcaacaattctcmtatcgaaggataacctcttgtatttacaaaaaaaagaagaaaaagtgctgtcatcagtaaattcattcatgtatgttatacacttacatacaaaatgtat

SEQ ID NO: 58358 - DNA, 201 bp, Homo sapiens
tcacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgcctttgtctgtagcctgccctcctctttaactgaacaccttccagacgagcatgctctg

SEQ ID NO: 58359 - DNA, 201 bp, Homo sapiens
ccgggaagtggaggttgcagtgagccgagatcttgccattgttctccagcctgggcgacaagagtgaaactccatctcaaaaaaaaaaaaaaaaaaaaaaraattatgtcatttcgttgtcacagcgtcagcagaataaatcttagatcaagatgggattactgcgccactcccttcttcccagtctgtggtttagcacgg

SEQ ID NO: 58360 - DNA, 201 bp, Homo sapiens
ggttggagaatgttcatatcacattattttggatgtctggggttgcacctggaagctcagatagcaatatctaggcacggctgccagtgctctatacattsacgtttgtttaatattttaatttccccatgagtcttaaacctctgcgtggtgtgcaagttgaggcctggtgtatgcacttcggccacgggctttcccact

SEQ ID NO: 58361 - DNA, 201 bp, Homo sapiens
aagcggggcaaggggttggagaatgttcatatcacattattttggatgtctggggttgcacctggaagctcagatagcaatatctaggcacggctgccagygctctatacattcacgtttgtttaatattttaatttccccatgagtcttaaacctctgcgtggtgtgcaagttgaggcctggtgtatgcacttcggccac

SEQ ID NO: 58362 - DNA, 201 bp, Homo sapiens
gaaggggacatgctatgtcagagtggagggacatggggaggcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgatt

SEQ ID NO: 58363 - DNA, 201 bp, Homo sapiens
ctcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaagg

SEQ ID NO: 58364 - DNA, 201 bp, Homo sapiens
gccagagtttttttttcccttgtcttataccagtggtgcctagcatggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactc

SEQ ID NO: 58365 - DNA, 201 bp, Homo sapiens
ctcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttt

SEQ ID NO: 58366 - DNA, 201 bp, Homo sapiens
ctctcaaagatagacatggacatataaataattttttaaaatcctcttttgcaaaaaaaaaaaaaaaaagaggtgaatttagttgaaaggatatagccacwcttttctgaagtgatggggatattcgatggcaattttgtgttttcttcacttggaaaaactaaaaagtttgcaacatttaaaaaaaatacaacccttatg

SEQ ID NO: 58367 - DNA, 201 bp, Homo sapiens
cttatttgtcttttggcttgtatcccacctgttcactttttaccatagctaacctttctaagtggtcaggtgggactcatggagattttccgttctttggmgactagcagcgactgcagattactcatcagctgtctccttgagtccacaatgccgggcggtggacgggcttcctgcctcctggcccagggcccctttgcc

SEQ ID NO: 58368 - DNA, 201 bp, Homo sapiens
tcttgctctgttgcccaggctggagtgcagtggcatgatggcatgatcatagttcactataatctcgaactcctggtttcaagtagtcttcctgccttggsctcccaaaatgctaggaatacaggcaggagccactgttactggtctgtttttttccttaaatacataggcaacttcctcgattgtctctcctttattggc

SEQ ID NO: 58369 - DNA, 201 bp, Homo sapiens
ttaaacagagacagatcttgctctgttgcccaggctggagtgcagtggcatgatggcatgatcatagttcactataatctcgaactcctggtttcaagtartcttcctgccttggcctcccaaaatgctaggaatacaggcaggagccactgttactggtctgtttttttccttaaatacataggcaacttcctcgattgt

SEQ ID NO: 58370 - DNA, 201 bp, Homo sapiens
tgattgccagtccattctctagccttctgaagaagatagattgtaatctttaattaagctatcactcacaccaaaaaaaaaaaaaaaaaaaaaaaaaaagyggggcaaggggttggagaatgttcatatcacattattttggatgtctggggttgcacctggaagctcagatagcaatatctaggcacggctgccagtgct

SEQ ID NO: 58371 - DNA, 201 bp, Homo sapiens
tttggcagttacctgaaagaaaatttagtgattgccagtccattctctagccttctgaagaagatagattgtaatctttaattaagctatcactcacaccmaaaaaaaaaaaaaaaaaaaaaaaaaagcggggcaaggggttggagaatgttcatatcacattattttggatgtctggggttgcacctggaagctcagata

SEQ ID NO: 58372 - DNA, 201 bp, Homo sapiens
accacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaa

SEQ ID NO: 58373 - DNA, 201 bp, Homo sapiens
gggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaaca

SEQ ID NO: 58374 - DNA, 201 bp, Homo sapiens
tgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgc

SEQ ID NO: 58375 - DNA, 201 bp, Homo sapiens
ctccaggctgtgtgacagagcaagaccccatctctaaataagtaaataaatgcctctgtgaatccatttcattgcattggaaagacctccaggattctctscagaagaatctttcccaacataaaatccattgttaatcacatttgacacacatgtgtgcccatgtctctgggcctgtgtccataggcatctacgtcactg

SEQ ID NO: 58376 - DNA, 201 bp, Homo sapiens
attttattttttttgagacagagtctctgtctccaggctggagtgcagtggcacaatctcagctcactgcaacctccacctcccgggttcaagcgattccmctgccctgatcagcttcctgagtagctgggactacaggtgcgcgctatcatgcctggctaattttttgtattttagtagagactgggttccaccatggtg

SEQ ID NO: 58377 - DNA, 201 bp, Homo sapiens
ttttttattttattttattttttttgagacagagtctctgtctccaggctggagtgcagtggcacaatctcagctcactgcaacctccacctcccgggttyaagcgattccactgccctgatcagcttcctgagtagctgggactacaggtgcgcgctatcatgcctggctaattttttgtattttagtagagactgggtt

SEQ ID NO: 58378 - DNA, 201 bp, Homo sapiens
aaatattctagtatttgccaaaactagaggatgaatgagtgatgggtaagagagttctcagaaaaatggatataaacaatattgtaaatcatatttggaarataaatactagaatcattgaatccctgagttatagaaaaatttattaatagcgctatctggctactttttaaagtgtggacatcctcgatgtattagcta

SEQ ID NO: 58379 - DNA, 201 bp, Homo sapiens
aaggctgcagtgaaccatgatggtgccactgcactccaggctgtgtgacagagcaagaccccatctctaaataagtaaataaatgcctctgtgaatccatytcattgcattggaaagacctccaggattctctgcagaagaatctttcccaacataaaatccattgttaatcacatttgacacacatgtgtgcccatgtct

SEQ ID NO: 58380 - DNA, 201 bp, Homo sapiens
gaactcgctggttctcgtcctcgccctcagcatacttgctcattgtttgtttccatctctatcatctctgtgagccctttgaggatggatgtgtgtccatsttgttaacagttggctccccagtaaccagtacagtgccagatacagagtagtaaccctacattctagcgtaggcaaatattctagtatttgccaaaacta

SEQ ID NO: 58381 - DNA, 201 bp, Homo sapiens
taacctcgatttgtgctccaggtctgagcagaaatgttattccctccagaaagccttccctggatgttgagggatgaagttgtagccccctcccgaatgcrtcctcagaactcgctggttctcgtcctcgccctcagcatacttgctcattgtttgtttccatctctatcatctctgtgagccctttgaggatggatgtgt

SEQ ID NO: 58382 - DNA, 201 bp, Homo sapiens
agactcactagaagtttcagaaagatgcagactgctttaaaaaaaaaaaaaaagggcaaggggaggtgtgagaagaaagtataattctttttcttctaackggagatataaaaatcatataagcatgatttatgatttgattggaacattgtattttatggttgcagagcacacgtatcatcctatctgcttctgacaccc

SEQ ID NO: 58383 - DNA, 201 bp, Homo sapiens
cctctcaaagatagacatggacatataaataattttttaaaatcctcttttgcaaaaaaaaaaaaaaaaagaggtgaatttagttgaaaggatatagccaytcttttctgaagtgatggggatattcgatggcaattttgtgttttcttcacttggaaaaactaaaaagtttgcaacatttaaaaaaaatacaacccttat

SEQ ID NO: 58384 - DNA, 201 bp, Homo sapiens
aatgtcagagccctaaatggtatgaaaaataggcaacttgggtcatgccactacagatcgacacccactaaatccttttaatttagtctagtgcaacaagkatttgtgtaagtgtcctctgccctggacaccggtgaggtcaccgtgggaatggctgggcaggaacaaagccttttgtttccagctgagtttccttttctg

SEQ ID NO: 58385 - DNA, 201 bp, Homo sapiens
taccaagtcatttggtttacatcgggaatgccttttgtcgttatgtctagacccctggagaacagcccacggcaatgcacttgtggaaattcggactgtgrattacactgagtaacaatcctaataatacctgcacacaatcagttgcctgtccaaaaagcaataaagaacctctagattttgtggtcaccatattaatca

SEQ ID NO: 58386 - DNA, 201 bp, Homo sapiens
cactggtgtgtggggtcataccaagtcatttggtttacatcgggaatgccttttgtcgttatgtctagacccctggagaacagcccacggcaatgcacttstggaaattcggactgtggattacactgagtaacaatcctaataatacctgcacacaatcagttgcctgtccaaaaagcaataaagaacctctagattttg

SEQ ID NO: 58387 - DNA, 201 bp, Homo sapiens
gacggtggaaagagaggactgctcctagcgtgagagtgtcagggaagcttgctgggggaaatacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttg

SEQ ID NO: 58388 - DNA, 201 bp, Homo sapiens
ggaggcctcaggaaacttacagttatggcagaaggtgaaggggaagcaggtaatgtcttcacatggctggcactggaggaagagagaaagtagggaggtgstagatgcttttaaacaaacagatctcaggagaactctttcacaagacagcactagggggatggtgattagaaagcacctcatgatcccgtctacttcctg

SEQ ID NO: 58389 - DNA, 201 bp, Homo sapiens
agggaagagcagggatagaagtgggctccgggtctaggagacggtggaaagagaggactgctcctagcgtgagagtgtcagggaagcttgctgggggaaayacaaggaaggaagagaatgcaggcagctcaaaagagccgggcaaggagacctgcagagcgagcggaggcctggtttctgtgaagcacagggcaggaaaat

SEQ ID NO: 58390 - DNA, 201 bp, Homo sapiens
ccctgaggagcgggattcgctgacccatgctggcagaacgggtgatggatgaggcagagaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgc

SEQ ID NO: 58391 - DNA, 201 bp, Homo sapiens
atttgatcctggagttgctgtaatggcaagaaaaaccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaac

SEQ ID NO: 58392 - DNA, 201 bp, Homo sapiens
aacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaaaccatggcctccagcccca

SEQ ID NO: 58393 - DNA, 201 bp, Homo sapiens
agagggagaggacagtaaccaataccgctccttctacatgatcagtgttcaggttgaagacaaacagggctccaattatgttgtgatttagaaggcgacaragctgagacctcaccctctgcttatgggctgcatgcctttctcagtgaaataacgcagaatgcagaggccatgcctgcagatcaggggtgctagaggata

SEQ ID NO: 58394 - DNA, 201 bp, Homo sapiens
aagcccacattttaaagggaatttggtatttttaacaaagcatcagggggccgggagcagtagctcacgcctgtaatgccagcactttgggaggccgaggygggcggatcacaagatcgggagatcgagaccattctggctaacatggtgaaatgctgtctctactaaaaatacaaaaagaaattagctgtgcgtggtggc

SEQ ID NO: 58395 - DNA, 201 bp, Homo sapiens
gacactggtctgcacaatgagtgtttttgtatatgaaccgaaaaacaggtagcaaaagcaaaaatagacaactgggattacaacaatctaaaaaatttctktacagaaaggaagcaatgaacagagtgaagcagcatcctacagaaagagagagaatatttgcaaaccacacatgtgataagggattaatattcaaaatgt

SEQ ID NO: 58396 - DNA, 201 bp, Homo sapiens
cttctgttaggtgtatctctgctcatgcttgagagtggtggtgtttggaaagactcaatagcatatgcacatgaggaagttgaccaaatgattccacagcrcatactcattttttgctctgattctagcttttcctccaattttattcagaatttgttcttttcttacctcacaccatatagaaaaatcaactcaaagtgg

SEQ ID NO: 58397 - DNA, 201 bp, Homo sapiens
ggcaggaagattgcttgagcctgggacgtcaaggctgcagtgaaccatgatggtgccactgcactccaggctgtgtgacagagcaagaccccatctctaartaagtaaataaatgcctctgtgaatccatttcattgcattggaaagacctccaggattctctgcagaagaatctttcccaacataaaatccattgttaat

SEQ ID NO: 58398 - DNA, 201 bp, Homo sapiens
actctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgc

SEQ ID NO: 58399 - DNA, 201 bp, Homo sapiens
aaaaaattgaggtgaaattcacataatataagattaaccatttcaaagtagacagttcaatagcagtacattcacaatggtgtgtaaataccgcatctathtatttccaaaatatttgtatctccccacaataaaagtctgtaccaattaagcagctactacccattcctcttccctaccattctaccttctgtctcagta

SEQ ID NO: 58400 - DNA, 201 bp, Homo sapiens
cttgtacttcttttaggctatttttccacctggtactatttggctttactgactgccctcattccccatacaccaccttgttttgttcagattcccctaartcttcattctcgtcccacctccccatcactcctgactacttgaaacacgacttctgtcctcagaaggcagcagtgttccctcctcccgttcatttttcat

SEQ ID NO: 58401 - DNA, 201 bp, Homo sapiens
aaatctcataatgttttaagaaagtttatgaatttgtgttgggccagattcaaagttgtcctgggccgcatgtggcccaccagccatggtttggacaagcytagtctacaggttcttcaagaggggcttgagcatttgaaagacttctagtgggagagatcacaaggtacaagtagaaaatcctgggctggcctgagaggc

SEQ ID NO: 58402 - DNA, 201 bp, Homo sapiens
tggctgcacataatatacaattgttgatgagctaaaaaaaaaaaaatccccaaaaaatctcataatgttttaagaaagtttatgaatttgtgttgggccasattcaaagttgtcctgggccgcatgtggcccaccagccatggtttggacaagcttagtctacaggttcttcaagaggggcttgagcatttgaaagacttc

SEQ ID NO: 58403 - DNA, 201 bp, Homo sapiens
ctgaattatggagttttagttttgctttagaatttttggatgattagacttgtacttcttttaggctatttttccacctggtactatttggctttactgamtgccctcattccccatacaccaccttgttttgttcagattcccctaagtcttcattctcgtcccacctccccatcactcctgactacttgaaacacgact

SEQ ID NO: 58404 - DNA, 201 bp, Homo sapiens
ccaaacttttggcttccctgggccacattggaagaaaaagaattgtctttggctgcacataatatacaattgttgatgagctaaaaaaaaaaaaatccccraaaaatctcataatgttttaagaaagtttatgaatttgtgttgggccagattcaaagttgtcctgggccgcatgtggcccaccagccatggtttggacaa

SEQ ID NO: 58405 - DNA, 201 bp, Homo sapiens
ataaacacatttatagttctcagagattccttgagagaggaacatctttaaatggataaccacagtcttctaaacacctgaaagggtgtcttttgctgaaytatggagttttagttttgctttagaatttttggatgattagacttgtacttcttttaggctatttttccacctggtactatttggctttactgactgccc

SEQ ID NO: 58406 - DNA, 201 bp, Homo sapiens
gtgtccaaacttttggcttccctgggccacattggaagaaaaagaattgtctttggctgcacataatatacaattgttgatgagctaaaaaaaaaaaaatycccaaaaaatctcataatgttttaagaaagtttatgaatttgtgttgggccagattcaaagttgtcctgggccgcatgtggcccaccagccatggtttgg

SEQ ID NO: 58407 - DNA, 201 bp, Homo sapiens
attatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattca

SEQ ID NO: 58408 - DNA, 201 bp, Homo sapiens
gagagagaaaaaaataattcctagatctagagttggtgtgaggctaaaataagctgcttttagtatcacatttggcaagtagtaaactctggataaatatrcttttgaattgtgtgattattgttgttaccatttattgaaagggaatgatgaatgtagtgagagaaggaaggaagagagagagggaagaaggggaaaaag

SEQ ID NO: 58409 - DNA, 201 bp, Homo sapiens
agagttgacggagaggggacaggaggtgactagatttggaaggaaaattagaaaacttttggccgggcatggtggctcatgcctgtaatcccagcactttygggtcagttgagtctaacataggggtgtccaaacttttggcttccctgggccacattggaagaaaaagaattgtctttggctgcacataatatacaattg

SEQ ID NO: 58410 - DNA, 201 bp, Homo sapiens
catgattcaattacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacag

SEQ ID NO: 58411 - DNA, 201 bp, Homo sapiens
caggcaagaaagaacttgtgtagggaaactctcccttatgataccgtcagattccttgagacttatttgctattgtgagaacaccttgggaaagacctgcytccatgattcaattacctcccacctggtccctcctgcaacatgtgggaattcaagaagagatttgggtgggtacacagccaaaccatatcaaaaaccatt

SEQ ID NO: 58412 - DNA, 201 bp, Homo sapiens
ggcgacacagtgatggcagaaggtgaaaggcacatctcacatggcagcaggcaagaaagaacttgtgtagggaaactctcccttatgataccgtcagattycttgagacttatttgctattgtgagaacaccttgggaaagacctgcctccatgattcaattacctcccacctggtccctcctgcaacatgtgggaattca

SEQ ID NO: 58413 - DNA, 201 bp, Homo sapiens
gctggggaggcgacacagtgatggcagaaggtgaaaggcacatctcacatggcagcaggcaagaaagaacttgtgtagggaaactctcccttatgataccrtcagattccttgagacttatttgctattgtgagaacaccttgggaaagacctgcctccatgattcaattacctcccacctggtccctcctgcaacatgtg

SEQ ID NO: 58414 - DNA, 201 bp, Homo sapiens
gtggcagagggagaggacagtaaccaataccgctccttctacatgatcagtgttcaggttgaagacaaacagggctccaattatgttgtgatttagaaggygacagagctgagacctcaccctctgcttatgggctgcatgcctttctcagtgaaataacgcagaatgcagaggccatgcctgcagatcaggggtgctaga

SEQ ID NO: 58415 - DNA, 201 bp, Homo sapiens
agagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggcgacagagctgagacctcaccctctgctta

SEQ ID NO: 58416 - DNA, 201 bp, Homo sapiens
ttgaggttctttccaagtaaaggcgttattctttgtggtgtgctcctggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtgg

SEQ ID NO: 58417 - DNA, 201 bp, Homo sapiens
aaacagccagctattctgatcatttgaaatctggaacattctttcctacggtggttgacttttcactgcctttgaggttctttccaagtaaaggcgttatyctttgtggtgtgctcctggaggtcactaacaaaacgtctccagcaggtgttgtgtggattcccccaaatccgtaggctcttatttcctagacatgaagag

SEQ ID NO: 58418 - DNA, 201 bp, Homo sapiens
ggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatg

SEQ ID NO: 58419 - DNA, 201 bp, Homo sapiens
ctatatgatcatatgattttcctttagctttttgatatggtggactatattgattttaaatattgaaccagccttgaagacctggaataaatcccacttgstcatggcatatatgtttttttatacattgttggatacagtttgctaacattttgtggatagctcaccaacttttattcagaaaacatccgtctcagttta

SEQ ID NO: 58420 - DNA, 201 bp, Homo sapiens
gacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacaca

SEQ ID NO: 58421 - DNA, 201 bp, Homo sapiens
agaattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgt

SEQ ID NO: 58422 - DNA, 201 bp, Homo sapiens
taagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagatt

SEQ ID NO: 58423 - DNA, 201 bp, Homo sapiens
agatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagc

SEQ ID NO: 58424 - DNA, 201 bp, Homo sapiens
acatatcagtcattttttgaggaaaataaatttaaggcttggttatcggtccttgagtcagcacattgagcgttttgtcaattagctcctccccccatctktatggtatggcttttcctgtaattacagtcaagatcctatagccggaggaaggcctgtcaattgagtaagaggctgatgttcatcgcacagtgacagccc

SEQ ID NO: 58425 - DNA, 201 bp, Homo sapiens
ggacaacatatcagtcattttttgaggaaaataaatttaaggcttggttatcggtccttgagtcagcacattgagcgttttgtcaattagctcctcccccmatctgtatggtatggcttttcctgtaattacagtcaagatcctatagccggaggaaggcctgtcaattgagtaagaggctgatgttcatcgcacagtgac

SEQ ID NO: 58426 - DNA, 201 bp, Homo sapiens
aggtaccttggaaagactgcatctcctggattttgcatggttctggcttaatggacaacatatcagtcattttttgaggaaaataaatttaaggcttggtyatcggtccttgagtcagcacattgagcgttttgtcaattagctcctccccccatctgtatggtatggcttttcctgtaattacagtcaagatcctatagc

SEQ ID NO: 58427 - DNA, 201 bp, Homo sapiens
ctaaattatgccagattaagaaaatgaaatctgactgtaaattacttctctaggagcaaatgattgcttgattctattgtagaaaataaaaattttttacytaaaccacacaaattaaaaaatggaactcactttcacagtcaagagttacttctatttttttttacagtaaatgcgctctttaagatgttgcaagctcaa

SEQ ID NO: 58428 - DNA, 201 bp, Homo sapiens
ctagggtgttgataagaaacagcaggcatagttactgggtgattgagaagagtttaacaaaagactatattagtctgttttcatgctactgataaaggcayacccaatactaggtcatttacaaaagaaaaaggtttattggacttacagttccttgtggctggggaggcgacacagtgatggcagaaggtgaaaggcaca

SEQ ID NO: 58429 - DNA, 201 bp, Homo sapiens
tagctagggtgttgataagaaacagcaggcatagttactgggtgattgagaagagtttaacaaaagactatattagtctgttttcatgctactgataaagrcatacccaatactaggtcatttacaaaagaaaaaggtttattggacttacagttccttgtggctggggaggcgacacagtgatggcagaaggtgaaaggc

SEQ ID NO: 58430 - DNA, 201 bp, Homo sapiens
ggattgatactagctagggtgttgataagaaacagcaggcatagttactgggtgattgagaagagtttaacaaaagactatattagtctgttttcatgctwctgataaaggcatacccaatactaggtcatttacaaaagaaaaaggtttattggacttacagttccttgtggctggggaggcgacacagtgatggcagaa

SEQ ID NO: 58431 - DNA, 201 bp, Homo sapiens
ctttctgttataaaatcatgtttttattgaattacattttaatattggtatcactttaaaatgaaaatgagtacttgcaaaatgtatttttgaaggagttkggtggtggtggggggatgccattttggcaacagatgacttcggttcaagtcctctctctgtctcttacttgctttgtggctttagaccagccacccactc

SEQ ID NO: 58432 - DNA, 201 bp, Homo sapiens
ttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaaatgtatttttgaaggagt

SEQ ID NO: 58433 - DNA, 201 bp, Homo sapiens
ctacaataactttttcagtctctttctccctttcccaccttcccaaaagggtgggaaatttttaaagtaaagtaataaacaaataagttttgggttgggcrggagattagttagagacaggatctgtaggtcagaagtggtatttgggggagtagggagttttttttttttttctttttcccttatgcatttgggagtgga

SEQ ID NO: 58434 - DNA, 201 bp, Homo sapiens
gcacaactgaactccagcctgggcgacagaggaagactctgtctcaaaataaacaaacaaataaataaataaaaattgtttaaacctgccaactacaatawctttttcagtctctttctccctttcccaccttcccaaaagggtgggaaatttttaaagtaaagtaataaacaaataagttttgggttgggcgggagatta

SEQ ID NO: 58435 - DNA, 201 bp, Homo sapiens
tttttgatttggtttggttctttggagttgtttgcatttcgtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcgaggaagggt

SEQ ID NO: 58436 - DNA, 201 bp, Homo sapiens
tactaagaaacttttgaaaatgataatgggtgtgtactttttatcaactgctttttgtatgccaatctatatgatcatatgattttcctttagctttttgrtatggtggactatattgattttaaatattgaaccagccttgaagacctggaataaatcccacttggtcatggcatatatgtttttttatacattgttgga

SEQ ID NO: 58437 - DNA, 201 bp, Homo sapiens
gattcttctcaattcctaaattactaagaaacttttgaaaatgataatgggtgtgtactttttatcaactgctttttgtatgccaatctatatgatcatawgattttcctttagctttttgatatggtggactatattgattttaaatattgaaccagccttgaagacctggaataaatcccacttggtcatggcatatat

SEQ ID NO: 58438 - DNA, 201 bp, Homo sapiens
tttatttttgtttgtatttgttagtttttttgagatttcttgggattttctatctagcctgtcatgtcatatgcaaatagagaattttatttcttcctttrtaatatgtgtgccctttttttattgccttattgtagtggctagaacttcctgtgctatgttgaacaagagtagtgagaacatccttgccttgctcctgat

SEQ ID NO: 58439 - DNA, 201 bp, Homo sapiens
gttttttatttttgtttgtatttgttagtttttttgagatttcttgggattttctatctagcctgtcatgtcatatgcaaatagagaattttatttcttcytttataatatgtgtgccctttttttattgccttattgtagtggctagaacttcctgtgctatgttgaacaagagtagtgagaacatccttgccttgctcc

SEQ ID NO: 58440 - DNA, 201 bp, Homo sapiens
gcctatcatataggaatgatagaggcagcacagtgctgtaatggaaaccataagggcacgcacaatggctcatgcctgtaatcccagcactttgggaggcmgaggcgggaggatcacataagaccaggagtttgagaccagcctggccaacatggtgaaaccccatctctactaaaactacaaaaatagccaggtgtcctg

SEQ ID NO: 58441 - DNA, 201 bp, Homo sapiens
cataagaccaggagtttgagaccagcctggccaacatggtgaaaccccatctctactaaaactacaaaaatagccaggtgtcctggtgcatgtctgtaatyccagctacctgggaggctgaagcatcagaatcgcttcagcttgggagctggagcttgcagccagccaagatcacaccactgctctctatcctgggagaca

SEQ ID NO: 58442 - DNA, 201 bp, Homo sapiens
ttctttggagcgattgtaaatggcattgtgtttttaattccaacttctacatatatctagaaatatgattgagttttgtgtgttgatcttgatcctatgascttgctgattgcatttattataaagttccaggagttttttatttttgtttgtatttgttagtttttttgagatttcttgggattttctatctagcctgtc

SEQ ID NO: 58443 - DNA, 201 bp, Homo sapiens
tgggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtct

SEQ ID NO: 58444 - DNA, 201 bp, Homo sapiens
gcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgtc

SEQ ID NO: 58445 - DNA, 201 bp, Homo sapiens
tgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatag

SEQ ID NO: 58446 - DNA, 201 bp, Homo sapiens
tacaaaaactgttaccgcctaacacattaaatgtatttaaattatttgttctattaaaatgtcagtgtatttcttgaattttaactgtgcctgaagatcartcattgtaacagctgcagggaaggctttatgacttacctgaacggtggtgtattctgtggctcggctaagtggattcttcgactttaatagattttacta

SEQ ID NO: 58447 - DNA, 201 bp, Homo sapiens
caaggtgttgatagaaccccttagtgtcctcctcataccacagacactctcttcccccacttacttggccaattttttttttttttttttttttttttggkggagtctcgttctgtctcccaggctggagtgcaatggtgcgatctcagctccctgcaacctctgcctcccatattcaagggattctcctgcctcagcctc

SEQ ID NO: 58448 - DNA, 201 bp, Homo sapiens
gaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatc

SEQ ID NO: 58449 - DNA, 201 bp, Homo sapiens
tggatggtttaataaataagattgatacaaacacaaagcattaagcaaacaaaaggaaataaaaacggcaacaaataaaacttctgtgctttttgaaattytgtttttggcaggcaacattccaaagatctttttcatttaaagtccaggagtcttctgtgtgaaccccacacaggtaccttggaaagactgcatctcctg

SEQ ID NO: 58450 - DNA, 201 bp, Homo sapiens
attattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttg

SEQ ID NO: 58451 - DNA, 201 bp, Homo sapiens
tgatgtaggaatgaacagatgaacaaccccacacaacctaaggacaactttgaatcaattcttctaagctggtagcagaagccacctttccatttgacttstatctcgctctttttttctttcttttttttttttttggagacagagtctcactctgttgcctagactagagtgcagtggtatgatctcagctcactgcca

SEQ ID NO: 58452 - DNA, 201 bp, Homo sapiens
gtgtgactaatattagaagcagacacagccatgatgagcaatactctttttttgtttatttttgttgttactgctgtaagccactttcttctccctctccrttaaaatgcaacttaattggtaaagtttagttgactagagatttcatttatttatttatttatttatttatttatttatttgtttgtttgtttgtttgag

SEQ ID NO: 58453 - DNA, 201 bp, Homo sapiens
cttgataaaggttggggtttgtaagcttggggctcctcagccatgactgaaacgtactatgagcacggcatctaccgggctgttccacatcctccctgtgkgactaggggccagggcaatgggaatcagtgcagaaataaagctcatgctgtttgctctgccatgagtaacgaagtcctctgtatctgatcctgggtctcc

SEQ ID NO: 58454 - DNA, 201 bp, Homo sapiens
acagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgctttt

SEQ ID NO: 58455 - DNA, 201 bp, Homo sapiens
cctgcaattctttgtacatatgaaatttaatatggtgagattggcatctagctgctgctagagatagtgctcataataatttttaacattgattgagtgtrgataataatccaggagctgtgctaaacgttttacaacacattatctcacttaatttcacaactccataaagtagttttcacttagttgagggatgaaaaa

SEQ ID NO: 58456 - DNA, 201 bp, Homo sapiens
ctgcctcctgtccctatcattgatacctgcaattctttgtacatatgaaatttaatatggtgagattggcatctagctgctgctagagatagtgctcatartaatttttaacattgattgagtgtggataataatccaggagctgtgctaaacgttttacaacacattatctcacttaatttcacaactccataaagtagt

SEQ ID NO: 58457 - DNA, 201 bp, Homo sapiens
ctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaatgaggtctcatgagcaaattttaaggatggcaaa

SEQ ID NO: 58458 - DNA, 201 bp, Homo sapiens
aagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaatgctagtgacctcatatactcatggtaacggcttccggcatccaatgaccttgc

SEQ ID NO: 58459 - DNA, 201 bp, Homo sapiens
tgaagcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactc

SEQ ID NO: 58460 - DNA, 201 bp, Homo sapiens
cttaatctcccttttccatgggcccaacacctgaatctagggcaaacaggtgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacctgtgacca

SEQ ID NO: 58461 - DNA, 201 bp, Homo sapiens
tataattttgatgaaagaagtttcccaacagtatttcggtgtgcatgctcacacaccagccctggtcgtcagtgaacagattcttccaggtcttcattgtrgcggaagaaagtgagatcagagatcccgaggaagggcttcagtttcaccagtagtggagctagggagtaggggggcagaagccgcaggaagtcagtgcag

SEQ ID NO: 58462 - DNA, 201 bp, Homo sapiens
tgcttctgacacccagtaagcagctctggcttttataattttgatgaaagaagtttcccaacagtatttcggtgtgcatgctcacacaccagccctggtcrtcagtgaacagattcttccaggtcttcattgtggcggaagaaagtgagatcagagatcccgaggaagggcttcagtttcaccagtagtggagctagggag

SEQ ID NO: 58463 - DNA, 201 bp, Homo sapiens
gattggaacattgtattttatggttgcagagcacacgtatcatcctatctgcttctgacacccagtaagcagctctggcttttataattttgatgaaagargtttcccaacagtatttcggtgtgcatgctcacacaccagccctggtcgtcagtgaacagattcttccaggtcttcattgtggcggaagaaagtgagatc

SEQ ID NO: 58464 - DNA, 201 bp, Homo sapiens
ccaacctttttgctggctctctttcaaactgtactgctcactttgggctgtacgttagaaccacctgagaagttctttttctttcttttttttttttgagrtggagtcttcctctgtcacccaggctggagtgcagtggtgggatcttggctcactgcaacctctgtctcctggcttcatgccattctcctgcctcagcct

SEQ ID NO: 58465 - DNA, 201 bp, Homo sapiens
ggctgcagcagtgtctaggtatctgtgaatgtgtaagaaattgagacagcctgcaaaatagctcacccagcttttctttaaagttccaacctttttgctgsctctctttcaaactgtactgctcactttgggctgtacgttagaaccacctgagaagttctttttctttcttttttttttttgaggtggagtcttcctctg

SEQ ID NO: 58466 - DNA, 201 bp, Homo sapiens
tttgggaagttcccaaatctgtcagtatatattacaaaaactgttaccgcctaacacattaaatgtatttaaattatttgttctattaaaatgtcagtgtmtttcttgaattttaactgtgcctgaagatcaatcattgtaacagctgcagggaaggctttatgacttacctgaacggtggtgtattctgtggctcggcta

SEQ ID NO: 58467 - DNA, 201 bp, Homo sapiens
tgtgggcccttctctttcctcgtgatgcacggtgatagtgcgtatctaacacttgaaggtgtccacgctggccctagctcagtgagatggctttgctttgsgggggtgagggggcggaggtggtggaaaggcagcaagctacgatgttcttatgtgtgtggccttgcttctggtggtggggtggcacacatgctctgtagt

SEQ ID NO: 58468 - DNA, 201 bp, Homo sapiens
catctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgtttttgttttgtttctttttgagatagggtc

SEQ ID NO: 58469 - DNA, 201 bp, Homo sapiens
aacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccgtctagcacggagggccagaaggaagcagtgt

SEQ ID NO: 58470 - DNA, 201 bp, Homo sapiens
cctttgtttttgttgtcatcgttttatgattaacttatatctggtcctttagacatttagattttttctgttttatctctctctctctatatgtatatctrtatatatatttatctatatctatatagatatatatatatatatataaaataatgaatgaaatggactgtttgcaacctcagatgtatttctaggacttag

SEQ ID NO: 58471 - DNA, 201 bp, Homo sapiens
cgtggtcacttgcttgcacacacttgtttagatgtctctgccctgctgttaattagactgtgagcctccagagggtgagactgacatctcatttctctttkcagtcacagcagagatgcaggcccacagtagggactcaccagatgtggcagggtgagggaattgtccatagatgccttaaagatatgctatccacaggag

SEQ ID NO: 58472 - DNA, 201 bp, Homo sapiens
ttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaac

SEQ ID NO: 58473 - DNA, 201 bp, Homo sapiens
ccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactca

SEQ ID NO: 58474 - DNA, 201 bp, Homo sapiens
ggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggt

SEQ ID NO: 58475 - DNA, 201 bp, Homo sapiens
ggccctgatgtcacttcttaggctaatttctgtgaaattgtgattgggaggaaaaagtgaacaggaacttaaagccagcagaggaaagctacctgcccttsactggtggtcagtgcatggattccagagacagggtgggcaccagttcctcaccgggtcctttctagttgcatgacctggggcaggtgactttatgtggct

SEQ ID NO: 58476 - DNA, 201 bp, Homo sapiens
ggtcttctgaagtataggaaaaggcagcttacagaaaaaaacttgcttgtttactgtcttctgagctgatttctcacctactggcaagtggataggtctastttttgtttagctgtttttctaatttaatcttgtacatgagacagctatagatggatgtatagtctttgaagtggggccagttggctccgtctattagct

SEQ ID NO: 58477 - DNA, 201 bp, Homo sapiens
tagtgttggcaaaaggcttgcaatttattattaagtggaataagcagtttaaaaacagtatgtacagggtggttttctggctatataaacacacaggcatwgaaaatagatatacataaataatgttactataatttgtctgcctcccttctctcagaaaagaccaatgaattatctattatgtgccactcactatttgag

SEQ ID NO: 58478 - DNA, 201 bp, Homo sapiens
tttttctccttggcaggttttcactattaatttgcttgacaaaggatagatacattttccatgtgtggaggtaaaagcagtgcagtgagctaaaaagttarcaaaggtgaagtggtcctaatctgcggccctggtacacttagataggcatcattgcctttcctctgagctcttggtgctgataacagcttccttgaccga

SEQ ID NO: 58479 - DNA, 201 bp, Homo sapiens
gctaagttacagcaggtgaacttgaatttgaggaaagacaaagcaaaccctggctattaaaggaacacacacacacacatacacacacacacacacacacmcgtttctggtattaggaaatggagatttctaacataataaaaaagattgaacttaaaaatgacttccattaaatagggtaagaattttgaggtggaatcc

SEQ ID NO: 58480 - DNA, 201 bp, Homo sapiens
gcaccactgctcgcattcccatgttggagttttccctttggggttcttatgccattttaaagactctgaaaacaggaagactttttctcttgggtattttwttttttttttcctctgcaagggatggggtcataagacattggtgaggttaggccttcctttgtctcccaggagcacacttgatagcaatgtagggtgaat

SEQ ID NO: 58481 - DNA, 201 bp, Homo sapiens
agaaagtataattctttttcttctaactggagatataaaaatcatataagcatgatttatgatttgattggaacattgtattttatggttgcagagcacaygtatcatcctatctgcttctgacacccagtaagcagctctggcttttataattttgatgaaagaagtttcccaacagtatttcggtgtgcatgctcacac

SEQ ID NO: 58482 - DNA, 201 bp, Homo sapiens
ccccccccagcttccccacctgtaaaatgatttgctcaaagtttgcaaagaatggaggcatattcaaagtgctcagcactgggccggacccatgggtatgmattcataatgatcagcttcattctctccctttccctctctctccacacctttccattcctcctaactaatgtgggagagaagagaaaattacagtgagag

SEQ ID NO: 58483 - DNA, 201 bp, Homo sapiens
gctttaaaaaaaaaaaaaaagggcaaggggaggtgtgagaagaaagtataattctttttcttctaactggagatataaaaatcatataagcatgatttatsatttgattggaacattgtattttatggttgcagagcacacgtatcatcctatctgcttctgacacccagtaagcagctctggcttttataattttgatga

SEQ ID NO: 58484 - DNA, 201 bp, Homo sapiens
atcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacata

SEQ ID NO: 58485 - DNA, 201 bp, Homo sapiens
gattaaatacaatgatgtaacctacttgaaagtgtcatataaattctgaggtgaagtggaggcattatggatgcattttattttgttttattttatttcayttattctttttttgaagaggtatgggtcaagcagatctgcagcccacactcggctcactgatcacgtcccatacaatcttggcagatacttagctgaatt

SEQ ID NO: 58486 - DNA, 201 bp, Homo sapiens
agctgcaggatcacttgctttagatggaatcacccagcggatggcgtttaactctgctttaaaccccttcatggcttcccaccacacttacaaatacaactccttatcctgtcagcaggggcttgcttaatctgaccctttccacatatgctggatcacttcacgcctccctgttctttcaattccttgaacacaccaagt

SEQ ID NO: 58487 - DNA, 201 bp, Homo sapiens
gcagctgcaggatcacttgctttagatggaatcacccagcggatggcgtttaactctgctttaaaccccttcatggcttcccaccacacttacaaatacatctccttatcctgtcagcaggggcttgcttaatctgaccctttccacatatgctggatcacttcacgcctccctgttctttcaattccttgaacacaccaa

SEQ ID NO: 58488 - DNA, 201 bp, Homo sapiens
tacgtttttctattttgtctgaactagccaaggtctctggagtttgctgttatattgcttcagagaaattagtgacattgaaaggctgttgtcttttttaktgtacttttggttgttaggagaaatttacaaggccatttttttctcccgtctctgcagttcaggagattatattagaaaatattctatacaaaaaatatg

SEQ ID NO: 58489 - DNA, 201 bp, Homo sapiens
acaaagcatcagggggccgggagcagtagctcacgcctgtaatgccagcactttgggaggccgaggcgggcggatcacaagatcgggagatcgagaccatyctggctaacatggtgaaatgctgtctctactaaaaatacaaaaagaaattagctgtgcgtggtggcgggcgcctgtagtcccagctactcgggaggctga

SEQ ID NO: 58490 - DNA, 201 bp, Homo sapiens
tccatgacactggtctgcacaatgagtgtttttgtatatgaaccgaaaaacaggtagcaaaagcaaaaatagacaactgggattacaacaatctaaaaaayttctgtacagaaaggaagcaatgaacagagtgaagcagcatcctacagaaagagagagaatatttgcaaaccacacatgtgataagggattaatattcaa

SEQ ID NO: 58491 - DNA, 201 bp, Homo sapiens
acagtgtaaaattagtagaagaaaacaaggaggaaagctccatgacactggtctgcacaatgagtgtttttgtatatgaaccgaaaaacaggtagcaaaarcaaaaatagacaactgggattacaacaatctaaaaaatttctgtacagaaaggaagcaatgaacagagtgaagcagcatcctacagaaagagagagaata

SEQ ID NO: 58492 - DNA, 201 bp, Homo sapiens
tgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtag

SEQ ID NO: 58493 - DNA, 201 bp, Homo sapiens
aagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtgga

SEQ ID NO: 58494 - DNA, 201 bp, Homo sapiens
tttatgattaacttatatctggtcctttagacatttagattttttctgttttatctctctctctctatatgtatatctgtatatatatttatctatatctrtatagatatatatatatatatataaaataatgaatgaaatggactgtttgcaacctcagatgtatttctaggacttagagtgattagcttgaggcgatgg

SEQ ID NO: 58495 - DNA, 201 bp, Homo sapiens
aagaaaaataaaacgtggtgaacgcccatgattgcaactaggagactgttatgcttatggttgttaagattagaaagaaggaagctttaaccctatctctratttcttacttttctctgtctatgtagaagttgatgttgatacgtgtctacataaatatttactaagggcttgcattagtcttgggaccaaggatatagt

SEQ ID NO: 58496 - DNA, 201 bp, Homo sapiens
agaaggaagctttaaccctatctctgatttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaat

SEQ ID NO: 58497 - DNA, 201 bp, Homo sapiens
gtcttaacttttcaaaaacaggacatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtctt

SEQ ID NO: 58498 - DNA, 201 bp, Homo sapiens
gttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccctagcctgggaagaaaaatcggt

SEQ ID NO: 58499 - DNA, 201 bp, Homo sapiens
ctgcgggtgtgtgagccaagggggccctgtgacccttgaaatagaaaagggggaaatggctgcatgccaaccgaagagaccactgcattgttggccataartgaaactagtgagatgtgtgggatatcataaaaagaacattgacataatccttttttggatgaagttatatcacaaccagaacacacaatgaccagcagg

SEQ ID NO: 58500 - DNA, 201 bp, Homo sapiens
aacaaagagagatcctgtctccaagtctgtctgtctgtctgtctgtctgtctgtctctctcggaaatattccttcagtgtattagtaaagaagttacttakgagtcacttatgcccttgaagagtgagtgatgtatcaaaatatgtctgtctttattgtttcactttcatccttctttttttggagatggagtcttgctct

SEQ ID NO: 58501 - DNA, 201 bp, Homo sapiens
gttttctattctgggcctccctgcttccagcgatagcaaggagcgaaatgagatgctgtctaagaaaggaaggtgctgcgatctttgattactacacagcytcggcagtgtttgtatgattaatgagtccatgtttcagacgttcccatttaatgtatttgagccttctaacaacattgcctttcatatgttgctgactgt

SEQ ID NO: 58502 - DNA, 201 bp, Homo sapiens
atcccctttgcaaaagtaagaattgtatcgtagcctgactcagggttttagccaacttctctggatgctaatgctattctcttctttatacttgtcttccytcccaggcacacatccactggagctttgcagggcctatctgcccttagccctccaatatccttttcattttctttaatagttttattgatatataatgtg

SEQ ID NO: 58503 - DNA, 201 bp, Homo sapiens
taagagacctcttctcaacaggatccatgtttgatccgggggaataaagctagagttgctttcttccttgtaatatgtataatgactcatgagagaattcyccactgtcttccccacctgagacctgagaggaggagaaggaagcttggagtcgctgccctgtggcctgaattggtcagtgaccaatcactcagacccagc

SEQ ID NO: 58504 - DNA, 201 bp, Homo sapiens
cttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggt

SEQ ID NO: 58505 - DNA, 201 bp, Homo sapiens
gctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaac

SEQ ID NO: 58506 - DNA, 201 bp, Homo sapiens
cactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgt

SEQ ID NO: 58507 - DNA, 201 bp, Homo sapiens
taccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactatta

SEQ ID NO: 58508 - DNA, 201 bp, Homo sapiens
cactgcagtcttgacctcccaggctcaagcaatcctctggcctcagcctcccaagtagctgggactattggcaatgccaccatgttcggctaatgtttttrattttttatagagacaaggtttccctatgttgcccaggctggtctggaactcctgtgctcaagccatcctcccacctcagtctcacaaagtgctgggatt

SEQ ID NO: 58509 - DNA, 201 bp, Homo sapiens
gcagtgagccaagatggtgccactgcactccagcctgggtgacaaaaaaaaaactttacctgggcttagtaagttgcctgacttctcatcctggagttcgkatccccttgtttctagaagagaaatccctcagatgtgaaggtgtgttccatgattttgtcgaacttgccctacatactgttttattatatattctgccca

SEQ ID NO: 58510 - DNA, 201 bp, Homo sapiens
gccctactgcactccagcctgagcgtgagactctgactcaaaaaaaaaaaaaaaaaaattagctgggcgtagtggcaggtgcctgtaatcacagctatccrgaggctgaggcaccagaactgcctgaacctgggaggcggaggttgcagtgagccaagatggtgccactgcactccagcctgggtgacaaaaaaaaaactt

SEQ ID NO: 58511 - DNA, 201 bp, Homo sapiens
atttccatgttctccgcacagtgcggagctactgcgggtgtgtgagccaagggggccctgtgacccttgaaatagaaaagggggaaatggctgcatgccarccgaagagaccactgcattgttggccataagtgaaactagtgagatgtgtgggatatcataaaaagaacattgacataatccttttttggatgaagttat

SEQ ID NO: 58512 - DNA, 201 bp, Homo sapiens
agatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccaaccgaagagaccactgcattgttggccataagtgaa

SEQ ID NO: 58513 - DNA, 201 bp, Homo sapiens
gccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagt

SEQ ID NO: 58514 - DNA, 201 bp, Homo sapiens
tccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgc

SEQ ID NO: 58515 - DNA, 201 bp, Homo sapiens
aaacatgctgtattatagtggcaaagattagaatcagatacatcttatgaccttgggcaagtttcttaacttctttaaacctcagtttcttcatctgtaamatgcacatcataatatctctattcagagatacaggtggttctattaaacacatcaactctgtgtatataaagtcttaacccattgtggaataaattaagt

SEQ ID NO: 58516 - DNA, 201 bp, Homo sapiens
aatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacgtaaaa

SEQ ID NO: 58517 - DNA, 201 bp, Homo sapiens
cccttgagcaggaataagtgagtggcagagggggtcagggatgttaacgcaaatggagatcccttcacccagaaagacacatctgaaatggagaagatgcytttttcctcctgcaaccaataagagagtgatgaaaattatgacgccttgggaaataagactgcaacgtaaatgtgtgtccaccccctagttttcttttgg

SEQ ID NO: 58518 - DNA, 201 bp, Homo sapiens
cagtgagccgagatcaggccactgcactccaatctgggtgacagagcaagactctgtctcaaaaataatagtaataataataataataataataataatartaataataataagaatctgactaaggttattaaccattaaggtatgctgtgctaaggagcagggggccccttccatccgtagagggcagaaaggtgccta

SEQ ID NO: 58519 - DNA, 201 bp, Homo sapiens
ctcctgtatctcagtaggcactgttcaagcatttgaacttcatcaagtatcaagacaagtctaagagaaggtggggagagaccatcagggcctaggattgsaaaacctccaacgcaaaatagagatgtagttttagcgtgctgcccaatattaaaagattgtataaatgaggggggcacacttcctgatatgttcgttatg

SEQ ID NO: 58520 - DNA, 201 bp, Homo sapiens
taaaatgttgcctcctgtatctcagtaggcactgttcaagcatttgaacttcatcaagtatcaagacaagtctaagagaaggtggggagagaccatcaggrcctaggattggaaaacctccaacgcaaaatagagatgtagttttagcgtgctgcccaatattaaaagattgtataaatgaggggggcacacttcctgata

SEQ ID NO: 58521 - DNA, 201 bp, Homo sapiens
aagggatggggaattagtcatagggtatttccagataatgtagttaacacctcgtgtaatattaggtgggcagggagctctgctctcaggaccaaaattgytcctgccagctctaatagggaatgtgtgtatttttaaagtctgggtaagcactgtgagtcatttccacaatacgcctccctttggcgtgaaatggggcag

SEQ ID NO: 58522 - DNA, 201 bp, Homo sapiens
tagcgtctaggggatatacacttctaagcccattcttcaatggagaattacttatgcgcataagtagtttaaacaaaattagtggaaaaacagggagtttmagggagcaagagatcaggtcttctgggctcaccacacatcaggtgatttaagctaaaaatggcttaaaataccgcaatcacttgaaacgccttacataaa

SEQ ID NO: 58523 - DNA, 201 bp, Homo sapiens
ttactttgcaggattgctgtaaggattagaaccaccgtctctaaggcattcagcatagtcccttagggtaacatgagtgctcaagaaatagtaaattttartatgtgtctcatttttttccagatgctctggggtcactaccaaccttgcctttcaccctacctgtggatctatgaccctgtccttctcagaacaccactc

SEQ ID NO: 58524 - DNA, 201 bp, Homo sapiens
tttcacctacaaaatgaaggctacaatatttactttgcaggattgctgtaaggattagaaccaccgtctctaaggcattcagcatagtcccttagggtaamatgagtgctcaagaaatagtaaattttagtatgtgtctcatttttttccagatgctctggggtcactaccaaccttgcctttcaccctacctgtggatct

SEQ ID NO: 58525 - DNA, 201 bp, Homo sapiens
gacttgtatctcttaatgagtttaactacatttaaccatgtatgtgtcagtcctactatgcaccttacagctcactaaccctgtttaataatgtatgttgytacatttaatctttatggtagcctcatgaacaggctcttatttagttcagtggttcttgatcaggagtgatattgcctgccagggaatgcatgtcaatgt

SEQ ID NO: 58526 - DNA, 201 bp, Homo sapiens
tgccattgcactccagcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttgtatctcgctctttttttctttcttttttttttttttggagacaga

SEQ ID NO: 58527 - DNA, 201 bp, Homo sapiens
cacacctgtaatccctgctacacaggaagctgaggcaggagaatcgcttgaacccaggaggtgaggttgtggtgagccgagatcatgccattgcactccarcctgggcaaaaagagcggggtaaaaaaacaacaaaaaaatgatgtaggaatgaacagatgaacaaccccacacaacctaaggacaactttgaatcaattc

SEQ ID NO: 58528 - DNA, 201 bp, Homo sapiens
aggaacaagagagagagaaagtgcatggcaaagacccatcattgatgagtgactggatgtgaggaatggagcaggggagatgctgatgatttggttacccscttctccatcccccaccacccactgatgttattatccagtaaggaccaggagagaagaagagatttaagaagaagacaatggctgtggtttgatgaagat

SEQ ID NO: 58529 - DNA, 201 bp, Homo sapiens
gctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatgga

SEQ ID NO: 58530 - DNA, 201 bp, Homo sapiens
ccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaac

SEQ ID NO: 58531 - DNA, 201 bp, Homo sapiens
ttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagaga

SEQ ID NO: 58532 - DNA, 201 bp, Homo sapiens
tctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattg

SEQ ID NO: 58533 - DNA, 201 bp, Homo sapiens
aaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatactta

SEQ ID NO: 58534 - DNA, 201 bp, Homo sapiens
gtgaacagattcttccaggtcttcattgtggcggaagaaagtgagatcagagatcccgaggaagggcttcagtttcaccagtagtggagctagggagtagsggggcagaagccgcaggaagtcagtgcaggacgccggaggccactcctaattgcttcatgtgttgttgccgtgctgatgaccttggaggcgctgctggtc

SEQ ID NO: 58535 - DNA, 201 bp, Homo sapiens
ctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgc

SEQ ID NO: 58536 - DNA, 201 bp, Homo sapiens
gcatcttacctataaaaataatgcagatacattcgtaactccccaggttttcgggagtggaaatgagggcagctggggagtgaatctgtcgtttgttgagrctctttttcctgcttgccagacactgatctaggctcattcatacaccagttcattcatcctcataacagttctgtgcctgagtagattcttgtccttatg

SEQ ID NO: 58537 - DNA, 201 bp, Homo sapiens
gaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgc

SEQ ID NO: 58538 - DNA, 201 bp, Homo sapiens
tcaggcccataaaatactgcacatcttggcatcttacctataaaaataatgcagatacattcgtaactccccaggttttcgggagtggaaatgagggcagytggggagtgaatctgtcgtttgttgaggctctttttcctgcttgccagacactgatctaggctcattcatacaccagttcattcatcctcataacagttc

SEQ ID NO: 58539 - DNA, 201 bp, Homo sapiens
aagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgaggg

SEQ ID NO: 58540 - DNA, 201 bp, Homo sapiens
ggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaag

SEQ ID NO: 58541 - DNA, 201 bp, Homo sapiens
tgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacga

SEQ ID NO: 58542 - DNA, 201 bp, Homo sapiens
agtcttctctttggtccctgataaatatacatagaatgtatggatgtgagaaagttaaactgatgtctgtgtgtcttcatgtcattaaactttgaatctayggacatgtctttttctttctggcatagtttggaggtcttcattttgtgattgaatacaaaacaccgagggctttaaggaggcatagtggtatgttcagct

SEQ ID NO: 58543 - DNA, 201 bp, Homo sapiens
tagaaggccttaatctcattgtacatacttttctattcctcccagtaccatttaaaggttagtgaaagcaacctttagtatcatctgttttttgggggggkttttttgttgttgttgtttagctgtttatgggtaggagaatgcgtgctcttttagggacatctcttcaaataagaacaggttgtaacctacactcaaaag

SEQ ID NO: 58544 - DNA, 201 bp, Homo sapiens
tgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagt

SEQ ID NO: 58545 - DNA, 201 bp, Homo sapiens
ttcataatcagcagaagtcttttctctggaaggaacaaaggattaagttagggagacagtaatggtattgttagcaggctatttcaatgattttctctgcrgaagagtagggaaaggtgacattccaactgggaatattcgactctgcagatccctactcggagtttttcagccctgttttaagtgccgagctgggttttg

SEQ ID NO: 58546 - DNA, 201 bp, Homo sapiens
aaatcacagagtccatttatttctcctcttcgagtcagtatatctcaaaacattttttcaacgttaatagaaatataagaagtgcctggatcagtttttgkttttgttttgtttctttttgagatagggtctcattccgttccctaggcgggactgcagtggcaccattatggtttactgcagccttgacctcccaggccc

SEQ ID NO: 58547 - DNA, 201 bp, Homo sapiens
cagaggggcagtccaataaaagaggcagaaagggctcttgaaaaatgtccctgggcacttgcccgaatgactttagtgacagtatctactaaaactgataytaattctgttacgtgttatggcgcatacccaagaccctccccataaactatttgaaagaagcaaagttgtaattctccaaatacggacttgtacatttct

SEQ ID NO: 58548 - DNA, 201 bp, Homo sapiens
ttgtttttctttcttttttttttttttttttgaggcaggccttaggtctggcacccaggctggagtgcagtgacgtgatcaaggctcactgcagcttccamctcctgggctcaagcaatcttcgtgtttcagcctcctgagtagctggaattacgggctcatgccaccacacttggctacttgtttaattttttgcagaca

SEQ ID NO: 58549 - DNA, 201 bp, Homo sapiens
tactgctattgttagtttctaaaggcacttgtcatggtgtgactaatattagaagcagacacagccatgatgagcaatactctttttttgtttatttttgwtgttactgctgtaagccactttcttctccctctccgttaaaatgcaacttaattggtaaagtttagttgactagagatttcatttatttatttatttatt

SEQ ID NO: 58550 - DNA, 201 bp, Homo sapiens
aaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgtt

SEQ ID NO: 58551 - DNA, 201 bp, Homo sapiens
gggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctac

SEQ ID NO: 58552 - DNA, 201 bp, Homo sapiens
cctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggctttttcggttgtgaagatcagtaccttgaaattcagaatagatggca

SEQ ID NO: 58553 - DNA, 201 bp, Homo sapiens
aaactgtgtgattctgtctgcagttgagaactgtaagaaaaagatcaagattaacattattattattggtgttacctcatgtctgtacctttttggacacktgggtctgtttcccgagaaatcatttttcctcctccttgaaaatagtgaatttcaagtggttttaattttaactgcattatttgtttgctttatatagtt

SEQ ID NO: 58554 - DNA, 201 bp, Homo sapiens
aaccacacagcccagtggccgtggcctgggcagggaaaccgcaactgcctgcaggaagagtgcagtttatttagataacattttcacttaacatcctgccrttaatgacctccacctggcaacctttatttaatccaaaactcagggactggattttccatacggcctgtgaggccagggggctcagttgttcctcataga

SEQ ID NO: 58555 - DNA, 201 bp, Homo sapiens
cggaggttacagtgaaccgagatcgtgtcactgcactccagcctaggcgacagagcgagaccctgtctcagaaacagaaaataaaacaaacaaaaaaatastattccatagctgactattttctgaaatgattttgttacttttctaatgagaaaaaaatagatctcgtgtgtggagggaattgaagatgtaatttcagac

SEQ ID NO: 58556 - DNA, 201 bp, Homo sapiens
acaacataaccacacagcccagtggccgtggcctgggcagggaaaccgcaactgcctgcaggaagagtgcagtttatttagataacattttcacttaacaycctgccgttaatgacctccacctggcaacctttatttaatccaaaactcagggactggattttccatacggcctgtgaggccagggggctcagttgttcc

SEQ ID NO: 58557 - DNA, 201 bp, Homo sapiens
cagttttcagaccaactccattgttactagatatcctgacactgaagaagctaaaaccaaacaacaatgacaacaacaaacccaagtctgccttatggcasattcttcacgtcgtaacaccttccttgggaccctatttctcagtatggacctgactctcccagggatcctagaatgcaagcatagtgattgcaaaccaga

SEQ ID NO: 58558 - DNA, 201 bp, Homo sapiens
ggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcgct

SEQ ID NO: 58559 - DNA, 201 bp, Homo sapiens
gatcacttgagctcaggaattcgagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctggg

SEQ ID NO: 58560 - DNA, 201 bp, Homo sapiens
ttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttc

SEQ ID NO: 58561 - DNA, 201 bp, Homo sapiens
tgcccatggcaaccacaattaacccatgcctgccttccagtctttttaccacgtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccaca

SEQ ID NO: 58562 - DNA, 201 bp, Homo sapiens
agcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgt

SEQ ID NO: 58563 - DNA, 201 bp, Homo sapiens
accacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaa

SEQ ID NO: 58564 - DNA, 201 bp, Homo sapiens
ttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttct

SEQ ID NO: 58565 - DNA, 201 bp, Homo sapiens
tttttgttcccccatgggatagtaggtaaattaatggaggaagggagtcaactaaacaatttatttgagcaattaatggaggaagggagtcaactaaacartttattagggctttatgtaaagccctagggttagttggttggttggttttgttttgttttgttcctttttttttttgccaggggatgctgtggttgaatt

SEQ ID NO: 58566 - DNA, 201 bp, Homo sapiens
agcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagtttgggagccaaaattgagcagaaagtacagagagttcccgtatacctccggcagagccctggct

SEQ ID NO: 58567 - DNA, 201 bp, Homo sapiens
cgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttg

SEQ ID NO: 58568 - DNA, 201 bp, Homo sapiens
tataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctc

SEQ ID NO: 58569 - DNA, 201 bp, Homo sapiens
cactttattggtgatatggtttggctgtgtccccacccaaatctcatcttgaattgtagctcccataattcccatatgttgtgggagggaccgggtgggasaatattgaatcatgggggtggttcccccatactgttcttggggtagtgaatgaatctcatgagatctgatggttttataagggggaaacacctttcactt

SEQ ID NO: 58570 - DNA, 201 bp, Homo sapiens
catgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccctcagataaaccacagcaatgattttatactgtctgtagggtaa

SEQ ID NO: 58571 - DNA, 201 bp, Homo sapiens
actccacatctttgtaactttttatggctctcagccctactttcttaatagtagcagcagtatttatctactgtttattgtattccaggtaaaggatatgygaagcacttttcatgcattatttaacctagctataatactcccatttgacagatgagaggactgaggcttgtagactttccaaggctgtgcagctctagg

SEQ ID NO: 58572 - DNA, 201 bp, Homo sapiens
tgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactc

SEQ ID NO: 58573 - DNA, 201 bp, Homo sapiens
cattgaactgaatctccaccttgggcttgagactctgcaaagtgcattaaatgggaaggaaaccaaagggcctgctgccctgcccccgccatagcccaagkctgtggccatggctggggaattggcctgtcagttcaatcaggcagcccctctgactggtgtttttcactaagctggccccatggatggccctggtcatgt

SEQ ID NO: 58574 - DNA, 201 bp, Homo sapiens
cacgcaggcattaaatggattgtgaagagggactttgttccccctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaag

SEQ ID NO: 58575 - DNA, 201 bp, Homo sapiens
agccatactcagagtggccctaggatggctcctcagatagctgctggcagaaacctgcactcagtacatctatacatggtgtaatgattgactcaagatamttagcatagccatcatctcaaacctttattatttgtgatgagaagattcaaaacccgctttttgaactgttctgaaatatgcaataccttgttgttaact

SEQ ID NO: 58576 - DNA, 201 bp, Homo sapiens
ccatcatttacttacgtaataaatctgttaaataattttaatataaatctattcatctatccatctattaaaagagatttaagttatttctaatctttgcrtattataagttgcatttcagcttataccttgactttctttgacatatacatcaataggtagagtatattcctagaaattcaattgtggaccaatgagatg

SEQ ID NO: 58577 - DNA, 201 bp, Homo sapiens
aattttatggattacatttattttcatttctgtatatttagttaattcttttaaaaggctgcctgttatcccattgtctgtcttcaccatcatttacttaygtaataaatctgttaaataattttaatataaatctattcatctatccatctattaaaagagatttaagttatttctaatctttgcatattataagttgca

SEQ ID NO: 58578 - DNA, 201 bp, Homo sapiens
ctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccttttcagtattcatgacgtcaagtccctgtttgttatcttattgtcc

SEQ ID NO: 58579 - DNA, 201 bp, Homo sapiens
tcctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcac

SEQ ID NO: 58580 - DNA, 201 bp, Homo sapiens
tccgctcatattcttgcatttgctgcagcaaaacctgacctctctttgtgttacctgagtcttgacgaagaagactgaggaaaggcccccccccccccccrccaaattgtcccgttgtctcttggctggtcttgccagctggcacacagcttcctctgaccaccctgctaggtacaaatcccacatgaaaagtctcaatca

SEQ ID NO: 58581 - DNA, 201 bp, Homo sapiens
atccgctcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatc

SEQ ID NO: 58582 - DNA, 201 bp, Homo sapiens
ttgaccgataagtgtaccagatttccttacctgtcccagggcaagatagcaagagtttcttgatgcatttaaaaaatgcatttagtgttggcaaaaggctkgcaatttattattaagtggaataagcagtttaaaaacagtatgtacagggtggttttctggctatataaacacacaggcatagaaaatagatatacataa

SEQ ID NO: 58583 - DNA, 201 bp, Homo sapiens
tgcaattccctctcagtttacatcaaaatcagctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctct

SEQ ID NO: 58584 - DNA, 201 bp, Homo sapiens
atgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgt

SEQ ID NO: 58585 - DNA, 201 bp, Homo sapiens
agctgccgttgagtgtgtgcatgtacaactgcttgaaaacagcttgtgagttcactattaggtccatgaaatttttctccttggcaggttttcactattartttgcttgacaaaggatagatacattttccatgtgtggaggtaaaagcagtgcagtgagctaaaaagttagcaaaggtgaagtggtcctaatctgcggcc

SEQ ID NO: 58586 - DNA, 201 bp, Homo sapiens
cattgacccacttatgtgtagtcccctagtgaaatgacaagaatccccagagctgggaaaacatttccatgcaattccctctcagtttacatcaaaatcakctcgtcacccttgagattgaagctcgcactctgtaagctctgaataaatattaaccatctcctgaaccctgaaggagacattttctggggagcagtgatt

SEQ ID NO: 58587 - DNA, 201 bp, Homo sapiens
cagattttaatatctttcctcccacacttgctttgactccctcctttagtaattagataattatgtataataagcacattaattatgtgcaacagctgccrttgagtgtgtgcatgtacaactgcttgaaaacagcttgtgagttcactattaggtccatgaaatttttctccttggcaggttttcactattaatttgctt

SEQ ID NO: 58588 - DNA, 201 bp, Homo sapiens
ttatttaggaggggaatttggggacattgacccacttatgtgtagtcccctagtgaaatgacaagaatccccagagctgggaaaacatttccatgcaattmcctctcagtttacatcaaaatcagctcgtcacccttgagattgaagctcgcactctgtaagctctgaataaatattaaccatctcctgaaccctgaagga

SEQ ID NO: 58589 - DNA, 201 bp, Homo sapiens
cagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctag

SEQ ID NO: 58590 - DNA, 201 bp, Homo sapiens
cttgatgtcggagtgttctctagacctcacacccagtccctattcttaggttttatttctcaaaccaggttttgcctgagaaattacagcaaatgattcakagcacaatgatgttgctcatttttgataagtagttgaaagctgatggtgccctccatttcaaagcaacagaagaaacgctggtggtcatggagaaagagt

SEQ ID NO: 58591 - DNA, 201 bp, Homo sapiens
tctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttcct

SEQ ID NO: 58592 - DNA, 201 bp, Homo sapiens
aatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgc

SEQ ID NO: 58593 - DNA, 201 bp, Homo sapiens
catccttcatcaaggtgacataggtctggcgatctttttggcatagacgtgtggacgttgtttttgacatttgtacatgcttttgctcaagttgaaggccsaagtttacccaattcgactgcccccacccagatagaatattcatggttagaccataaactacataactggaaattttaaatctatttttatatgcataca

SEQ ID NO: 58594 - DNA, 201 bp, Homo sapiens
atggttttaaaataccaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctggg

SEQ ID NO: 58595 - DNA, 201 bp, Homo sapiens
attttcatttttattaagaagtaaggcaaaaacaaaataagacatatgtcagaacttcacttatccttctttgctgaattgtataatggttttaaaatacyaaaaaatatttcttcaatttttttctgctactcataatgtagcatctgtagagcgacacacttttgaatttgagttaatatttcctttttattttatttt

SEQ ID NO: 58596 - DNA, 201 bp, Homo sapiens
agaccttgatatatgtacatatattgtatgatacatatccatgcatatacgtgggtgtacacacacaggtacacacaaatatatatgtgcctttggacaaraaaaaatccccaggacagtctcatttggcttttaaaatgctgcagttgaataggaccgtagaggtggcctaaggcagccttccattcagggcacgcagat

SEQ ID NO: 58597 - DNA, 201 bp, Homo sapiens
gacatgaatattggttgatattttcatttttattaagaagtaaggcaaaaacaaaataagacatatgtcagaacttcacttatccttctttgctgaattgkataatggttttaaaataccaaaaaatatttcttcaatttttttctgctactcataatgtagcatctgtagagcgacacacttttgaatttgagttaatat

SEQ ID NO: 58598 - DNA, 201 bp, Homo sapiens
caacctaaataaagccacagccagtgttacagaaatagtgtttcgtgattaaaataatggtacttatttgggagagttacttgccacgtttcagatgattkggaggtagtcttttcaggaatattctgagtttgtttcttgatctcgatagcagcaacctttccatttgctctctgtctggtttctctgtgtctctctttt

SEQ ID NO: 58599 - DNA, 201 bp, Homo sapiens
gtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattata

SEQ ID NO: 58600 - DNA, 201 bp, Homo sapiens
gttcattcagttatctcacgtttctggagggccctctatgtgcaatacctagtgatacagcagtgaacaaaggaaatccctgccctcagggagctttcatkctacttggggaaagagacgtgaaagaaatcaagacatgcaagcaaggataagtgctgtaaagataattcattcctgtttagagggctgaggacaggaaga

SEQ ID NO: 58601 - DNA, 201 bp, Homo sapiens
cattttcatggcgatgtgttataacaggacagaccttgtactttggaatcaaacattctcaactctgctatctgctctttgtggggccctgaacaaaaatmtttactctctttgagccttcgcttcctcattggtcaagacttttctcactgcattatatttgagtgagacccgtatcaatggattgaaattctcagaaac

SEQ ID NO: 58602 - DNA, 201 bp, Homo sapiens
ggagaggtgcgatttccctccacataatcttcagttagtgatctctgtaagagaatgtttttcaaaaggctaatagagaagtaatgagatcagaaggaggycaacccggccttctccgtttggcagcttgattaatttatttctccttcttggagattgctgcaaggggcttttgtcaccctgtgtttttcatgggactgt

SEQ ID NO: 58603 - DNA, 201 bp, Homo sapiens
cctaaagatatcccgccccaccaaagatatccctaaagacatcctgctggtttcagtggctcatgcctgcaatcccagcactttgggaggctgaggcaggyggatcacttgagctcaggaattcgagaccagcctggccaacatggtgaaaccttatccgtaaaaaaaataaaaaattagccagacatcgtggtgcatgcc

SEQ ID NO: 58604 - DNA, 201 bp, Homo sapiens
gagcaagcatttctaacaatcatattgcttaagaagtggatggcaagaagataattactaatatgtctgcaattgatctgaaattgacacagttgatctawctgattcatggggaccctgggagtatgtttgtgtatttgggggttgggatgggggggtgggtggagggtcagagaggtggcaaaagcaggtgggaacagg

SEQ ID NO: 58605 - DNA, 201 bp, Homo sapiens
  misc_feature (1)...(201): n = A,T,C or G, or insertion/deletion polymorphism (see Tables 1-2)
gtagtccagtatattggcctccagggcaaagctacctaggttctgagtccaattatggccttcatgagtcttgtttctttggacaggttttccagtgtctntgagcctcaacttcctcatgtataaagtggagatgatgccattacaggttgctgctttatggcacataattaatactagctcttatttataggaactgaa

SEQ ID NO: 58606 - DNA, 201 bp, Homo sapiens
atgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggtgtccagcgaatgcct

SEQ ID NO: 58607 - DNA, 201 bp, Homo sapiens
ctgtaaacaaaaacaacacagccatctagctgcaagacgtagctaattgctctgcagaacagggttggccagcctggccttgatgtcggagtgttctctaracctcacacccagtccctattcttaggttttatttctcaaaccaggttttgcctgagaaattacagcaaatgattcagagcacaatgatgttgctcattt

SEQ ID NO: 58608 - DNA, 201 bp, Homo sapiens
tcttacccattagggattattaatatactagataagagtacagtctctggagctaggcttgtgactttgaacaaattattttatctctctgagctcagtcycctcatctacaaagggggaattgataataggaattgtcgcaaagagctgttttaaagattaaatgagataatagatataaagcacttagaagagagtttg

SEQ ID NO: 58609 - DNA, 201 bp, Homo sapiens
cttttgtgaccctgatgagattacaggtcctcagtctcctcattgtatctgaagactaaagaatcagaaatttgtgactccacttagtttttctccacccmggagccctcaggccgctggtgagtgaagttcttacccattagggattattaatatactagataagagtacagtctctggagctaggcttgtgactttgaa

SEQ ID NO: 58610 - DNA, 201 bp, Homo sapiens
tatatgtgtatacatacatagaagtatatatataaataccagtactagtgtctgctaataggtggcgccactttttatctgtgtgtgttgggggtggaatkagcatgtagaggttggcaaaggggacaggagactgtgggatgattagtatattcttatttggcctgggagggaaaaaaaatctttcatttccaacaatat

SEQ ID NO: 58611 - DNA, 201 bp, Homo sapiens
ataaattaattttttagcattaatattagggaagataatctgacatttaaaaatacatgtctatatgtgtatacatacatagaagtatatatataaatacmagtactagtgtctgctaataggtggcgccactttttatctgtgtgtgttgggggtggaattagcatgtagaggttggcaaaggggacaggagactgtggg

SEQ ID NO: 58612 - DNA, 201 bp, Homo sapiens
aatctaggagaaaggtagagctctcttatgctggggcaacgctaccaacattggtattccacagcattccaacgattctaaatactctcccagagtagggmggaaaaatcatccaaactacttggtaattgaattcaagagtgatggaccaaaaattattaatgcattcccttccgtccaccagccaaagaggattccatc

SEQ ID NO: 58613 - DNA, 201 bp, Homo sapiens
ctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggaggaaaaatcatccaaactacttggtaattgaattc

SEQ ID NO: 58614 - DNA, 201 bp, Homo sapiens
catgcaatgttcacaggtctttacatgtaaaaacaaccctgtaaaataaataacattattctcttcattctccaagtaagctgaggcagaggattccagcrcaagcaatttggttccaaaacctgcccttttaacctctaccagattttggtgaactctctgtctttggaagggtaggtggcggctgcggggagaaataga

SEQ ID NO: 58615 - DNA, 201 bp, Homo sapiens
gtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagaggattccagcacaag

SEQ ID NO: 58616 - DNA, 201 bp, Homo sapiens
gaatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatga

SEQ ID NO: 58617 - DNA, 201 bp, Homo sapiens
aactcctagcctcaagtgatccgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatga

SEQ ID NO: 58618 - DNA, 201 bp, Homo sapiens
ttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcac

SEQ ID NO: 58619 - DNA, 201 bp, Homo sapiens
tttttttttgagacaaggtctcattctgttgcccagactggagtgcggtggtgcgatctcagctcactgccacctctgcctcccaggcccaagcgatcctsctgcctcagcctcatgagcagctgggaccacaggatgcaccaccatggccagataattgttttgcatctttggtagagacaaggcttcactatgttgccc

SEQ ID NO: 58620 - DNA, 201 bp, Homo sapiens
cccagacacttacatattcctagccattccttttgcttaagtttgcagagatttgtgcttaaaactgaataaacaatctcagggtttttgtgtgtgtgtggatgtgtgtgtgcgtgttatatgaagtcttgctagaatgcataaacaaacaaaaaaaatatcatactctcagatcctggatactgtggtcgcctggacttc

SEQ ID NO: 58621 - DNA, 201 bp, Homo sapiens
taggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagc

SEQ ID NO: 58622 - DNA, 201 bp, Homo sapiens
tagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggttt

SEQ ID NO: 58623 - DNA, 201 bp, Homo sapiens
cttacatttaaatacaggcctttcccatttcacagtgtttctagctcccctttccaatacatctctctctctctttctctctctctctctctctctctcamacacacaacacacacacacacacacagccaaatcagacaccaacataaactgtagagttaacattctttttccaccctcacactttttttagctccgatc

SEQ ID NO: 58624 - DNA, 201 bp, Homo sapiens
gcacatatgtgtgtgtgcaaattgtacttgcagtggctgcctgggaaatgaaatttctgcaccttgccagagcatgttttccctctaaagagaggcagctsataattagtaatgctaatgtcggggtgagatgcaatagataatctaacaccagcaatgatgcccagagcatttatctttgatgctgggaatgcgttcatt

SEQ ID NO: 58625 - DNA, 201 bp, Homo sapiens
ccgattctcttccacgtgtggacagattggcacatatgtgtgtgtgcaaattgtacttgcagtggctgcctgggaaatgaaatttctgcaccttgccagarcatgttttccctctaaagagaggcagctgataattagtaatgctaatgtcggggtgagatgcaatagataatctaacaccagcaatgatgcccagagcat

SEQ ID NO: 58626 - DNA, 201 bp, Homo sapiens
ctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcct

SEQ ID NO: 58627 - DNA, 201 bp, Homo sapiens
gtccagtatattggcctccagggcaaagctacctaggttctgagtccaattatggccttcatgagtcttgtttctttggacaggttttccagtgtctctgcgcctcaacttcctcatgtataaagtggagatgatgccattacaggttgctgctttatggcacataattaatactagctcttatttataggaactgaacaa

SEQ ID NO: 58628 - DNA, 201 bp, Homo sapiens
ctttctaatgcagaaggtgtagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagt

SEQ ID NO: 58629 - DNA, 201 bp, Homo sapiens
atctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggct

SEQ ID NO: 58630 - DNA, 201 bp, Homo sapiens
ccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaac

SEQ ID NO: 58631 - DNA, 201 bp, Homo sapiens
catggtgaaagaagacagacagtgtaatttccctggaaactcaattttgattcagacgtccacagcatctcatttctgcctttaaaaaatttcaagagtgrcattttggcatgattggactcacaggtggagaaggtatgacaaacattctggaaatcttggaaggtgaaatatagggaagatggcccctatggaggttca

SEQ ID NO: 58632 - DNA, 201 bp, Homo sapiens
tgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtg

SEQ ID NO: 58633 - DNA, 201 bp, Homo sapiens
agatagatgaagggttaggaagatgtaacttgtcctaaatcacgtgtcttctaagcggtggaactgattttctcactgactatagatgttgagcccattamtgtgatacctactgccttttaattttaaaagttctcattgttttatcgttttcatcattatcatatgatttacctcttctcttgtgtcttataatccgat

SEQ ID NO: 58634 - DNA, 201 bp, Homo sapiens
gtcttttttttttttttttttttcctccttttttgagagagagagtctcactctgtcacccagactggattgcagtggcacaatctcaactgactgcaacstgcacctctcaggttcaagcaattatcaggcctcaacgtcctgagaagctgggactacaggcatgtaccaccacactcagctaatatttgtatttttagt

SEQ ID NO: 58635 - DNA, 201 bp, Homo sapiens
atccagtcagagtgaatcagcttgcccagtgcttggcatatagctgctcaagaaatattaggcattctttgttattataaatcccctttgtattttaaaaycctcatgtatcactgaaacaaccaactgaaaaccattgagaggctcatggtgaaagaagacagacagtgtaatttccctggaaactcaattttgattcag

SEQ ID NO: 58636 - DNA, 201 bp, Homo sapiens
taatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggat

SEQ ID NO: 58637 - DNA, 201 bp, Homo sapiens
tgtttaaatgctcaaacttggtatggaactgcacagactatacggctgctctccactcaagaatacaaattgaacattgactttcctcattttttatccarttttgctttccagagacccagatatggcttcattttttaaatgaaattttgcaggtcattagctcataatgattaaatgattctggttattagcataaaa

SEQ ID NO: 58638 - DNA, 201 bp, Homo sapiens
tgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtca

SEQ ID NO: 58639 - DNA, 201 bp, Homo sapiens
cccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccagttttgctttccagagacccagatatggcttcattttttaaatgaaattt

SEQ ID NO: 58640 - DNA, 201 bp, Homo sapiens
ggaaaagctcattttccagtttttccccctccagctgtaggggatatattttcgttaattcctgtgaccatatggcagcatggttaggatcttgggcttcyaaatcagacagttgtaaacttaaactccaattctgccacttattgtgtcactttggacaagttacttcacctctccaagcctcagtttccctgactataa

SEQ ID NO: 58641 - DNA, 201 bp, Homo sapiens
gtgagccacggttggccagctcccaaacaccatgacatacaacttgcaggaaaagctcattttccagtttttccccctccagctgtaggggatatattttygttaattcctgtgaccatatggcagcatggttaggatcttgggcttctaaatcagacagttgtaaacttaaactccaattctgccacttattgtgtcact

SEQ ID NO: 58642 - DNA, 201 bp, Homo sapiens
tagtatttgccaaaactagaggatgaatgagtgatgggtaagagagttctcagaaaaatggatataaacaatattgtaaatcatatttggaaaataaataytagaatcattgaatccctgagttatagaaaaatttattaatagcgctatctggctactttttaaagtgtggacatcctcgatgtattagctatgcatctg

SEQ ID NO: 58643 - DNA, 201 bp, Homo sapiens
tttcttaccaggagtacatagtttgttctttaagcaaaaccatatgcatcgtattttaaatggaacagggaggttgttccatgcgtcaacttagtccaaawgtagagggtcaggaaaacaatgatatgagaaaagggccggttactgtctgggaatccataaatactgcttggcaaatggcacattgcatgcttattcctt

SEQ ID NO: 58644 - DNA, 201 bp, Homo sapiens
cccttatcagagatcaattggccataaatgtaagtatttctttctggactctgaattatatcccattgatctgtatgcctgtccttatgccattgccacaytgttttggttactgtactctgtgtaagttttgaaatttggaattgtgaattctccaactttgttcttcattttcaagattgttttgggtattctgggtcc

SEQ ID NO: 58645 - DNA, 201 bp, Homo sapiens
ctttgaaagttgtccttctgcacccattttccccagacctaacctcgatttgtgctccaggtctgagcagaaatgttattccctccagaaagccttccctkgatgttgagggatgaagttgtagccccctcccgaatgcgtcctcagaactcgctggttctcgtcctcgccctcagcatacttgctcattgtttgtttcca

SEQ ID NO: 58646 - DNA, 201 bp, Homo sapiens
tctattaaatggtctttgcacccttatcagagatcaattggccataaatgtaagtatttctttctggactctgaattatatcccattgatctgtatgcctrtccttatgccattgccacactgttttggttactgtactctgtgtaagttttgaaatttggaattgtgaattctccaactttgttcttcattttcaagatt

SEQ ID NO: 58647 - DNA, 201 bp, Homo sapiens
gcatgtggcccaccagccatggtttggacaagcttagtctacaggttcttcaagaggggcttgagcatttgaaagacttctagtgggagagatcacaaggkacaagtagaaaatcctgggctggcctgagaggcagacctgtgattattttgctctttgaaagttgtccttctgcacccattttccccagacctaacctcg

SEQ ID NO: 58648 - DNA, 201 bp, Homo sapiens
tctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattca

SEQ ID NO: 58649 - DNA, 201 bp, Homo sapiens
actttaggcattgatgcgcttaattatgcttttcaacaagattttgcatttttaatatttccttttagagcttccaggaatctcaattattaattgtaccstggatttattggtctttggactctcccgctagtataaagactgtagattcatcaaacattgtttactgtcttcaaacttcaacagtgttttaactatcaa

SEQ ID NO: 58650 - DNA, 201 bp, Homo sapiens
gggaaaatggaggagaatgatgacgaaggaggaggaggaggaaaaggtgacttgcctctagctgatgtggattatttctcttttttaatttccatgtctgygtagcttcatcatagatctcagcttaaggacaatgaaagtcgtttattgagtacttagtatgtgctggttgcagagccaagtcttttttttttttttttt

SEQ ID NO: 58651 - DNA, 201 bp, Homo sapiens
acagacagtgtaatttccctggaaactcaattttgattcagacgtccacagcatctcatttctgcctttaaaaaatttcaagagtggcattttggcatgaytggactcacaggtggagaaggtatgacaaacattctggaaatcttggaaggtgaaatatagggaagatggcccctatggaggttcattgtcccccacctt

SEQ ID NO: 58652 - DNA, 201 bp, Homo sapiens
cgtcctcgccctcagcatacttgctcattgtttgtttccatctctatcatctctgtgagccctttgaggatggatgtgtgtccatcttgttaacagttggmtccccagtaaccagtacagtgccagatacagagtagtaaccctacattctagcgtaggcaaatattctagtatttgccaaaactagaggatgaatgagtg

SEQ ID NO: 58653 - DNA, 201 bp, Homo sapiens
ttttaagatacagaaagtgggccttaaaggtgctactgacttgctgatatgctttggctgtgtccccacccaaatcttaacttgaatcgtatctcccagarttcccacgtgttgtgggagggacccagggagaggtaattgaatcatgggggctggtgtttcccatgttattcttatgaaagtgaataagtttcataagat

SEQ ID NO: 58654 - DNA, 201 bp, Homo sapiens
gtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctga

SEQ ID NO: 58655 - DNA, 201 bp, Homo sapiens
cataaccacatctactttgtgtctctatagatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttt

SEQ ID NO: 58656 - DNA, 201 bp, Homo sapiens
accatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgcttttagcatgctttcaaggttcatccatg

SEQ ID NO: 58657 - DNA, 201 bp, Homo sapiens
tactttctaaaattctcgggcctttgcaccttctttttatcaacgcttagttctatgttactgaatatttcttaattaagtgcaggaaagaaaataaccaytttttctccttttaaagaagcacacacacctttcttttattggtattacattccttttccctgttggtgcccctgttggttttccaaattgtcttcccat

SEQ ID NO: 58658 - DNA, 201 bp, Homo sapiens
aaacatctgtgcaccagtaaagggttctgatgtgtgataaatttatttagctattactcatctgaagttatactattttaggatcttggggcagtgaggaytttggaaatggaacaggatgctcctttaagttagggtaaaatgaagtctataaaaactgtttttctatatcctcctcctaccccacaaagaaagttaggg

SEQ ID NO: 58659 - DNA, 201 bp, Homo sapiens
gaggaccttgtgttcctgctggagagtgagagtccctccctccccattccactcccaagagcagtgaagagtcaggaaggtgggcttgttttgttttgttwtgttttgttttgcttgttgagcaagggaatgcggttcccctgtgtcggacttgtttcagaaagacaatgtcactgaggctggggcagggagattagctga

SEQ ID NO: 58660 - DNA, 201 bp, Homo sapiens
taaatgaagcaccgccaggcccagttggggaggaccttgtgttcctgctggagagtgagagtccctccctccccattccactcccaagagcagtgaagagycaggaaggtgggcttgttttgttttgttttgttttgttttgcttgttgagcaagggaatgcggttcccctgtgtcggacttgtttcagaaagacaatgtc

SEQ ID NO: 58661 - DNA, 201 bp, Homo sapiens
aacccaactcctagccactgctttttgagcagctactcagtgcctaagactttgaatagtttattaatcatgtgtcactgcagcaaaggggacatttcggycctgatttcagagatgaaagaaccaaggcatagaaattgagtcactttctggagtgtacacaactagtaagtggattcgagttagttttgctctattcca

SEQ ID NO: 58662 - DNA, 201 bp, Homo sapiens
tttttcaattccagagatgttttcacctggaagattccccagatttggcaaaaacaacccaactcctagccactgctttttgagcagctactcagtgcctwagactttgaatagtttattaatcatgtgtcactgcagcaaaggggacatttcggccctgatttcagagatgaaagaaccaaggcatagaaattgagtcac

SEQ ID NO: 58663 - DNA, 201 bp, Homo sapiens
ctttttacagtcatgtgctttcagcccagtaccctttgctatgccaagatccagctgaaactgaaccaggtgggggaggcctgctaatgcccaggcagtcraaatgacgccatctcatcactccttctcttaaaatttttttttgtctttcttcttggatttccagcaacagggagctgccaccaccgtgtactgtgctgc

SEQ ID NO: 58664 - DNA, 201 bp, Homo sapiens
gatcaccattggtagatcatcacttagaatgccatcactaccttctaacagcaatcagtccccttaagtggctttcttctcttttttttcttttatctttktgttttttttttttttttgagggagtcttgctctgtctgccagatggagcacaatggcgcgatctcagctcactacaacctccgcctcccgggatcaagc

SEQ ID NO: 58665 - DNA, 201 bp, Homo sapiens
agaatgaggtatgtggtactcgtgagcaggattttcaatgcctggctggttgttacttatccatttagtccgagcttcagggaaagaacatgacaccggcstccagcagagcctgctcttggtccactgtttatcctggtgaccttaggcaagtcatttaatttccttgagttttggtgtaagtattgatggagcagacca

SEQ ID NO: 58666 - DNA, 201 bp, Homo sapiens
agcaggattttcaatgcctggctggttgttacttatccatttagtccgagcttcagggaaagaacatgacaccggcctccagcagagcctgctcttggtcyactgtttatcctggtgaccttaggcaagtcatttaatttccttgagttttggtgtaagtattgatggagcagaccatcaataactgttcttatgtctatt

SEQ ID NO: 58667 - DNA, 201 bp, Homo sapiens
aattattcttttacccagacacttacatattcctagccattccttttgcttaagtttgcagagatttgtgcttaaaactgaataaacaatctcagggtttgtgtgtgtgtgtgtatgtgtgtgtgcgtgttatatgaagtcttgctagaatgcataaacaaacaaaaaaaatatcatactctcagatcctggatactgtgg

SEQ ID NO: 58668 - DNA, 201 bp, Homo sapiens
tgtgtgtgtgtatgtgtgtgtgcgtgttatatgaagtcttgctagaatgcataaacaaacaaaaaaaatatcatactctcagatcctggatactgtggtcrcctggacttcaaaagccttttgtccgtatgtatttacataatgtattctccatgtttggttttcattaaacccatgagtttaataataaagtgtttggaa

SEQ ID NO: 58669 - DNA, 201 bp, Homo sapiens
gtgttatatgaagtcttgctagaatgcataaacaaacaaaaaaaatatcatactctcagatcctggatactgtggtcgcctggacttcaaaagccttttgyccgtatgtatttacataatgtattctccatgtttggttttcattaaacccatgagtttaataataaagtgtttggaactatgcttttccctaccactttt

SEQ ID NO: 58670 - DNA, 201 bp, Homo sapiens
aaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagttttctagcagttctcttttttaagagcctca

SEQ ID NO: 58671 - DNA, 201 bp, Homo sapiens
tgtgagccaccgctcctggcacccatcaaattttcaaaggaagaaatggaatggtgcaaccatggtacatgggaaggaggagggggacacacaagactgtrcctatcatgggggcttcgacctcatctgggaaggtggttggagagagtgagtcctgacctgagctttggaacttatcaagttgagagagaaatttgataa

SEQ ID NO: 58672 - DNA, 201 bp, Homo sapiens
gagcagaagaactcactgaaaagtcctggcaaggttccacggcacctgtgatgcttccatcacacatatttgctgagtacccgctgttcataggtcagtcrctatgcaaggcactgaggtgacaaagacaagcagaatgacagttaaatgtaacatgggctttgtggtcaattagttctgggttcgttcccaggtcctatc

SEQ ID NO: 58673 - DNA, 201 bp, Homo sapiens
catagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctct

SEQ ID NO: 58674 - DNA, 201 bp, Homo sapiens
tgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttt

SEQ ID NO: 58675 - DNA, 201 bp, Homo sapiens
gtgtgtgttgggggtggaattagcatgtagaggttggcaaaggggacaggagactgtgggatgattagtatattcttatttggcctgggagggaaaaaaartctttcatttccaacaatattcattctctgtgtcacctcagcatttaatttacttccgtcacaaaactacttgaagttgtcccaggctagttggtcctat

SEQ ID NO: 58676 - DNA, 201 bp, Homo sapiens
ttaacagcaagatcttcagagctgcagctcacctgtgccacgatggtctcctaggagccctttcctgctgtagtcccgccccgaggggtttcacttcccaytgcctcttggtagccgtgggcactttggtgctctgatgatgtaacatggagattgtccttgtctccatcgctgtctttactggtgtatgcccatgaggta

SEQ ID NO: 58677 - DNA, 201 bp, Homo sapiens
ggttccacggcacctgtgatgcttccatcacacatatttgctgagtacccgctgttcataggtcagtcgctatgcaaggcactgaggtgacaaagacaagsagaatgacagttaaatgtaacatgggctttgtggtcaattagttctgggttcgttcccaggtcctatcactaactagtacccttatgaacctggacatgt

SEQ ID NO: 58678 - DNA, 201 bp, Homo sapiens
gtcaggccattggtataccattgtttttcttaaacatttatttattttcttatatttacagcatatgtggtcatttaaaattattttatagcatataaaastaaaaagaatataaattaattttttagcattaatattagggaagataatctgacatttaaaaatacatgtctatatgtgtatacatacatagaagtatat

SEQ ID NO: 58679 - DNA, 201 bp, Homo sapiens
ttgtctccatcgctgtctttactggtgtatgcccatgaggtatgtcaaagtctgtatgtctttgtaataatgctggatcatttgtccaccttcagagacarctgaagacagttttaagtgaaaccacacagagggcatataccattgggacaagaggtctgaagtctatttttgagaaagagaagagatcaagtagttaac

SEQ ID NO: 58680 - DNA, 201 bp, Homo sapiens
ccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaag

SEQ ID NO: 58681 - DNA, 201 bp, Homo sapiens
ctgggcttagtaagttgcctgacttctcatcctggagttcgtatccccttgtttctagaagagaaatccctcagatgtgaaggtgtgttccatgattttgycgaacttgccctacatactgttttattatatattctgcccacttctattccctgccaattaattaattgtttcattggtatagttttttttttttttttt

SEQ ID NO: 58682 - DNA, 201 bp, Homo sapiens
ccaggctggagtgcaatggcgtgatcttggctcactgcaacctccgcctcccaagttcaagcgattctcctggctcaacctcctaagtagctgggattacrggcacctgccaccacgctcagctaatttttgtatgtttagtagagacgaggtttcaccatgtttgtcaggttagaccggaactcctgacctcaagtgatc

SEQ ID NO: 58683 - DNA, 201 bp, Homo sapiens
ggaaatgaacaggacggaagaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttg

SEQ ID NO: 58684 - DNA, 201 bp, Homo sapiens
accagtccctagcctgtggagaaggggcaatctcttatctgaaggcctaggaggtgcagggatgtttatatgggctgctagcgcttagtttcctgccacarggagacagtaagaaaggtgacgtcaatctgagatgagagagagagcaaaacagttcttttgaccaccttgaccccgaccttgaaataaggtggaactaat

SEQ ID NO: 58685 - DNA, 201 bp, Homo sapiens
ctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagct

SEQ ID NO: 58686 - DNA, 201 bp, Homo sapiens
atgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttgtactgacc

SEQ ID NO: 58687 - DNA, 201 bp, Homo sapiens
tccacaatgtccacataccagcttgatggtgacttgtgtcattctccatccccttgttaagagaaaatctactttatgagccctctttccaaccgcagtgwtgaggactagaccaggcaagatgatgccgctggaccactggatccagctggaccgctagaccacagagcccctggagcctcccaaggccaagcccgccag

SEQ ID NO: 58688 - DNA, 201 bp, Homo sapiens
ggggtagctctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctat

SEQ ID NO: 58689 - DNA, 201 bp, Homo sapiens
tccacctgggcacccagcctggtgaacagggtgcaggctgggatttagccctaccttgcttttggaccattgagctactaagttggagcaacaaggcttgrgaatttttctttgatcataggtaggaaaggtaaaaaaacataaatctgccaatagaaaatagcatcgtaatgagtttctactatatttgtttgggctttg

SEQ ID NO: 58690 - DNA, 201 bp, Homo sapiens
tccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgctcttgcaaaccttgaagtgggccctg

SEQ ID NO: 58691 - DNA, 201 bp, Homo sapiens
attctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttga

SEQ ID NO: 58692 - DNA, 201 bp, Homo sapiens
gtttggtggaattaacatagatttcccacatggggaaggttttgggtgaggatttagaacaaggcaggttcttgatcctcggaagagattcttatctgagrggggatttgagaatggcattgcagagtgggaggcgctgctgtgtggaaaaatgaactggaataattattagaacagttctcagaatttacaggatatttg

SEQ ID NO: 58693 - DNA, 201 bp, Homo sapiens
cctggataagaacatgctgcgtcagagagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgacca

SEQ ID NO: 58694 - DNA, 201 bp, Homo sapiens
aggatatttgatcataggagtaactttcctcaggagtgatggatggaatgcctgtacttggaatatttttaaattaatctattttcattacattgaaagtrtgacacacagagaacactaaaattggatgaggcactacctggaattatataaagaatgacaaagatgcggttatccatttattttctaggcaagttagtt

SEQ ID NO: 58695 - DNA, 201 bp, Homo sapiens
caagcgctggaattgctgacctccctgaaagagaagcctgcagctgcggcctctggggtgaattccccccatgggaggacctggtggagttaaaacagackatatccacatcacagagagctggcccattgctcagggcctgggaagtggtagggagggaccttcccagaagagagatgactcaggctggtcccaagcccc

SEQ ID NO: 58696 - DNA, 201 bp, Homo sapiens
gatcacatgaggtcaggaattcgagaccagtctggccaacatggcaaaactccgtctctactaaaaattcaaaaattaggcttggtggcacgtgcctgtartcccaagctactcaggaggctgaggcaggagaatcacttgaacccagtaggcggaggttgcagtgagccgagatcgcaccactgcactccagcctaggtg

SEQ ID NO: 58697 - DNA, 201 bp, Homo sapiens
ggcaggccaaggcgggtggatcacctaaggtcaggagttcgagaccagcctgaccaacttggcaaaacccagtgtctactaaaaatacaaaaattagctgrgcatggtgtcacatgcatgtagtcccagctactcaggaggctgaggcaggagaactgctcgaacccaggaggctgaggttatgttgagccaagattgtgc

SEQ ID NO: 58698 - DNA, 201 bp, Homo sapiens
gttccacatcctccctgtgggactaggggccagggcaatgggaatcagtgcagaaataaagctcatgctgtttgctctgccatgagtaacgaagtcctctrtatctgatcctgggtctcctgttttctgctagcttcctcaaaacttggtagctaactcattaacttacaaggaagaggttgaacgtgtagacccttcaca

SEQ ID NO: 58699 - DNA, 201 bp, Homo sapiens
tggtttactactccttagacggtggcccagagaccctttaaatgaaattcattttactagcaccctttttcatcatgagaaatatattctgtttttcttaraaaatgggttatgttaggtctggtcaaggtaaataagtgttgagagtcgatgttgtgtgcatagttaatttcaattctttgaagaagctcccccatgata

SEQ ID NO: 58700 - DNA, 201 bp, Homo sapiens
aggctcagttaatgataaattgttatcaggagacccagcagtttctgctttttctaccctcctctttgacctctatttaaactaataggttactgggtttsaacatgccatgcagtgggaagaggcgggaaccccactgagctgtcctctaagtgaatcatgcccactatttggttgtgaggctgtggactttacttttca

SEQ ID NO: 58701 - DNA, 201 bp, Homo sapiens
acctgtaatcccagcactttgggaggctgaggtgggtggatcacttgaggtcaggagttcgagatcagcctggccaacatggtgaaaccctgtctctactrtaaactccgtctctactataaatacaaaaattagccaggcttggcgctgggtttctgtaatcccagctacttaggaggctgagacaggagaatcacttga

SEQ ID NO: 58702 - DNA, 201 bp, Homo sapiens
gtattaatagtagggagacagtaagcaagcaaggctcagttaatgataaattgttatcaggagacccagcagtttctgctttttctaccctcctctttgasctctatttaaactaataggttactgggtttcaacatgccatgcagtgggaagaggcgggaaccccactgagctgtcctctaagtgaatcatgcccactat

SEQ ID NO: 58703 - DNA, 201 bp, Homo sapiens
tctcgatctcctgacctcatgatctgtcagcctcagcctcctaaagtgctgggattacaggcgtgagccactgcgcccggccggggatcttgtattaatartagggagacagtaagcaagcaaggctcagttaatgataaattgttatcaggagacccagcagtttctgctttttctaccctcctctttgacctctattta

SEQ ID NO: 58704 - DNA, 201 bp, Homo sapiens
acactttgaaataatttatgttatgtgaatttcatctcagcaaaaagaggctaacacataaggagacatattttgatacatgtggcatattaagctgctgytgttgttttttaaatattccagctgcgtgcagtggctcacacctgtaatcccagcactttgggaggctgaggtgggtggatcacttgaggtcaggagttc

SEQ ID NO: 58705 - DNA, 201 bp, Homo sapiens
taggacccatatccctggattgttgaggaaatacgtgaacatatgtggcacacattatagtgtctggcatacaataaatactttgtaatgttactggtgtyttcttaccgttattgtctcactggtgaccgtttgaaatgttgaagctttattattacagataatggtggatatagtctcttccttgtttattttttgaca

SEQ ID NO: 58706 - DNA, 201 bp, Homo sapiens
ggcgggtggatcacctaaggtcaggagttcgagaccagcctgaccaacttggcaaaacccagtgtctactaaaaatacaaaaattagctgggcatggtgtyacatgcatgtagtcccagctactcaggaggctgaggcaggagaactgctcgaacccaggaggctgaggttatgttgagccaagattgtgccactgtactc

SEQ ID NO: 58707 - DNA, 201 bp, Homo sapiens
tttatataaaatatgcagagtaggcaaattcataaagacagaatacgcatcggtggtttctggggcggcggggagtatggaaagcctgttaatgagtacawgtttctttagttttttttggttttttgttttttttttgagacggagtcttgctctgttgcccaggctggagtgcagtggcaccatctctgctcactgcaa

SEQ ID NO: 58708 - DNA, 201 bp, Homo sapiens
atactttgtaatgttactggtgttttcttaccgttattgtctcactggtgaccgtttgaaatgttgaagctttattattacagataatggtggatatagtstcttccttgtttattttttgacagaatctttttttaaaaaagtttttatttgtttggtgagaatttacttgttacaggtctagtgctgttatagttgaat

SEQ ID NO: 58709 - DNA, 201 bp, Homo sapiens
atgttgacataacagttctgaagaccaaggtggtggaataggttaggttaggatacgtcggaggagccagtgtgaactgctcctttaagacatgaattagyccattttcatgctgctgataaagacatacccgagactgggcaatttacaaaagaaagaagtttattggacttacagttccatgtggctggggaggcctca

SEQ ID NO: 58710 - DNA, 201 bp, Homo sapiens
ttacaggtctagtgctgttatagttgaatgttttgaattatgtaacttaagtgaaacataaagctatgacttgaattttgtggttagaaattttctcagtygattgacaaggatggcgtattggccaccttttgccgcagtaacaaacaatcccagactctcaaggcttgcaaaaataaatgtgtgtttgtttgctcataa

SEQ ID NO: 58711 - DNA, 201 bp, Homo sapiens
agaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaa

SEQ ID NO: 58712 - DNA, 201 bp, Homo sapiens
gtaacaaacaatcccagactctcaaggcttgcaaaaataaatgtgtgtttgtttgctcataacacatgtggctgagggttggccgtggctccacagtcacrggtgggctttcctgggctcagcttctcacagcgtctccttgcagggcccaggctgtaggagatgtcatcagggcctgcagagggcaaaacctcacagagg

SEQ ID NO: 58713 - DNA, 201 bp, Homo sapiens
ccggggccgggcacggtggctcatgctggtaatcccagcactttcggaggcctaggtgggcagatcacaaggtcaggagatggagaccatcctggctaacrtggtgaaaccccgtctctactaaaaatagaaaaagaaattagcctgacatggtggcacatccctgtaatcccagctactcgggaggctgaggcaggagaa

SEQ ID NO: 58714 - DNA, 201 bp, Homo sapiens
ctaagttcttgccacaggtagaagccatgctactgcacaagtttcatacttgaagagtggacatctgacacagtgttggtggttgttgaagtgtatgactwttactgtgttgctttggaagcttgatgccataacaaaagtgcagaattccatgtttgataactttctgacttgatgaaaatgaattgtggatacagattt

SEQ ID NO: 58715 - DNA, 201 bp, Homo sapiens
taatcccagcactttcggaggcctaggtgggcagatcacaaggtcaggagatggagaccatcctggctaacgtggtgaaaccccgtctctactaaaaatasaaaaagaaattagcctgacatggtggcacatccctgtaatcccagctactcgggaggctgaggcaggagaatggcgtgaacccaggaggcggatcttgca

SEQ ID NO: 58716 - DNA, 201 bp, Homo sapiens
acttagccaaaactaatttgggatttttgtttgtttgaattgttggagggtggatgagagtgaagacatatccttttgaaacttaatttaatttttatttwttattattattattattttcaattttttatttttattattattattattttctattttttatttttattttttgagacggactctcgcactgtcgcccag

SEQ ID NO: 58717 - DNA, 201 bp, Homo sapiens
gggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccatggacagaaatagagaaggcaagatgagaa

SEQ ID NO: 58718 - DNA, 201 bp, Homo sapiens
cacgtggccttgctgacatctgagtttgcaacttcttttatgccttctgctaactgggaccccagtgggcttccctgctacaccctctgaggttccccagwcctgccaagctgttccatccccagttccttggtgcctgctggtacttcaccctggagagcccagcccttccacttgttcagatctcagtctctcatctgg

SEQ ID NO: 58719 - DNA, 201 bp, Homo sapiens
gaataaataggtacataagtgcttgctagcaagcagctgaggcaacctattaaaactcatgccagtggtaaagttaagctgctttctggtaagaatttcasaattccaggacgtctcaaatttctggctggtacaccctgggtaaggtccacaggctggatgggttttggaacatgtcttgattgtactttttcctcttgg

SEQ ID NO: 58720 - DNA, 201 bp, Homo sapiens
ctaactgggaccccagtgggcttccctgctacaccctctgaggttccccagacctgccaagctgttccatccccagttccttggtgcctgctggtacttcmccctggagagcccagcccttccacttgttcagatctcagtctctcatctgggagggacagcttgagcactatgacctgtgtgaagcttttcccagtgctg

SEQ ID NO: 58721 - DNA, 201 bp, Homo sapiens
tgaggcaacctattaaaactcatgccagtggtaaagttaagctgctttctggtaagaatttcagaattccaggacgtctcaaatttctggctggtacaccytgggtaaggtccacaggctggatgggttttggaacatgtcttgattgtactttttcctcttggtttggaaagcaacgtaccctaggtaaggagagatttc

SEQ ID NO: 58722 - DNA, 201 bp, Homo sapiens
tggcgtgagctgagatcgcaccactgcactccggcctgggtgacagagcaagactctgcctcaaaaaaaaaaaaaaaaaaaagaaaaaaaaaagattgaamatgtggaatatgagacaaatgaaaaagattgaattccgttccaactgggcttttgaatttattttcgcacttcctattttttgagcccgggagtgcaaga

SEQ ID NO: 58723 - DNA, 201 bp, Homo sapiens
caacctattaaaactcatgccagtggtaaagttaagctgctttctggtaagaatttcagaattccaggacgtctcaaatttctggctggtacaccctgggyaaggtccacaggctggatgggttttggaacatgtcttgattgtactttttcctcttggtttggaaagcaacgtaccctaggtaaggagagatttctgaca

SEQ ID NO: 58724 - DNA, 201 bp, Homo sapiens
ctgtactctttaaccaaggctccttttgcaaagagaaatctgagctgctttttaaagaaggccgtttttaaataaaaatgcaaataagctactttgtaacyacattaattacccacctagcctcttattaccatgtttgtattgtttgcaaatactatttacagtcgtgtggaaattaacattactggtcctgaggaaaga

SEQ ID NO: 58725 - DNA, 201 bp, Homo sapiens
gcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagc

SEQ ID NO: 58726 - DNA, 201 bp, Homo sapiens
gacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgcccc

SEQ ID NO: 58727 - DNA, 201 bp, Homo sapiens
acgaaacataccttccagtctcccgagtagtgtattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaa

SEQ ID NO: 58728 - DNA, 201 bp, Homo sapiens
gctgggagtacaagtgtgcaccaccatgcctggctaatgtttgtatttttagtagggacggggtttcgccatgttggccaggctggtgtcaaactcctgayctcaggtgtaccaagaacaaaaggccaaccccattagacggtggccaagttggtgctgtgaacagggatcctgcctctgcctcccaaagtgatgggatta

SEQ ID NO: 58729 - DNA, 201 bp, Homo sapiens
caagtgtgcaccaccatgcctggctaatgtttgtatttttagtagggacggggtttcgccatgttggccaggctggtgtcaaactcctgatctcaggtgtwccaagaacaaaaggccaaccccattagacggtggccaagttggtgctgtgaacagggatcctgcctctgcctcccaaagtgatgggattacaggcgtgag

SEQ ID NO: 58730 - DNA, 201 bp, Homo sapiens
ccccatctctgctacagatataaaaattggctgggcatggtggggtgcagctgtaatcccagctgctcaggaggctgaggcaggcgaatcgcttgaacccsggaagcagaggttgtagtgagctgagatcatgccactgtactccagcctgggtgacagagcaagactgtctcaaaaaagaataaaaatgaataaaaatta

SEQ ID NO: 58731 - DNA, 201 bp, Homo sapiens
agcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcac

SEQ ID NO: 58732 - DNA, 201 bp, Homo sapiens
ggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccac

SEQ ID NO: 58733 - DNA, 201 bp, Homo sapiens
agcaggacacactgcaaatactaggaatccttaagtacagtggaaccccagagcactctacctgctttctttctcacctccttaaaaactttttttgcccwcacctcatcatttattcagcagtcacaacagtgccaagaacttggctagagattggaaataaagcttatgccttctctcatatctcctgtaccttatttc

SEQ ID NO: 58734 - DNA, 201 bp, Homo sapiens
ggcaggcgaatcgcttgaacccgggaagcagaggttgtagtgagctgagatcatgccactgtactccagcctgggtgacagagcaagactgtctcaaaaargaataaaaatgaataaaaattatgtgattagagaggggaaaacaatcatttcttgtgcgctaatgccactcagcaggtgcttacactgtctggttcatcc

SEQ ID NO: 58735 - DNA, 201 bp, Homo sapiens
tgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatca

SEQ ID NO: 58736 - DNA, 201 bp, Homo sapiens
acttgttaacttctgtattgtcttttctgctgctttatccaactttgcaatctataagcttctgttactggaaaatggtgatggtaaagtaattgctttcytatgttccatcacagagggtagactgctagctctagtatttttcaatgctgctttttaagtgatagatgtataccattcagtaccaaccctgcaccctgg

SEQ ID NO: 58737 - DNA, 201 bp, Homo sapiens
gagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctc

SEQ ID NO: 58738 - DNA, 201 bp, Homo sapiens
aaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttatt

SEQ ID NO: 58739 - DNA, 201 bp, Homo sapiens
acatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcagctcaca

SEQ ID NO: 58740 - DNA, 201 bp, Homo sapiens
aagttaaaaaatagcacagaggggatccctgtgatttttactcacttttctacaagcatgactccttatataactacagtacaggatccaaaccaggaaayatgcctgggtacaatgtgagtgtataattccaggtaggtaaaataatggcccttattaggatgtctgcgtcctaatccgcggaaactatggatatgcttt

SEQ ID NO: 58741 - DNA, 201 bp, Homo sapiens
ttggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattg

SEQ ID NO: 58742 - DNA, 201 bp, Homo sapiens
gagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggattaaaaaaatggtttttgatttatgaaaaatttttctgc

SEQ ID NO: 58743 - DNA, 201 bp, Homo sapiens
tgtggtgtgcggtgcaacccgggctgtgttcccgagtgcatcaaacggggattgggacctgttttccttcccactcacatgtaggtcacctacgggagcargggaggaaccatctgaggtgtttttttttttttttttagatttctcattgctgagaacagttccagctctgctgaccaaaggctgagtgtccttttatta

SEQ ID NO: 58744 - DNA, 201 bp, Homo sapiens
aagaggtcacataggatattccatttatataaaatatgcagagtaggcaaattcataaagacagaatacgcatcggtggtttctggggcggcggggagtakggaaagcctgttaatgagtacaagtttctttagttttttttggttttttgttttttttttgagacggagtcttgctctgttgcccaggctggagtgcagt

SEQ ID NO: 58745 - DNA, 201 bp, Homo sapiens
tctccgacttatgtatgattcatcaagaggactccaggctgtggtgtgcggtgcaacccgggctgtgttcccgagtgcatcaaacggggattgggacctgktttccttcccactcacatgtaggtcacctacgggagcaggggaggaaccatctgaggtgtttttttttttttttttagatttctcattgctgagaacagt

SEQ ID NO: 58746 - DNA, 201 bp, Homo sapiens
aggagctcttggattgcaatttttcattcacccctccctctccacccttcctgtcttcaagcctgagcaggtgatactgcattttgtaccgtatgactttwaaacagaaccacgagttcagaactttggttaggtcctgcccgtgttctctagctaacgcatggcaacgctggtttccaacctttcactgtgcgggtttct

SEQ ID NO: 58747 - DNA, 201 bp, Homo sapiens
agggagatggagggaggcaaaaagaaaaagggagaaggaaagagaggaaagaggggaagggaggaaggaaagaagagagagaaggaggaagagagggaagkaggcacagaggtagagaggcagggagataatggagatcctggccaaaagttaatgctccgtttctagtagtccacagaaagcaccttgaccaagtgactg

SEQ ID NO: 58748 - DNA, 201 bp, Homo sapiens
ctttccattaagtgagtctttctccaagggaacagaagtcttaggttgttgatctggcggtcagaacctaggacaggcaaggcagtgggctgttgtagagkagatgaagctgatcagagcacacccacaccagtgacaaccggtcaggacctgggaagggctctgacccattcatctgagagatgtggcatgaggaacact

SEQ ID NO: 58749 - DNA, 201 bp, Homo sapiens
attgcattgcaaataatagcagttagtgggagttgagagccagctctgcaccagactcgtatcagccacttgacctccattattccttattccttggtacytctgcgccatctgtgatatcagatccttttttctgcaaggaaactgaggctcggcgatactaagaaactcagccagggtccgtcagctgtcaagtggcat

SEQ ID NO: 58750 - DNA, 201 bp, Homo sapiens
taaagtgatagagaggggctggcgaggagagcagtctaatttcaggaaagtcagaaaagtctttaaggaaactgaaggctgagctgccagggccagccacrtgggtactggagagtgggaggcccagtcacggggaatgctggcttagcacaactgaaaaatacaaaggtagaatatgaagtgtaatgacatggtttagat

SEQ ID NO: 58751 - DNA, 201 bp, Homo sapiens
cgggtgtggtggcgtgtgcctgtaatcccagttactcgggaggctgaggcaggagaatcgcttgagcctgggaggcagaggttgcagtgagctgagatcgygccactgcgctccatgctaggtgacagagcaagattccatctcaaaacaaaacaaaacaaaaaaacaagaagttaaggattgcagagcataagtatcttc

SEQ ID NO: 58752 - DNA, 201 bp, Homo sapiens
cccatataccacagtttctaatacgatattataccaagctttaatatgagcacacctcctggatgatgctgtaaattagttgcctcccaccacaccacatsaagtataatggatataatatgatttttcagaattcagctaattacctactgagctttacattttgtaacttttttgactgtccatcaaaatgtctttggg

SEQ ID NO: 58753 - DNA, 201 bp, Homo sapiens
gcagtctaatttcaggaaagtcagaaaagtctttaaggaaactgaaggctgagctgccagggccagccacatgggtactggagagtgggaggcccagtcasggggaatgctggcttagcacaactgaaaaatacaaaggtagaatatgaagtgtaatgacatggtttagattgaaatctgatgtggatggaaaggttttgt

SEQ ID NO: 58754 - DNA, 201 bp, Homo sapiens
actctaatgacataattacctcccaaagtccgcacttcctaatgttaccactctggaggttagaatttcaacatataaattttggggggacacattcagaycacaataatgttttataatgttccttttgctttaacaagagacacatgtcagatagtagacatgatctgagaagacacaaaacccagcgtggtgattttg

SEQ ID NO: 58755 - DNA, 201 bp, Homo sapiens
gtagtttaactaaaaagtggccactgtctcctggtagcggttggtaagccatccagtctctgcaggcatctacgctccaggtctccagtctgaggagtctsgctcctggggcaggtgcctctgggggtctctgccaggcttgtctggtcatgcagctacttccagactgattcctagatcttgcatttttacataggacat

SEQ ID NO: 58756 - DNA, 201 bp, Homo sapiens
taatgacatggtttagattgaaatctgatgtggatggaaaggttttgtggcctttcagcccaaggtttgaaaaagaaatggaatttctaaatggagtgggyagccacaggagggctttagacaggaccgtggccccgctggattttctgcccattgacttgggctcgaagtcacgtccatgttgctattacagatgcctcc

SEQ ID NO: 58757 - DNA, 201 bp, Homo sapiens
gaggatttgtttttgatctcataggtgtccatcttgctattttctcaactagcagaggcaactctctggggtatcttttaaaagggcactaatggccaggmgtggtggctcacacctgtaatcccagcactttgggaggccgaggcaggtgtctcggtggatcacttgaggtcaggaggtcgagaccagcctggctgacat

SEQ ID NO: 58758 - DNA, 201 bp, Homo sapiens
aactaaaaagtggccactgtctcctggtagcggttggtaagccatccagtctctgcaggcatctacgctccaggtctccagtctgaggagtctggctcctrgggcaggtgcctctgggggtctctgccaggcttgtctggtcatgcagctacttccagactgattcctagatcttgcatttttacataggacatccccagc

SEQ ID NO: 58759 - DNA, 201 bp, Homo sapiens
atgtggatggaaaggttttgtggcctttcagcccaaggtttgaaaaagaaatggaatttctaaatggagtgggcagccacaggagggctttagacaggacmgtggccccgctggattttctgcccattgacttgggctcgaagtcacgtccatgttgctattacagatgcctcccagaacagtttatataatcgtcaacgt

SEQ ID NO: 58760 - DNA, 201 bp, Homo sapiens
aagtgctgggattacaggcgtgaactactgtgcctggccaggataatctttaagaagaagataacattagctattcttctcacttcctacgtagaattccmtaccctgtgtctttggcctggaaagggtattggtagcaattgtcttcggctttccctgccatgtgtatgcattcccacggccacacaagcacacacacac

SEQ ID NO: 58761 - DNA, 201 bp, Homo sapiens
ccctagttgtatcaccttcctcccattatgtttgtaacttcagattttgtatatttcgcatatgtcaatatgtaaacattttatatatatatatatgcatkcacacacatgcatacatatatgtaatggtatatatacatgtaagtttccatttttgctcaaattgctctggacagttctttgctctgggagttctttact

SEQ ID NO: 58762 - DNA, 201 bp, Homo sapiens
acaggaccgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgc

SEQ ID NO: 58763 - DNA, 201 bp, Homo sapiens
cagtgagcccagatcgcaccactgcactccagcctgggtgacagagcgagactccatctcaaacaaacaaacaaacaaacaaacaaacaaactaagaacarcaacgaaaaaactcccatgtattatctatggattgactgtaaaatatgagaagcaataaatatgttcatcactagggccatctagaaatttctaacccaa

SEQ ID NO: 58764 - DNA, 201 bp, Homo sapiens
gctagacacagaattgggtgttgggctttaaagatggatgaaaggcagtacctggtctagagaggctgctacctggatggtgtgtttgccatcctcagtartgtgtgtcccttacagatgatgcccagtgactctacaattgctgggatactttttagaattttctttttgtgcattacttttgattcttggttctttctt

SEQ ID NO: 58765 - DNA, 201 bp, Homo sapiens
gaagaaatgctgttttaggaaatcaataggataatttttttttttttttgaggcggagtctcactctgttgcccaggctggagtgcagtggcacagtctcsgctcactgtaagctccgcctcccgagttcacgccattctcctgcctcagcctcccgagtagttgggactacaggcgcccgccaccacactcagctaattt

SEQ ID NO: 58766 - DNA, 201 bp, Homo sapiens
gagaagcaataaatatgttcatcactagggccatctagaaatttctaacccaagggtcaactaatctttccctgtgttgtatttcctgctctgcggatccrgcatcatgacctttgtactacccaggaaagccagtgttctcatgggctcttctcttttttatgctctaccagatgctagcactgtggcatgccattcgct

SEQ ID NO: 58767 - DNA, 201 bp, Homo sapiens
ttaaagatggatgaaaggcagtacctggtctagagaggctgctacctggatggtgtgtttgccatcctcagtagtgtgtgtcccttacagatgatgcccartgactctacaattgctgggatactttttagaattttctttttgtgcattacttttgattcttggttctttctttggcattagctcaccagtggcaaatat

SEQ ID NO: 58768 - DNA, 201 bp, Homo sapiens
ataaataaatacataataaataaacagtagtggttgaaagaaagggaaggaagaaatgctgttttaggaaatcaataggataatttttttttttttttgargcggagtctcactctgttgcccaggctggagtgcagtggcacagtctcggctcactgtaagctccgcctcccgagttcacgccattctcctgcctcagcc

SEQ ID NO: 58769 - DNA, 201 bp, Homo sapiens
tgtctgtttatagaaagtgtcaccaagttctgtcttgggcccgtccactcggttatatgtgctggaccctgggtggaagcactttgcacgtgtgcattcaygatgggctgtgctggaggggaaaacaggcatcactcccaaattctattcatgcaattaaaaattcctttcatttttatttgtgagagggtatgggtgcac

SEQ ID NO: 58770 - DNA, 201 bp, Homo sapiens
gacataggtctggcgatctttttggcatagacgtgtggacgttgtttttgacatttgtacatgcttttgctcaagttgaaggcccaagtttacccaattcractgcccccacccagatagaatattcatggttagaccataaactacataactggaaattttaaatctatttttatatgcatacaaaaactgcaggcctga

SEQ ID NO: 58771 - DNA, 201 bp, Homo sapiens
taactgggtgtggctgtgtcctaataaaactttatttacaaagaacaggaagtggcttggatttggtatctggcctggcagctgtggtttactactccttrgacggtggcccagagaccctttaaatgaaattcattttactagcaccctttttcatcatgagaaatatattctgtttttcttagaaaatgggttatgtta

SEQ ID NO: 58772 - DNA, 201 bp, Homo sapiens
ttggattatttatttatttatttatttatttatttatttatttattgtttgagacagtctcactttgtcaccaagtctggagtgcagtggtgtgaccttgrctcactgcaacctctgcctcccaggttcaagtgattctcttgcctcagccccctgagtagctgggactacaggcacgtgccaccatgcctggctaatttt

SEQ ID NO: 58773 - DNA, 201 bp, Homo sapiens
ataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagat

SEQ ID NO: 58774 - DNA, 201 bp, Homo sapiens
ttacaaagaacaggaagtggcttggatttggtatctggcctggcagctgtggtttactactccttagacggtggcccagagaccctttaaatgaaattcaktttactagcaccctttttcatcatgagaaatatattctgtttttcttagaaaatgggttatgttaggtctggtcaaggtaaataagtgttgagagtcgat

SEQ ID NO: 58775 - DNA, 201 bp, Homo sapiens
cccctttcctttcccaaacttttactagcttcttccatcctggacttgcaatctggctgaaaacctgctaaataagggaacaattttgacatggctcctgkactccccacaaacctagttgattccagaccagtaatgtcttggggacagtgttgtcccatcttcctttctaggctgggctcagattactgacgtggaaga

SEQ ID NO: 58776 - DNA, 201 bp, Homo sapiens
gcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtaga

SEQ ID NO: 58777 - DNA, 201 bp, Homo sapiens
ggggtttcaccatgttagccaggatggtctcgatctcctgacctcatgatctgtcagcctcagcctcctaaagtgctgggattacaggcgtgagccactgygcccggccggggatcttgtattaatagtagggagacagtaagcaagcaaggctcagttaatgataaattgttatcaggagacccagcagtttctgctttt

SEQ ID NO: 58778 - DNA, 201 bp, Homo sapiens
agtcttcaggcccacagtgtaggcattcaacaaacgctcttcagggagaaggaaagttaccatcaaaatccgtcgttgaaagtattgaagttccagctggyggtctgatacagcttagatgttgtccctgcccaaagctcatgtcaaaaggtaatctgcagcgttggaggtggggcatggtgggaggtgattgggtcatgg

SEQ ID NO: 58779 - DNA, 201 bp, Homo sapiens
cccacagtgtaggcattcaacaaacgctcttcagggagaaggaaagttaccatcaaaatccgtcgttgaaagtattgaagttccagctggcggtctgatayagcttagatgttgtccctgcccaaagctcatgtcaaaaggtaatctgcagcgttggaggtggggcatggtgggaggtgattgggtcatgggggtggattt

SEQ ID NO: 58780 - DNA, 201 bp, Homo sapiens
gatcacacagctagatcacagtgggggaacctgaattatggggatgctcacaaaagggcaaaacacaacggttgctgtcatttgatgctttatgttaagtrtgcatatgctcagttacagaaacctaaattgctaaattgcaaggctgtatatgatatgccaatttggcatattctgtctttttatattctgccaccccta

SEQ ID NO: 58781 - DNA, 201 bp, Homo sapiens
aatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgc

SEQ ID NO: 58782 - DNA, 201 bp, Homo sapiens
tctgtttttcttagaaaatgggttatgttaggtctggtcaaggtaaataagtgttgagagtcgatgttgtgtgcatagttaatttcaattctttgaagaarctcccccatgatatttcacggctgagagaagaggaaagagtttaagtggaacagtgtgctttgctgagctttggaaatattaccatatagggaagcaggt

SEQ ID NO: 58783 - DNA, 201 bp, Homo sapiens
cacagtgggggaacctgaattatggggatgctcacaaaagggcaaaacacaacggttgctgtcatttgatgctttatgttaagtatgcatatgctcagttrcagaaacctaaattgctaaattgcaaggctgtatatgatatgccaatttggcatattctgtctttttatattctgccacccctatcatacttatgaaaat

SEQ ID NO: 58784 - DNA, 201 bp, Homo sapiens
acatatgtattcattcattcattcatttattctttcattcagtcaataaatatttattgagtagtaagcacatgcaaggcattgagggtggggagggaaaragacacaaattgtccttaccctcatggattcaccatctatttaaaggccacaaatacttgtgtgagaagcaagtcttaatagtctgaagtattttcttag

SEQ ID NO: 58785 - DNA, 201 bp, Homo sapiens
atataatgatgataataattgctaatatttatcagctatttatcatgtgtcatgtacagctaagcacttacataccatcccattttatccttataatgackctaagagtgggttaaaaaatggcagaagaatggcagtgtttaatggttcagcctggtgcaatgattaaccacattttacagactaagaaattaagaacct

SEQ ID NO: 58786 - DNA, 201 bp, Homo sapiens
ttcagtcaataaatatttattgagtagtaagcacatgcaaggcattgagggtggggagggaaaaagacacaaattgtccttaccctcatggattcaccatstatttaaaggccacaaatacttgtgtgagaagcaagtcttaatagtctgaagtattttcttagattcccttgagccgcaatgctgaaaagcttatggtgg

SEQ ID NO: 58787 - DNA, 201 bp, Homo sapiens
ggagggaaaaagacacaaattgtccttaccctcatggattcaccatctatttaaaggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccat

SEQ ID NO: 58788 - DNA, 201 bp, Homo sapiens
ataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctg

SEQ ID NO: 58789 - DNA, 201 bp, Homo sapiens
tgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatgg

SEQ ID NO: 58790 - DNA, 201 bp, Homo sapiens
cctttttctggggtcttttgcctaatcgtttactggtttggagacactgttttctgtattgtttaggactgaaaatgtagacctaactgaaatcaagcackcgagtatcctaattattttaaattcataatgaatagtcatcatggtttcactttttttatgtactcttttgaaagagtacgatgggggaataaaagccag

SEQ ID NO: 58791 - DNA, 201 bp, Homo sapiens
atcattaaaatgagaacactgttattggtctttcgggattgttttgagaaatgagatatcgagacatgcctggcacaaggccttaattcttcttcatggtmaagaaatggcagattttcccccttccattcccacccttgcacatagtaggttctcagcaagtatttgtagatgtaatcgaccagcagagatcatttgtac

SEQ ID NO: 58792 - DNA, 201 bp, Homo sapiens
ggagttttgtttgcaaatgatcacctggtaatttaagagggtgagctaaacttcctccttttctagtatggacctttggggctcaggatgaggatgttcamtttgtactgctggtggagctgcctttccattaagtgagtctttctccaagggaacagaagtcttaggttgttgatctggcggtcagaacctaggacaggc

SEQ ID NO: 58793 - DNA, 201 bp, Homo sapiens
agaagcttagtctcaatttcagagagttattttggcaacatatttgggaaaatgatagttagatgctgcgttagccagcctctgcatgattttttacgcaraacaaacagttccaaatatcagtgctttcagcaactcatatatttctcacttatggtgcatgtcgctgatggttggctgctgctctgatctcactccagt

SEQ ID NO: 58794 - DNA, 201 bp, Homo sapiens
gcttctttttatttcttagagccagagctggaagacaaggcctggcatattttggcaggcctggatcagagcctaggtgtgtaaattaggaattgcatttsgctgctgctaacaaggacccaaacatggtggtaaattcttccacataaaacaacagaaaataagttgttttctggccctgggctggggtggccactccac

SEQ ID NO: 58795 - DNA, 201 bp, Homo sapiens
gggtttatgatcaagtaaagagtttaaagaagtgttttatgagggagttttgtttgcaaatgatcacctggtaatttaagagggtgagctaaacttcctcmttttctagtatggacctttggggctcaggatgaggatgttcaatttgtactgctggtggagctgcctttccattaagtgagtctttctccaagggaacag

SEQ ID NO: 58796 - DNA, 201 bp, Homo sapiens
aggacatatgtgtcttctgccaagatgtggaattttggcaaggctagcatgataacaaataaacattcaagcagtcacttaatgatattgaattgaacacmatttctcagaagttcctgtattaaattacaaccataagaacatacacaagcatgcagattgtaagtgtgatgagaatggaaacattccataggacgcaga

SEQ ID NO: 58797 - DNA, 201 bp, Homo sapiens
ttgggtaattctaatgcttacttcatcccagggctgatgtgtgttaggttagggtttatgatcaagtaaagagtttaaagaagtgttttatgagggagttytgtttgcaaatgatcacctggtaatttaagagggtgagctaaacttcctccttttctagtatggacctttggggctcaggatgaggatgttcaatttgta

SEQ ID NO: 58798 - DNA, 201 bp, Homo sapiens
actcctgtacttcaaggttttggagtgggaaagttgaggaaatgtaagagatcatctctgtctctatcacattaccgacggagaagtgggataagaactaygtgtgttttcacttcttctttctttagagaaaacaaatatcatctgccttgctaggtagttgtgagaaatgaggagataatatctttaaatctcctacgg

SEQ ID NO: 58799 - DNA, 201 bp, Homo sapiens
actagcttcttccatcctggacttgcaatctggctgaaaacctgctaaataagggaacaattttgacatggctcctgtactccccacaaacctagttgatyccagaccagtaatgtcttggggacagtgttgtcccatcttcctttctaggctgggctcagattactgacgtggaagagttgttggtcctggtgcaacatg

SEQ ID NO: 58800 - DNA, 201 bp, Homo sapiens
ggcggtgcatgcctgtaatcccagctacttgggaggctgaggcaggagaatcccttgaacctgggaggtggaggttgcagtgagctgagatcacgccattrtactccagtctaggcaacaagagtgaaactctgtctcaaaaaaattaataataataatgttacaataataataatgttagtgatacatatcattttgaaa

SEQ ID NO: 58801 - DNA, 201 bp, Homo sapiens
atagaagtttatgacggaaaaggcaaaattctctgtgtctttatggggagatattcgatatgttttttcttggcagaaataaaacatattcaataatatamttaggcaaacttgttttacttgacaagaagaccgtatctccgtctgcaagatgaaggcaagatcaagagatgtcagttaacattcttgcgaccacaggta

SEQ ID NO: 58802 - DNA, 201 bp, Homo sapiens
tatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatg

SEQ ID NO: 58803 - DNA, 201 bp, Homo sapiens
agagaaaaacaattacactagctgctggtctgtatttactggttagaatagaatattattaccatcaagaataacattagtggccaggtgcggtggctcaygcctgtaatcccagcactttgggaggccgaggtgggtggatcacctgaggtcaggagttcaaaaccagcctggccaacatggtgaaacccccgtctctac

SEQ ID NO: 58804 - DNA, 201 bp, Homo sapiens
ggaaaaggcaaaattctctgtgtctttatggggagatattcgatatgttttttcttggcagaaataaaacatattcaataatataattaggcaaacttgtkttacttgacaagaagaccgtatctccgtctgcaagatgaaggcaagatcaagagatgtcagttaacattcttgcgaccacaggtagggaggagaactggg

SEQ ID NO: 58805 - DNA, 201 bp, Homo sapiens
ttgaccaatttttgtaaatctcttctgttactgtttatatacccggccacttctgccaaaatatgctggccttttagtcttttggttttttctctcttttkgtttgttggcttatgttcgctgcttgatctgactactggttttatttctaaggatttttttttaagttggcatctttttttctttgactttccttgtatg

SEQ ID NO: 58806 - DNA, 201 bp, Homo sapiens
aaggcaaaattctctgtgtctttatggggagatattcgatatgttttttcttggcagaaataaaacatattcaataatataattaggcaaacttgttttasttgacaagaagaccgtatctccgtctgcaagatgaaggcaagatcaagagatgtcagttaacattcttgcgaccacaggtagggaggagaactggggagg

SEQ ID NO: 58807 - DNA, 201 bp, Homo sapiens
ttactgtttatatacccggccacttctgccaaaatatgctggccttttagtcttttggttttttctctcttttggtttgttggcttatgttcgctgcttgrtctgactactggttttatttctaaggatttttttttaagttggcatctttttttctttgactttccttgtatgcccccctttctcccctgcattgtcttg

SEQ ID NO: 58808 - DNA, 201 bp, Homo sapiens
gttcaagaaggtcttgggcaagcgcgtgctagttattttcctcactggtgtggtcgtgacagatgaatcacattttactctcctccctttctcatagtatrattacataaaggagaccttccctggaaagagccctgtgcatggcttttgagagtgggcctgggctaacagtgagtgtggaagcttgctgccttgaattct

SEQ ID NO: 58809 - DNA, 201 bp, Homo sapiens
ttgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgt

SEQ ID NO: 58810 - DNA, 201 bp, Homo sapiens
gggctaacagtgagtgtggaagcttgctgccttgaattctttccaattctggagagttgatgggtaacaagtgtgtatctatagtctgcttggacatggcrgtgtggccactgacacgttgtcagccatcccctcaactccagggacaggaatggtgagaaggtggtgagggcacagtctgcccggagacgggacagtttg

SEQ ID NO: 58811 - DNA, 201 bp, Homo sapiens
gctgatctgcatagcacttcgcaatgaagctgtgctctagaaacataccacgatctactggactttcttaaataaggtggttgttcaggaaattcctccarttaattttactttaattccccctacaagaatgccgagacacctctgcctattttctctttctgtgtttgttgtttcttttgtttttgttttcgagactga

SEQ ID NO: 58812 - DNA, 201 bp, Homo sapiens
tcagaaatgcatgtcagagctacacaattctatccaaggcattaactgttgtcaagtctgttttttatgaatatgtttcaatataagaaattgtcttaggyccaaagtgaaacgtcttcctccttgactcatagcaagctcatgcaggtatttgaacattgttctgtataatatgtgcacctttgagaaatcccatgattc

SEQ ID NO: 58813 - DNA, 201 bp, Homo sapiens
ggattacagggatgcgccaccatgcccagctaattttttgtatttttagtagagacggggtttcaccatgttggccaggctggtcttgaactcctgacctsagttgatctgctcacgtcggcctcccagagtgctaggattaaaggtgtgagccaccgtgcctggcctctttctgtttcaaagaaatagtcaagaagtttc

SEQ ID NO: 58814 - DNA, 201 bp, Homo sapiens
aacttttgtagttgctgctggtctctttggaaggcaagtgctaatttacccacagttgaaacctgacacacacacgcgcgtgcacacacacagacacacastctctctctctttctctgtctctctctctttctctgtctctcataaggaactaaatcctgcgttttctcaccagagggctaatgacacactgcttagtca

SEQ ID NO: 58815 - DNA, 201 bp, Homo sapiens
tggcctctttctgtttcaaagaaatagtcaagaagtttctagatgcacacaaaatgaccaaaccagtctttccgcttatttacacaatgaagaaacatcasagttcaccctggaagacagagtttctttctgtcttcatcctagggcacaggagagatgcagtgatggcatgtctccactctgcagacatgttgcaggcct

SEQ ID NO: 58816 - DNA, 201 bp, Homo sapiens
gccacttgcagaccttggcagttgctgttgctcctgctgctgctgctgctgctgcattgtcaagactacattgatgtcttggaaatatagaaaaaagaggmtgctggactgtgtgcttagaatcagtgtgctaactctgttaccaacaccgtagagaagtggttccagaaggaagagttcagggtgagaatgaataacgga

SEQ ID NO: 58817 - DNA, 201 bp, Homo sapiens
ctgttgctcctgctgctgctgctgctgctgcattgtcaagactacattgatgtcttggaaatatagaaaaaagaggctgctggactgtgtgcttagaatcwgtgtgctaactctgttaccaacaccgtagagaagtggttccagaaggaagagttcagggtgagaatgaataacggagtggctttgcagtgggaacctggc

SEQ ID NO: 58818 - DNA, 201 bp, Homo sapiens
aggatagtttcccttcctggaagattgagatgaaataaagctttaggagttggtatcgcacgcaggcattaaatggattgtgaagagggactttgttcccsctcagtcttgtctctgcctccgtaaaggagtaagttaaaaaagaaagtttctttttttaaaaaaaagccttactgctcaataaatccctgtggaaaaaaa

SEQ ID NO: 58819 - DNA, 201 bp, Homo sapiens
tttgggttgatgagatgctggtatgtatcattcgttcagccattctttcagtaagtcatcacggaagtctgcctctgtgacagattctggggctctaaggmggaatttacttcttcaaagtacagtttcctgccttgcaagtttggagttaaggccacgcagaccagagttacgtgcacaggttgtaatactctctcttgt

SEQ ID NO: 58820 - DNA, 201 bp, Homo sapiens
gcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagaga

SEQ ID NO: 58821 - DNA, 201 bp, Homo sapiens
ttgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactgacccaaatcacacgtcacggctcttcgcccattaacgcttata

SEQ ID NO: 58822 - DNA, 201 bp, Homo sapiens
catcaatataagccccataaaaggcaaagtggttgaggagaaacgagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaa

SEQ ID NO: 58823 - DNA, 201 bp, Homo sapiens
ctcgtttttccttttttcttttcctttttttttttttttttttttttttttttttttgagatggagtctcactctgttgcccaggctggagtgcagtggcrcaatctcagctcactgcaacctctgcctcccgggttcaagtgattctcctgcctcagcctcccaagtagctgggactacaggtgcacaccaccatggctg

SEQ ID NO: 58824 - DNA, 201 bp, Homo sapiens
cacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggag

SEQ ID NO: 58825 - DNA, 201 bp, Homo sapiens
caatcacttactaactgcattgtgggttaacacagtgtgtgtgtgtgcacttactaactgtgcaactgtgggcaagtgatgtaatctctctggagctcgtytttccttttttcttttcctttttttttttttttttttttttttttttttttgagatggagtctcactctgttgcccaggctggagtgcagtggcgcaatc

SEQ ID NO: 58826 - DNA, 201 bp, Homo sapiens
aggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaatt

SEQ ID NO: 58827 - DNA, 201 bp, Homo sapiens
acagcttgcatgtgtagttaatttgttccaaatttccatcctgcattataaccctaatgtttgctaataacacacaaacccacattttattaagtaagtartttgagacatgatgatttttgtcatgtaaataggatcaggctgaccagtatagactgggcagaggaagattcataaccagggaattaatctctggatcca

SEQ ID NO: 58828 - DNA, 201 bp, Homo sapiens
ggctgcatagtattccatggtgtatatgtgccagccatcccgttactgggtgtatacccaaaggactataaatctttctgctataaagacacatgcacacrtatgtttattgcggcattattcacaatagcaaagacttggaaccaacccaaatgtccaacagtggtagactggattaagaaaatgtggcctttgcctctt

SEQ ID NO: 58829 - DNA, 201 bp, Homo sapiens
ctataaatctttctgctataaagacacatgcacacatatgtttattgcggcattattcacaatagcaaagacttggaaccaacccaaatgtccaacagtgrtagactggattaagaaaatgtggcctttgcctcttttaaaaagttctaagttgctagccagtcggaacaaatacagaatgtgaggtccctttccagccaa

SEQ ID NO: 58830 - DNA, 201 bp, Homo sapiens
aaagacttggaaccaacccaaatgtccaacagtggtagactggattaagaaaatgtggcctttgcctcttttaaaaagttctaagttgctagccagtcggracaaatacagaatgtgaggtccctttccagccaatggaaaccggacacagcagtagagtacacgtgtcaggttataaatgagcctgtctcctttgtccgg

SEQ ID NO: 58831 - DNA, 201 bp, Homo sapiens
ctcttttaaaaagttctaagttgctagccagtcggaacaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgct

SEQ ID NO: 58832 - DNA, 201 bp, Homo sapiens
tgctggcgagtgtaccctttctgcagaaagtaaaaatggccttgctgaggaaattaaattcctgttcgagtgctatttctttatggcactgaggagcaagyatttctaacaatcatattgcttaagaagtggatggcaagaagataattactaatatgtctgcaattgatctgaaattgacacagttgatctaactgattc

SEQ ID NO: 58833 - DNA, 201 bp, Homo sapiens
tgaatggaccctgagtatcttagaatcttctgaaataatatgcagcattatattccatttgtacctgggaagagggtacttgtctttcatcagagagtcaycaatggaccactggtccctgctgatttagtgtcacagctcaaaaccatcagtagtcctcgtgatctttcggcattgtggctccctttgtgagaagggcct

SEQ ID NO: 58834 - DNA, 201 bp, Homo sapiens
gtgaatctcccaaccataagctgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggc

SEQ ID NO: 58835 - DNA, 201 bp, Homo sapiens
cactgtactagttttctattgcttcataaacaaactatcacaggcatagtgagttggaatgatggctctcaaaaaactatgtccacatcctataaatgctrttgtacaatatatggtcttttgtgattggcctcctccacttagcgtcgtgtttttgaggttcagccacagttgtagcatgtccatctctctttgtgtggc

SEQ ID NO: 58836 - DNA, 201 bp, Homo sapiens
ttgttgtaaactcgtcctgccgcctggactagttacgcttcccttgattagctctgagaaacgaggcagcgggcactggggcagccacatagacaacatcyaaatttttgttgctttcctgggtcttgccctgtccttactgtttcccttgggcacgctgttcaccccttaggacatactacagtaaccttttcccaccac

SEQ ID NO: 58837 - DNA, 201 bp, Homo sapiens
tcttaatacaaactggcgtatgttatagttactgtcagttgttgtaaactcgtcctgccgcctggactagttacgcttcccttgattagctctgagaaacraggcagcgggcactggggcagccacatagacaacatctaaatttttgttgctttcctgggtcttgccctgtccttactgtttcccttgggcacgctgttc

SEQ ID NO: 58838 - DNA, 201 bp, Homo sapiens
cccatgtgtgtatgtctaacccagtgacaggtaaggcagccaggagctgctgttatttcagtgcaaagctgttttcacaatcacagacatgcacagctcaraaaccctcacaggtcacgcctgaataccttcaatgtgccccatgtaaaaatacactgcaagtcgattggacatgccctatgaattataccttatttatga

SEQ ID NO: 58839 - DNA, 201 bp, Homo sapiens
ctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatt

SEQ ID NO: 58840 - DNA, 201 bp, Homo sapiens
gcatgttaacatcctggtagctctatttatttgctaccatggtacataatcatgggagctctatttatttgaacatcttcttttgttattatttggtgtayttgggaaaggcatgtgggagcagcaagcaggtgagcatcctgtttggaatgcagggccgggaactgccctgcccagtccagcctcattccagaggctagc

SEQ ID NO: 58841 - DNA, 201 bp, Homo sapiens
atttgttatttttctcttcccccccttagctgtatccctgcatttattacagcgcaggtgcatcttgcttttgagtgctaactgagatgaaaggagtgagraaacgctctcttcttcttgcaggggagggctggcaaattcagtgaatgcagagtcggctgggagcctttcggctggaaagctcttcctctgatgagctgt

SEQ ID NO: 58842 - DNA, 201 bp, Homo sapiens
agctctctgcttctttggcagtctagtgctgtcacagaaggaaagctcactccatggaaaaggggggattgatttcttctctgagggcagaggctgatcartctaggctggtaggaatagatgtaacctcagaggaaacaatttgcattggcgaaagcaagtcaatggccatccccaaattcaaaaggacagggaagtgta

SEQ ID NO: 58843 - DNA, 201 bp, Homo sapiens
gtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaaaatat

SEQ ID NO: 58844 - DNA, 201 bp, Homo sapiens
ctcccctttccaatacatctctctctctctttctctctctctctctctctctctcacacacacaacacacacacacacacacagccaaatcagacaccaayataaactgtagagttaacattctttttccaccctcacactttttttagctccgatctgtgttcaatttctgcctgagagagtgatatattcatatattta

SEQ ID NO: 58845 - DNA, 201 bp, Homo sapiens
gagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcagg

SEQ ID NO: 58846 - DNA, 201 bp, Homo sapiens
taattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgcc

SEQ ID NO: 58847 - DNA, 201 bp, Homo sapiens
agctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgaagtctgctgctgtcagctctgtggtcgct

SEQ ID NO: 58848 - DNA, 201 bp, Homo sapiens
taacacctgcctccgtggtttgtcaggacatttagaaatgcagacttgctcaagacctggatctcaggtggtaggttggtccacagacagtggcaccactmgctattatttatttgttgtcactgtttgggacccctgttgctgtctcaccaaagaacttcttgtctcccttttagaagtttccagagcgtcttcctgatg

SEQ ID NO: 58849 - DNA, 201 bp, Homo sapiens
aacatggtgaaaccctgtctctactaaaaatacaaaattttttttgtattttgggattcggtttaggtgatgtgtgtctgtaatcccagctacttgggagrctgagacaggagaatcacttgaactccagaggcagaggttgtagtgagccaaacttgcacaactgaactccagcctgggcgacagaggaagactctgtct

SEQ ID NO: 58850 - DNA, 201 bp, Homo sapiens
aatttcatcactccaaaaagaaatctcataacaattagcagttattttccatcgctacttcctccagtcccaaggcaatcagcagtctgctttctatctcyacctgtttgcctattctggacatttcatatgagtggagttagataatacatggccttttgtgactggctttcacttagcataatgttctagaggttcatt

SEQ ID NO: 58851 - DNA, 201 bp, Homo sapiens
aggtggttggtttgtaattgttcctacctcttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctc

SEQ ID NO: 58852 - DNA, 201 bp, Homo sapiens
ataggaaggttatcctgggtgattagcatggatcagagttctcacaggagcccttcaaagcagaaggggaaggtggacaagagaatcggagagatgtggcrgagggtaggcagagagattgcaagcagggaaggatttcacgtactgccactggctttgaagatggagggggcacatggctagaaatatgggcggccctca

SEQ ID NO: 58853 - DNA, 201 bp, Homo sapiens
tggtattggtacaatcagtcaggaagcatttttcctggggagaaacttacaagtccacgatcaaagccaacaagagacaaggtgttacatgactcattttyggtttaagaagtgacaggctgattctaagttgggttcaattattttgttaaagcgttttgcttatttgacttctcctgacctcggaaataattctaacca

SEQ ID NO: 58854 - DNA, 201 bp, Homo sapiens
ttctcatgtacttactttaaatcagagagcccacctgtccaattctagcttctcctgggcatcctgtatttgacacagcccctcccagcattctgagtcaycgtctgctgctcttgcactgtccgttttccaaatgaggaactcatcggtaaggccagaaaggaaagggagaaaaaacaaacaaacaaacaaacaaaaaat

SEQ ID NO: 58855 - DNA, 201 bp, Homo sapiens
gtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatag

SEQ ID NO: 58856 - DNA, 201 bp, Homo sapiens
aaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccgttgtagattctgacatg

SEQ ID NO: 58857 - DNA, 201 bp, Homo sapiens
acaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccct

SEQ ID NO: 58858 - DNA, 201 bp, Homo sapiens
tgagatattgggactgttcttattcccatttcacagatgagccactaactggctcctggcaggacagtgaataaggggcacaacagagacacaaacacatsgctaaccaatggtctcatccgtcagccacactgcctgtctcagcatgggccctgtgtggaccattccatctcaatttgtttctgattcttgtcaattcaa

SEQ ID NO: 58859 - DNA, 201 bp, Homo sapiens
cttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttct

SEQ ID NO: 58860 - DNA, 201 bp, Homo sapiens
gcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcc

SEQ ID NO: 58861 - DNA, 201 bp, Homo sapiens
caaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagataca

SEQ ID NO: 58862 - DNA, 201 bp, Homo sapiens
atatactgcacatgtttttgtttttgtattttggttcaaaaagagagtatgatctcacttttcccttcttgataggttgtagattccatgtctaatccatscttttccaatattccctcctaatctttcagttgaattatggtctttagctcaaatgcatgacatgatgtgtgtgcctttggagtggggcggtattagtca

SEQ ID NO: 58863 - DNA, 201 bp, Homo sapiens
ttagatgctcttagttaaagaccatgcaaaaaggatgaaatcttttgatcatgttcttcacaatattagaggtaaaacatgaactcaacgcttttaggaaraaacaactggattgcgttttctattttattgacagaaactagatggggaggccagggtgtgttttattattgcacacatacgtaattacaaagtctttgc

SEQ ID NO: 58864 - DNA, 201 bp, Homo sapiens
ataagtaagtgggaagtccaggggtagacgtgagttcaggcatagctggatccaggatccgacagcttgcatgtgtagttaatttgttccaaatttccatmctgcattataaccctaatgtttgctaataacacacaaacccacattttattaagtaagtaatttgagacatgatgatttttgtcatgtaaataggatcag

SEQ ID NO: 58865 - DNA, 201 bp, Homo sapiens
aagctgtaccttaagtttatagttatgcaaatgaaaaccattaatcctggagcctctgacttgcaaggtgtgcttcagaaatttgcagcttctatttaggyaggaagagtttgccagcccgaaaactccagtaagcaaacagctttatagtaccccagccatagaaagtgagagctttcgaagaatctgtggttagaacta

SEQ ID NO: 58866 - DNA, 201 bp, Homo sapiens
aattatagctcaaatttaattaaaatagcttttattgcttctattcatgtgtccctggattttaagtgatgcgtcagaatttcatgatgagcaaatgcctrtggatgccctcatttctcatccttcttgactgtctgctaagattcactcttggtcttgtctttgagcttttctgttcagtgatgtaatgggacaggctct

SEQ ID NO: 58867 - DNA, 201 bp, Homo sapiens
aagtaccaaaacaaaacaagaaacccagaattatagctcaaatttaattaaaatagcttttattgcttctattcatgtgtccctggattttaagtgatgcrtcagaatttcatgatgagcaaatgcctatggatgccctcatttctcatccttcttgactgtctgctaagattcactcttggtcttgtctttgagcttttc

SEQ ID NO: 58868 - DNA, 201 bp, Homo sapiens
caggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaat

SEQ ID NO: 58869 - DNA, 201 bp, Homo sapiens
cttctctttatggatttccctttggaagcagggataagaagagggaaggtctcccagatgtaaatttctcataaatatttgagctccatttcagtaattcyttcattctctgatctgttgcctaatcttctatttagcaagtactttccatgaaatagaaggctttaattgatagaattactaatttgaatagcttagcac

SEQ ID NO: 58870 - DNA, 201 bp, Homo sapiens
agggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaaga

SEQ ID NO: 58871 - DNA, 201 bp, Homo sapiens
atagtgagttggaatgatggctctcaaaaaactatgtccacatcctataaatgctattgtacaatatatggtcttttgtgattggcctcctccacttagcrtcgtgtttttgaggttcagccacagttgtagcatgtccatctctctttgtgtggctgaatatcattgcattgtatggatataccaaatatttttctcctt

SEQ ID NO: 58872 - DNA, 201 bp, Homo sapiens
gggaatagatgaagcaagctgcttctttcaaatgctcttccaatatgaagcaaaatattattgatctagactgcctgctactttcatttaccatgttactrctcgtgggattacaggcacaaaggtttcataaatttcaaatgaaatatgaacatttgttgtcaaagtactgttaaggtatgaaaaccctgctagtattag

SEQ ID NO: 58873 - DNA, 201 bp, Homo sapiens
ttggatgcaattgcccccaaattatcgaagagaaaagaagaccactgtaattcaccggccatagcatttttaccaactgtttttgctaagcattagtttcktgtgataggttcaattctcaggctccttctcattagagtctttctgtaaagaccattattatttctgttatatttcctgtggctgagctgagccgcactt

SEQ ID NO: 58874 - DNA, 201 bp, Homo sapiens
aaaagaagaccactgtaattcaccggccatagcatttttaccaactgtttttgctaagcattagtttcttgtgataggttcaattctcaggctccttctcrttagagtctttctgtaaagaccattattatttctgttatatttcctgtggctgagctgagccgcacttggagatttgatccattttaactctctcattgc

SEQ ID NO: 58875 - DNA, 201 bp, Homo sapiens
aacctcagtttcctttgccacaaaatagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagc

SEQ ID NO: 58876 - DNA, 201 bp, Homo sapiens
aagaagaccactgtaattcaccggccatagcatttttaccaactgtttttgctaagcattagtttcttgtgataggttcaattctcaggctccttctcatyagagtctttctgtaaagaccattattatttctgttatatttcctgtggctgagctgagccgcacttggagatttgatccattttaactctctcattgcct

SEQ ID NO: 58877 - DNA, 201 bp, Homo sapiens
gaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttggttttaacaataatggtttttaaaaaccgtaggt

SEQ ID NO: 58878 - DNA, 201 bp, Homo sapiens
catttttaccaactgtttttgctaagcattagtttcttgtgataggttcaattctcaggctccttctcattagagtctttctgtaaagaccattattattkctgttatatttcctgtggctgagctgagccgcacttggagatttgatccattttaactctctcattgccttcagagagttggtgattttggggggggcac

SEQ ID NO: 58879 - DNA, 201 bp, Homo sapiens
cagcctgggcgatgagtgaaactccgtctcaaagaataaacaagaattgtgtctggcctttgtgatagttactcaacaaatcatatctgtgattgttttgrttttaacaataatggtttttaaaaaccgtaggtgatcacatactacgcagaaagggaagcagttacagcattcacagcatccgtgagtcatagactcact

SEQ ID NO: 58880 - DNA, 201 bp, Homo sapiens
tactcaacaaatcatatctgtgattgttttggttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctc

SEQ ID NO: 58881 - DNA, 201 bp, Homo sapiens
cccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctat

SEQ ID NO: 58882 - DNA, 201 bp, Homo sapiens
cactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgtggaactaatttttatactgccaatctgaggccttttctgacctcatcgctgcca

SEQ ID NO: 58883 - DNA, 201 bp, Homo sapiens
cctcacgagtagctgggatttcaggtgcctgccaccatgcctggctaattaagtgagtttcttaaagtcctacaactggtgagctgtgagctgtaaattgyggaactaatttttatactgccaatctgaggccttttctgacctcatcgctgccactgtaaaatgaattctagccccagaccatgacatgcctactagctt

SEQ ID NO: 58884 - DNA, 201 bp, Homo sapiens
tgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactatcatcaaactgtatatttacaatggttaaatcatatggtatgt

SEQ ID NO: 58885 - DNA, 201 bp, Homo sapiens
gatacagatttcactatccatgaattgtggccttaactttctcatgtacttactttaaatcagagagcccacctgtccaattctagcttctcctgggcatyctgtatttgacacagcccctcccagcattctgagtcatcgtctgctgctcttgcactgtccgttttccaaatgaggaactcatcggtaaggccagaaagg

SEQ ID NO: 58886 - DNA, 201 bp, Homo sapiens
gagtaaaagtcctttatgattagcaaattgcaggtcctcccctttctgatatttacagcccttgcaaccgcctgtacaaaaatcgggaaaaggcagaagasggctgtcattaatgtaaaagcagctggttacctccccctccccagcgcacacatcacctcctagtacaattagtcaccatgtcttttcccttccgtcaag

SEQ ID NO: 58887 - DNA, 201 bp, Homo sapiens
agctgaaactgaaccaggtgggggaggcctgctaatgcccaggcagtcgaaatgacgccatctcatcactccttctcttaaaatttttttttgtctttctycttggatttccagcaacagggagctgccaccaccgtgtactgtgctgctgtcccagaactggagggtctgggagggatgtacttcaacaactgctgccgc

SEQ ID NO: 58888 - DNA, 201 bp, Homo sapiens
tcactgtccaatatggtagccacgtgtgactattaaaatgtaaattaattaaaattaaaagttcaattgctctgaaatagcagccacatttcaaatcttcwgtagccagatgtggttattggctaccatattgggtagcaccgatatagaacatttctaccatagtagaatgctcttttggatacatctgctttaaagcat

SEQ ID NO: 58889 - DNA, 201 bp, Homo sapiens
agagtaaaagtcctttatgattagcaaattgcaggtcctcccctttctgatatttacagcccttgcaaccgcctgtacaaaaatcgggaaaaggcagaagmcggctgtcattaatgtaaaagcagctggttacctccccctccccagcgcacacatcacctcctagtacaattagtcaccatgtcttttcccttccgtcaa

SEQ ID NO: 58890 - DNA, 201 bp, Homo sapiens
atgcatgacctgtgcaatgcacctgcttcggtgcctggcacagagtcgcaaagccacaaagatggtgcttgttggttgtatgtgttgtttccatctgataycaccattgaggggagcaagatgacatgtgcctaccccacgtgtccagcagcaaagccacctggcatagtgggctgctcagcgtgcctggttcatactgcg

SEQ ID NO: 58891 - DNA, 201 bp, Homo sapiens
ataaaaataaaaagtcaaaaggaaacaaacaatgttgctgagaagtgatagaatattctagtttatatctcagtcattttacagctctggcatttctgggkaacactttagaatacttccactccggttggtccataaaaagctgcctgtgtttttatgttttgaaaatacacgcagagagacccactgcatgtcctatta

SEQ ID NO: 58892 - DNA, 201 bp, Homo sapiens
aaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaa

SEQ ID NO: 58893 - DNA, 201 bp, Homo sapiens
aaagagagtatgatctcacttttcccttcttgataggttgtagattccatgtctaatccatgcttttccaatattccctcctaatctttcagttgaattayggtctttagctcaaatgcatgacatgatgtgtgtgcctttggagtggggcggtattagtcagtcgatggttatttccttgaggagaaaggaaaggagaag

SEQ ID NO: 58894 - DNA, 201 bp, Homo sapiens
attttaagcaactgacccttgggataaaaataaaaagtcaaaaggaaacaaacaatgttgctgagaagtgatagaatattctagtttatatctcagtcatwttacagctctggcatttctgggtaacactttagaatacttccactccggttggtccataaaaagctgcctgtgtttttatgttttgaaaatacacgcaga

SEQ ID NO: 58895 - DNA, 201 bp, Homo sapiens
tctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagt

SEQ ID NO: 58896 - DNA, 201 bp, Homo sapiens
ctttcagttgaattatggtctttagctcaaatgcatgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaagggggttttttgccttgtcagc

SEQ ID NO: 58897 - DNA, 201 bp, Homo sapiens
aattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcc

SEQ ID NO: 58898 - DNA, 201 bp, Homo sapiens
gtaggacaatgagaagaggccagatgaggacagaatttttattttccattgccagtaacaaacacagccctaacttgcttagaccaaagatggggattgaytggcaactgggaagcctaagggtggatctggcgtggctggatctaagtgattaaatggcgcggtcataattctatttctctgcatctctcagctgtactt

SEQ ID NO: 58899 - DNA, 201 bp, Homo sapiens
ttcaccatgttggccatattggtcttgaactcctgacctcaagtgatcctcccgcctcagctgcccagggtgctgggatcacaggcgtgagccaccgtgcrcgacctcagggtcccttctaacctgtgctgttgtcataaaccctggaggagaagcaagatctttctagcaggagcaacatcatcccaaataaagtgatag

SEQ ID NO: 58900 - DNA, 201 bp, Homo sapiens
aacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttcctt

SEQ ID NO: 58901 - DNA, 201 bp, Homo sapiens
aatttttattttccattgccagtaacaaacacagccctaacttgcttagaccaaagatggggattgattggcaactgggaagcctaagggtggatctggcrtggctggatctaagtgattaaatggcgcggtcataattctatttctctgcatctctcagctgtacttccatctctgtaaacttcatttgcagacatggcc

SEQ ID NO: 58902 - DNA, 201 bp, Homo sapiens
gagcactggatacctagactctgctgggctctagagaagtgctgggctacagcgcccagtgccctacctcttggggccagccagcctcaccaaaaaatcasgcttctggcttgctccaaactcaggaagttgctgggaagtctggctagcaacaccctcattcccagtcctggccatgcctctctgctctccctagcacag

SEQ ID NO: 58903 - DNA, 201 bp, Homo sapiens
atgagtactcactctacttttttagtttatatttttattttagttcatttcatttaagacagcgtctgttacccaggctggagtgcagtgacatgatctcrgctcactgcaacctacaccttctgggttcaagtgattctgatgtctcagcctccccagtagctgggattacaggcatgtgccaccacaccggctaatttt

SEQ ID NO: 58904 - DNA, 201 bp, Homo sapiens
taagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgagga

SEQ ID NO: 58905 - DNA, 201 bp, Homo sapiens
gctccatcaatacccatcccaggagacagtggcagtcttgatgtcaatcttgttttaggatcattgccagtggaattcaggactgcggttctacccggtaycggggaaccaggtgagggggttaagaggcctgggcccatggaaggggtgagagagagccacatacttacagttgtgaagggggccagccaggatggtggc

SEQ ID NO: 58906 - DNA, 201 bp, Homo sapiens
agagaataaggtgttggtttgttataaggtggtcctttataaagtttagacctattttaataaggctgacttgggttgaagataactagagccatgacttycatcttgatggacaatgagtactcactctacttttttagtttatatttttattttagttcatttcatttaagacagcgtctgttacccaggctggagtgc

SEQ ID NO: 58907 - DNA, 201 bp, Homo sapiens
atgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtattttt

SEQ ID NO: 58908 - DNA, 201 bp, Homo sapiens
atccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagcc

SEQ ID NO: 58909 - DNA, 201 bp, Homo sapiens
cactggataggtaatagacgccggcatggctatgctgtggttcctgctgatgggcacactattacaggtgcatgataagtgtgtcgtacgcaggaagtacrtttcccccagccttccctacctgctgagggctgctcccagcctaaggatttcatccagatagattcatagcgcttccagtaaatgcaccccttgcctttc

SEQ ID NO: 58910 - DNA, 201 bp, Homo sapiens
ctgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcag

SEQ ID NO: 58911 - DNA, 201 bp, Homo sapiens
cctgctgatgggcacactattacaggtgcatgataagtgtgtcgtacgcaggaagtacgtttcccccagccttccctacctgctgagggctgctcccagcstaaggatttcatccagatagattcatagcgcttccagtaaatgcaccccttgcctttcaaagttgaaaaagaaattactttggacacaaagaggtgtttc

SEQ ID NO: 58912 - DNA, 201 bp, Homo sapiens
tcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttca

SEQ ID NO: 58913 - DNA, 201 bp, Homo sapiens
ctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagag

SEQ ID NO: 58914 - DNA, 201 bp, Homo sapiens
cgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggccaacatggtgaaaccc

SEQ ID NO: 58915 - DNA, 201 bp, Homo sapiens
tattgaattttggcccacaggaaaaggaaactttgctgttagggtcagctggaggagagactgcaggggtcagagatcagggccatatgctagagctgcartgtgggtgctcaaatgatgttcagtgcatcttcacagatggacctccacatgtccctcatgccctaaaatagatattctccacagctgcacatacaacaa

SEQ ID NO: 58916 - DNA, 201 bp, Homo sapiens
gtcttcgtaatatagctagtttttgtccattcattttgctttgacttccttgtataggtacaaaggtgtaagtaggagagtctaccaggcagcacacagaygtggccctgtaaccacccttgtgtaaaatcagagtaatcctccctatccttgcttatttcactgggttcatgggtgatgactgtaaatgacacaggagac

SEQ ID NO: 58917 - DNA, 201 bp, Homo sapiens
gatgaatactcagggttttttttttttttttttttcttctaacttgtcctccttgatcaggatttctcaaatgcacatttgtctaatatactgttgaaccrtgcaagtaccaaaacaaaacaagaaacccagaattatagctcaaatttaattaaaatagcttttattgcttctattcatgtgtccctggattttaagtga

SEQ ID NO: 58918 - DNA, 201 bp, Homo sapiens
cccagtgtgtcacgccattacatgcttacagcctatttttacaaagtttgaatattgtaatttgcctttaaaaaattgttttaaagatctgcctaggtcarcaaattttatttactctctagaaccatttgattggggtactgccttaagaaataaagcagattccttcagtcgcatgtgggcctggagtcactggaaaat

SEQ ID NO: 58919 - DNA, 201 bp, Homo sapiens
caaggtagaagacataggtggtcaagaatttagaaagacccggactcgaatcccagctctgatccatctcagctctgccatattgccaagttccgctgagrctccatttactcacctgttgtatcatctgaattatttccatatccataatgtgcaaggatatccttccatgttattagaaatacagatacaccatcatta

SEQ ID NO: 58920 - DNA, 201 bp, Homo sapiens
gtgccagtgggcagaaggttttgcaagaatagcttcaggaagactttgtgggaagacagatgaatactcagggttttttttttttttttttttcttctaayttgtcctccttgatcaggatttctcaaatgcacatttgtctaatatactgttgaaccatgcaagtaccaaaacaaaacaagaaacccagaattatagctc

SEQ ID NO: 58921 - DNA, 201 bp, Homo sapiens
tggttttaaaagacgccatggttgccatgaggaggacaatgcgtaggaggcaggagtgaaagctaaaggatatgctgggaggtgaccctggagttaaagaragcaactaaggtgaccaggtgacaataatggagatagagaaaacaggatggattcaggaaacatgaccacactgagcatattcaaatgtaattgtcagtt

SEQ ID NO: 58922 - DNA, 201 bp, Homo sapiens
tttgcttttaaatgcccgtgttgatttcttaatattttcaacttcctcttctgaagccagttccccccgaccatcagtcatgagtccgttcttttaacctygttcaggtggcgtggggcggtgtgtttggtggggagtgatgggtgcttgcctggaagtgcgagcaattgatcagctgatgaggggtatttattatctgtc

SEQ ID NO: 58923 - DNA, 201 bp, Homo sapiens
catttactcacctgttgtatcatctgaattatttccatatccataatgtgcaaggatatccttccatgttattagaaatacagatacaccatcattatcastggccaaatcattcaaatcgctgtttgcttcttctcgggctcttattcaagctcacgatgctattctcatagtgattgcgaatctcactgcataaaggtg

SEQ ID NO: 58924 - DNA, 201 bp, Homo sapiens
aactaaacaaaatgctaacccatatgggagaaatttccaaagaattaaaaccacccaccaggaaaatgggaaagtctcccctccacacacacacacacgcrcgcgcgcacacacacacacacacacacacacacacacaaaatcaccaaatcacacctgaacaagaggaagaaaattaaactcattgaggagataccatct

SEQ ID NO: 58925 - DNA, 201 bp, Homo sapiens
tgatcctattcgcatgataaaaatcataatgtctcaaattacttactcaataaaatgtgggtttgtctattattagtgattattagggttataatgcagcrtggaaatttggagcaaattaactatacatgcaagctgttgggctcaagtgcagttaatcatacgcatacagtgccagtgggcagaaggttttgcaagaat

SEQ ID NO: 58926 - DNA, 201 bp, Homo sapiens
ttcattgttgtccttttttattaaaacaggttttgtttttttgtgtgtgtgttattttgttttttgtttttttgtttttcgggggctggagtagtgtgcaragcctggcggtgattgttctcattagaaagtatagtgtaatactcaataaattacttttgttctcaccttgggaagtggactcagaggccaagtgacttt

SEQ ID NO: 58927 - DNA, 201 bp, Homo sapiens
aacttcctcttctgaagccagttccccccgaccatcagtcatgagtccgttcttttaaccttgttcaggtggcgtggggcggtgtgtttggtggggagtgmtgggtgcttgcctggaagtgcgagcaattgatcagctgatgaggggtatttattatctgtccctgactcccgagagaggaaataaatccttggaccccag

SEQ ID NO: 58928 - DNA, 201 bp, Homo sapiens
atctcactgcataaaggtgattttgaaaacatcacttttcctccacactaatgtgtgagcttagccagagtaggagatatatcttacttaaaaaaaaaaamaacaaacaaacaaaaaaaaaaaactccttcttcatttgttatagttccaggatagagtgtgtacctggatagagagagtcaggcagatataggtgtgccc

SEQ ID NO: 58929 - DNA, 201 bp, Homo sapiens
ctaaacaaaatgctaacccatatgggagaaatttccaaagaattaaaaccacccaccaggaaaatgggaaagtctcccctccacacacacacacacgcgcrcgcgcacacacacacacacacacacacacacacacaaaatcaccaaatcacacctgaacaagaggaagaaaattaaactcattgaggagataccatcttt

SEQ ID NO: 58930 - DNA, 201 bp, Homo sapiens
tcactgcataaaggtgattttgaaaacatcacttttcctccacactaatgtgtgagcttagccagagtaggagatatatcttacttaaaaaaaaaaaaaamaaacaaacaaaaaaaaaaaactccttcttcatttgttatagttccaggatagagtgtgtacctggatagagagagtcaggcagatataggtgtgccctcc

SEQ ID NO: 58931 - DNA, 201 bp, Homo sapiens
aaacaaaatgctaacccatatgggagaaatttccaaagaattaaaaccacccaccaggaaaatgggaaagtctcccctccacacacacacacacgcgcgcrcgcacacacacacacacacacacacacacacacaaaatcaccaaatcacacctgaacaagaggaagaaaattaaactcattgaggagataccatcttttt

SEQ ID NO: 58932 - DNA, 201 bp, Homo sapiens
aggtgattttgaaaacatcacttttcctccacactaatgtgtgagcttagccagagtaggagatatatcttacttaaaaaaaaaaaaaacaaacaaacaacaaaaaaaaactccttcttcatttgttatagttccaggatagagtgtgtacctggatagagagagtcaggcagatataggtgtgccctccttccaagatgt

SEQ ID NO: 58933 - DNA, 201 bp, Homo sapiens
tagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcaaataatgaccattaataatct

SEQ ID NO: 58934 - DNA, 201 bp, Homo sapiens
ctgcagaactgaggtgggccccaaaacttgcgtttctaaaaggtactagctgagcatgatgactcacatttgtaatcccaccactttgtgaggccgaggcsggtggatcgcttgaggccaggagtttgagaccagccttgccaacatggtgaaactccatctctactaaaaatataaaaatttgccgggtgtagtggtgca

SEQ ID NO: 58935 - DNA, 201 bp, Homo sapiens
gcttggaaggtggcgcaaataactgcttgaggctccctctcttgggccaagcttgactctggattttcattgttgtccttttttattaaaacaggttttgkttttttgtgtgtgtgttattttgttttttgtttttttgtttttcgggggctggagtagtgtgcagagcctggcggtgattgttctcattagaaagtatag

SEQ ID NO: 58936 - DNA, 201 bp, Homo sapiens
aaaaaaaaaaaaacaaacaaacaaaaaaaaaaaactccttcttcatttgttatagttccaggatagagtgtgtacctggatagagagagtcaggcagatayaggtgtgccctccttccaagatgtgtgatggtgggcaactttctttgcatctctgagcctctattttctctatataaaatgagagagaaaaaaataattc

SEQ ID NO: 58937 - DNA, 201 bp, Homo sapiens
catcgcccactctgatttagatgagcaagagctgctgagttgtagatttctagtttctaaacaacaataagtcttgcccccagatagcctcttagcagagycaaaagccagcagagagaagactcagcatttgctttggagtaagtttgtgtgtgtatgtttatctcccttttactcatgggctcttttttcccaaataac

SEQ ID NO: 58938 - DNA, 201 bp, Homo sapiens
gatgaatgtagtgagagaaggaaggaagagagagagggaagaaggggaaaaagagggatggaaaggaggaaggaaggaaaggagggaggaggcaagtatawtagtcatgatatagggaattgaaaagacattcacgttttgtggtgaatgaaaataacttgacctttatgaagctggcctaatccctggaaggaaaaaatt

SEQ ID NO: 58939 - DNA, 201 bp, Homo sapiens
actacaaatcattgatcaaagtattggtctgtcacctgtccatgtgtaaggccaggcctaagtgctctgacagggcatgactcaatcctcaaacaggaagsgggaaattgctttccatctcctaaccctaagatcctggatggcaggtaatctgcttcctcaagattctgttgatacacattcaggactctggtttctgtt

SEQ ID NO: 58940 - DNA, 201 bp, Homo sapiens
gagaaggaaggaagagagagagggaagaaggggaaaaagagggatggaaaggaggaaggaaggaaaggagggaggaggcaagtatattagtcatgatatakggaattgaaaagacattcacgttttgtggtgaatgaaaataacttgacctttatgaagctggcctaatccctggaaggaaaaaatttccttggatatgtg

SEQ ID NO: 58941 - DNA, 201 bp, Homo sapiens
caaagtattggtctgtcacctgtccatgtgtaaggccaggcctaagtgctctgacagggcatgactcaatcctcaaacaggaagggggaaattgctttccrtctcctaaccctaagatcctggatggcaggtaatctgcttcctcaagattctgttgatacacattcaggactctggtttctgttttgcttgatgacaatg

SEQ ID NO: 58942 - DNA, 201 bp, Homo sapiens
gggaagaaggggaaaaagagggatggaaaggaggaaggaaggaaaggagggaggaggcaagtatattagtcatgatatagggaattgaaaagacattcacrttttgtggtgaatgaaaataacttgacctttatgaagctggcctaatccctggaaggaaaaaatttccttggatatgtgatttatataatcaatcaacta

SEQ ID NO: 58943 - DNA, 201 bp, Homo sapiens
atacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttg

SEQ ID NO: 58944 - DNA, 201 bp, Homo sapiens
tattttagtagagacgggttttcaccgtgttgcccagggttgtctcgaactcctgagcttaggcagtctgcccacctcagcttcccaaagtgctaggattrtaggcatgagccaccatgcccggcctaatctaatcaattcctttaaatctgaaactgtccgcctgattctggtttaccacaaccaccagagtcttaagtg

SEQ ID NO: 58945 - DNA, 201 bp, Homo sapiens
aggcagtctgcccacctcagcttcccaaagtgctaggattataggcatgagccaccatgcccggcctaatctaatcaattcctttaaatctgaaactgtcygcctgattctggtttaccacaaccaccagagtcttaagtgtcccaatagccagggtctcatagactctgcttatggttaattcttctggggaaattaatt

SEQ ID NO: 58946 - DNA, 201 bp, Homo sapiens
gtgacaagatctccaaggagccagttcacgcttggatgactctggagctgtggtgacaatctaaatcctaaattgaggcttactaggaaatgcactaggtracaggctctagagaaatggctattaccaggttgctcaggctggagtgcagtagtgcaatctcagctcactgcaacctctgccttctgggttcaagcaatt

SEQ ID NO: 58947 - DNA, 201 bp, Homo sapiens
ctctagtctagggcacaaaatttctgtcaacccttctaaccagtgtttgaagtacgtaagacgttcatttccacttctaatgaggaattagaggaacggawttataaaggaattctggttataattgcatgtacttttagagacgatgtctaacagtgcaacccatagaaccaggctgcctggattcaaatcccagctctg

SEQ ID NO: 58948 - DNA, 201 bp, Homo sapiens
agtatagacacgtggcaccacgcctgggtaatttttgtagttttagtggagacaggatttcaccatgttggccaggctagtcttgaactcctgacctcaastgatagacccacctcagcctcccaaagtgctaggattacagacatgagccgacctttttatgtattgttgatacagtatgacaagggaagagttaactga

SEQ ID NO: 58949 - DNA, 201 bp, Homo sapiens
aagagactggagaaagccaatctgtttctccctgaaaatcatcttacttttttaacgcttcgtacctagatttggcctgggcagcccagggagactgttcragcactggatacctagactctgctgggctctagagaagtgctgggctacagcgcccagtgccctacctcttggggccagccagcctcaccaaaaaatcag

SEQ ID NO: 58950 - DNA, 201 bp, Homo sapiens
gcccatcccaaatgaattctaatcctcagcctctagaatgcctggagtgagaaaacagaatattgttcttttctgtttatattatttcatactgagttaayacacttgccaagactccgaggcagcttctggcttgacaatgccttctttaactagcctagtttctagaataaagttcgggtccaccaggccctctgagtg

SEQ ID NO: 58951 - DNA, 201 bp, Homo sapiens
tcgagttcttaatctgagcagtttcgaaaccaagcccacattaattaatataaataatgactgggaaacgttgcaggactccccggaaaagaatgtataarttgatgtgtttttgtatatgcttatgtatatgcctttgtgcacgaaaggagataaatggtgtatttcacacagttccttctcctcctctaagggatatta

SEQ ID NO: 58952 - DNA, 201 bp, Homo sapiens
cttaggcatccatgctcagggctctctgtggtaggcaacagctggattatttactttctagaatatctcgagttcttaatctgagcagtttcgaaaccaarcccacattaattaatataaataatgactgggaaacgttgcaggactccccggaaaagaatgtataagttgatgtgtttttgtatatgcttatgtatatgc

SEQ ID NO: 58953 - DNA, 201 bp, Homo sapiens
tgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccat

SEQ ID NO: 58954 - DNA, 201 bp, Homo sapiens
tatgctagagctgcaatgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagag

SEQ ID NO: 58955 - DNA, 201 bp, Homo sapiens
cagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggc

SEQ ID NO: 58956 - DNA, 201 bp, Homo sapiens
gagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaa

SEQ ID NO: 58957 - DNA, 201 bp, Homo sapiens
atcatattctcttcactgaaacatttcagatgacttaaaaattcaccttgtagaacttttaaaattgaaactttctggtgaacatcattagttgacagatrtgtcattgaagtttcatccttcttcatttcagagtctgctggaagacccttcatttaccactctctccttcctggaggtgtggaaatactctacctgggt

SEQ ID NO: 58958 - DNA, 201 bp, Homo sapiens
tataagcaatagtccctgaacatcatttggcctgaactaggctagagtttctcttaatcaaaataataacgatgatttttccatgccaaggagtggtgtcrtatcatgaagtagatttatgtacacattaaataaacttttacattttaatgtaccaatttgcaatttttttttctattcaccaaaatattccagataacg

SEQ ID NO: 58959 - DNA, 201 bp, Homo sapiens
catattctcttcactgaaacatttcagatgacttaaaaattcaccttgtagaacttttaaaattgaaactttctggtgaacatcattagttgacagatatrtcattgaagtttcatccttcttcatttcagagtctgctggaagacccttcatttaccactctctccttcctggaggtgtggaaatactctacctgggtga

SEQ ID NO: 58960 - DNA, 201 bp, Homo sapiens
cccaaagtgctgagattacatgcatgagccaccatgcctggcctctggccttcttttcactttagaaaaaaacaaaaaacaaaaaacaaaaaaaaacacamaaaaaacttttttttttagaactgttttagtttgggagccaaaattgagcagaaagtacagagagttcccgtatacctccggcagagccctggctcacta

SEQ ID NO: 58961 - DNA, 201 bp, Homo sapiens
caaatggggaacagtcctgtgcagtgtttctaggaagttaccagcttcatcataggaagacgttctccatcgtttggatctttttcaccagcaccttttgrttgtggtggtttgggatgtgatgatctcagaactttacatcctccatgaaatctctgcagcgatagttgaatgtcttgccttttctattattgccctttt

SEQ ID NO: 58962 - DNA, 201 bp, Homo sapiens
ttcaccttgtagaacttttaaaattgaaactttctggtgaacatcattagttgacagatatgtcattgaagtttcatccttcttcatttcagagtctgctrgaagacccttcatttaccactctctccttcctggaggtgtggaaatactctacctgggtgaggctctcgtggctttttgtgccaagtgtccgtaaacttc

SEQ ID NO: 58963 - DNA, 201 bp, Homo sapiens
atgcctggcctctggccttcttttcactttagaaaaaaacaaaaaacaaaaaacaaaaaaaaacacaaaaaaaacttttttttttagaactgttttagttkgggagccaaaattgagcagaaagtacagagagttcccgtatacctccggcagagccctggctcactatctacatccccactagatccatgtatttgttta

SEQ ID NO: 58964 - DNA, 201 bp, Homo sapiens
gaagtgggcgtcgtgatgccagtgtcttcgtaatactatctttctttcccctttagcacccagaacttatgaaatatgactcggtttatcctgaacacatstctgtgcatcagggaggatgggagaattaattccagtttctcaattgcaaaagtgaggctggtcatggggcttggaaccacgccacggacgcatgaagcc

SEQ ID NO: 58965 - DNA, 201 bp, Homo sapiens
tgaataccttttgctttctataaaatggtgtggcattgctggtattttcactcttccttcctaccctggatgctgatttgatgcttccagccttagcggtyttcttgcttctaggactgaacagggaagagggaaaagtcaaaagaatgacagaaggtcctcacgttgcagaacactgaccaatgttggcaactacaagac

SEQ ID NO: 58966 - DNA, 201 bp, Homo sapiens
gggggcctggaaggggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgttcttaatcattaccttcacctggaggga

SEQ ID NO: 58967 - DNA, 201 bp, Homo sapiens
tctgtagcttcttccagcatgtgatcatacatctacctaacctctcccattggttgaatttaatatactagtgaattttccattgcaaagatgaggttacraatcatagtgttcatactcagaaggactttataaatattttgcctttttgaagtatatacaagaaatgaaaaaaaaaacaggaataaataaaaagaataa

SEQ ID NO: 58968 - DNA, 201 bp, Homo sapiens
atcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtagggg

SEQ ID NO: 58969 - DNA, 201 bp, Homo sapiens
gattccagcattttgggaggccaaggtggacggatcaccagagttcaggagtttgagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcag

SEQ ID NO: 58970 - DNA, 201 bp, Homo sapiens
tgctctcatttcattttcactgaactgaaaataaggtaacagaccctcaggtctacctataagtaccttccaactgttccacttttgtaaatttagttcarataatacatatgctgaaattcctatatcccccccatactccagatcttcagtgtggaatttaaatataattccttattgtaaaaaaaaaaaatttttttt

SEQ ID NO: 58971 - DNA, 201 bp, Homo sapiens
ctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttattgggtacat

SEQ ID NO: 58972 - DNA, 201 bp, Homo sapiens
cccaggctggagtgcagtggcatgaccatggctcactgcagcctcgacctctggggctcaagcgatccttctgcaacagcctccctagtagctgggactayaggtgcatgccaccacacccagctaatttttatattttttgtagagatggggttttaccatgttgcctaggctggtctcgatctcctgggctctagcaat

SEQ ID NO: 58973 - DNA, 201 bp, Homo sapiens
gaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatt

SEQ ID NO: 58974 - DNA, 201 bp, Homo sapiens
tctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaaca

SEQ ID NO: 58975 - DNA, 201 bp, Homo sapiens
tcgacctctggggctcaagcgatccttctgcaacagcctccctagtagctgggactacaggtgcatgccaccacacccagctaatttttatattttttgtrgagatggggttttaccatgttgcctaggctggtctcgatctcctgggctctagcaatcctcccacctcggcctcccaaagtgttgggattacaggcgtga

SEQ ID NO: 58976 - DNA, 201 bp, Homo sapiens
ctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgac

SEQ ID NO: 58977 - DNA, 201 bp, Homo sapiens
gctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcaga

SEQ ID NO: 58978 - DNA, 201 bp, Homo sapiens
attcataactcagtcacgttactgaggtatgtctcttcggatagattctatctctaaaaactacagattctatctctaaaaacttaagtcaagggattttsaagcagttgtttgatttatgtatgtgaacctctcccttaggagaagaacttttctttggcaaacaccataggaacggagaccttaacaaaagaattagga

SEQ ID NO: 58979 - DNA, 201 bp, Homo sapiens
agtgcacctgaccctaggataatcttaattttaagtaactggtaactcataaatttttaaacactctgcagttcaaagaaaacatgtttgtggtaggtagycagtttataacctgtgtaagactgtgttattagcaaatccctcaatgtgttgaccaagagtgggtaggaatcctgcagacagaatcttttgaaggtggtt

SEQ ID NO: 58980 - DNA, 201 bp, Homo sapiens
tggacaagaggtcacattgccttttctagcttggaaggtggcgcaaataactgcttgaggctccctctcttgggccaagcttgactctggattttcattgktgtccttttttattaaaacaggttttgtttttttgtgtgtgtgttattttgttttttgtttttttgtttttcgggggctggagtagtgtgcagagcctgg

SEQ ID NO: 58981 - DNA, 201 bp, Homo sapiens
cccggccttacgtttcagcatctttcaatccatctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacat

SEQ ID NO: 58982 - DNA, 201 bp, Homo sapiens
accccatctctattaaaaatacataaattagtcgggcatggtggcatgtgcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaag

SEQ ID NO: 58983 - DNA, 201 bp, Homo sapiens
aaagtactctctatggagaggttttatggttctgaaataatttaaaaacacactttactacaatccatagcaggtagttttgccaatttgggaagttatgktgccttgcagtttccaaagtaagctgaacagtgttttttaacagtgctgcccctctctcccactagaaatgcgagtccatccttttaccaagtgtggtac

SEQ ID NO: 58984 - DNA, 201 bp, Homo sapiens
ttccttttgagcccagctctccctttgtgacccagcaacttccttccccgatgatggccaagccttgaggatgtgaaactgcccagtgccccaatctggartccaccatcctgggtctagctggggacatccttgaatcagcctctgggaatcactgaaccaacatgagtcacttgctactgtgagatctcagaacacatg

SEQ ID NO: 58985 - DNA, 201 bp, Homo sapiens
tgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaa

SEQ ID NO: 58986 - DNA, 201 bp, Homo sapiens
gttattagcaaatccctcaatgtgttgaccaagagtgggtaggaatcctgcagacagaatcttttgaaggtggtttgtttttttattcctttataagtacwgttgtagatttacaaagtaattgagtatatagtacataaggtcttgtgtacccaccgatcgcaattgagcatatagtacatgctgtcctgtgtacccact

SEQ ID NO: 58987 - DNA, 201 bp, Homo sapiens
ttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtgtgtaaaattcaaatttcaatgaagattgtgtattt

SEQ ID NO: 58988 - DNA, 201 bp, Homo sapiens
tgggtttactcaccgtatctgtgtgcatcctggcaatgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtac

SEQ ID NO: 58989 - DNA, 201 bp, Homo sapiens
aggcctgagcaaaagacacagaaaggatttctttatcgtaagcacacttctctacattacctttataatccaacaactctgctattagtaaattatagaamcaacttttgtaacactatcttgtttgcagagtatatgaaaaatttgaagttaaaattcagctccacgaatactgcagtggtgagaaaatggcgacaaaga

SEQ ID NO: 58990 - DNA, 201 bp, Homo sapiens
taggccaagaaaggggtgggagaaacgagcaaggtgttgatagaaccccttagtgtcctcctcataccacagacactctcttcccccacttacttggccawttttttttttttttttttttttttttggtggagtctcgttctgtctcccaggctggagtgcaatggtgcgatctcagctccctgcaacctctgcctccca

SEQ ID NO: 58991 - DNA, 201 bp, Homo sapiens
gaaatctctagcttctcaaactgtttcgtggtggagtgccttttgggcacaggagaaggaaataagagcctcgcgaggtttgggaatgctgcctctagctytcacactgcatgcagaattcctactctgagagctcactttatctcaaaaacccatgcatattctgcatctactctgaattccgcagtgttgtgtgttact

SEQ ID NO: 58992 - DNA, 201 bp, Homo sapiens
tactcctctccgtacactttggacatgtcaaaatctagaaatagagatcagtaaaggtaacacatagcaccttaaatctgatttaaaaggaaaacaatgaytattatacagatttatggcttcttgtcaataatactctgatttctggagattgttatcagtcataagctttataggaaatatctccttttgaaaatgaca

SEQ ID NO: 58993 - DNA, 201 bp, Homo sapiens
cacgaacaaattgccaaatgcaaggcctgagcaaaagacacagaaaggatttctttatcgtaagcacacttctctacattacctttataatccaacaactytgctattagtaaattatagaaacaacttttgtaacactatcttgtttgcagagtatatgaaaaatttgaagttaaaattcagctccacgaatactgcagt

SEQ ID NO: 58994 - DNA, 201 bp, Homo sapiens
tgcactcctgtctgggagacagagggaggagactccatcaacactaataataataaagtaaataaaagggcactaaccctactcaggaagccttcactctmatgacataattacctcccaaagtccgcacttcctaatgttaccactctggaggttagaatttcaacatataaattttggggggacacattcagaccacaa

SEQ ID NO: 58995 - DNA, 201 bp, Homo sapiens
gtgtcatacagcagagggctgtgatgctctactgaggagtggaagtgtttttctgagggcatcaaacacgccgtcaagcagggaggcaacaaatctgagtygttccacagatactttgagtgcagtacaagttggtaatgggtaacaggctaaaccatgtggcaccccttccctcttatcagcttcttgctaccatgcaga

SEQ ID NO: 58996 - DNA, 201 bp, Homo sapiens
tccgtacactttggacatgtcaaaatctagaaatagagatcagtaaaggtaacacatagcaccttaaatctgatttaaaaggaaaacaatgactattatasagatttatggcttcttgtcaataatactctgatttctggagattgttatcagtcataagctttataggaaatatctccttttgaaaatgacattttaaat

SEQ ID NO: 58997 - DNA, 201 bp, Homo sapiens
tcccatcacgaacaaattgccaaatgcaaggcctgagcaaaagacacagaaaggatttctttatcgtaagcacacttctctacattacctttataatccamcaactctgctattagtaaattatagaaacaacttttgtaacactatcttgtttgcagagtatatgaaaaatttgaagttaaaattcagctccacgaatac

SEQ ID NO: 58998 - DNA, 201 bp, Homo sapiens
ggaaaacaatgactattatacagatttatggcttcttgtcaataatactctgatttctggagattgttatcagtcataagctttataggaaatatctcctwttgaaaatgacattttaaattaatgtgaaattgtgttttaatttaattcacagggagtcataaacaggtgggagaattatggaacaataattgtgtttgc

SEQ ID NO: 58999 - DNA, 201 bp, Homo sapiens
acaatgactattatacagatttatggcttcttgtcaataatactctgatttctggagattgttatcagtcataagctttataggaaatatctccttttgamaatgacattttaaattaatgtgaaattgtgttttaatttaattcacagggagtcataaacaggtgggagaattatggaacaataattgtgtttgcaagaa

SEQ ID NO: 59000 - DNA, 201 bp, Homo sapiens
ggtctcccaccctctcttatttttataaacaggctccatggtactatatacactgcagatggacagctgccaacctgctctttttgtgctgaggaactctrgatatttcaactagtttacatgactttcttacctatgctaccttataatccttttataaattttgctttacgttttaacaacggaaaacacttaaggttt

SEQ ID NO: 59001 - DNA, 201 bp, Homo sapiens
ttataggaaatatctccttttgaaaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaa

SEQ ID NO: 59002 - DNA, 201 bp, Homo sapiens
catggtactatatacactgcagatggacagctgccaacctgctctttttgtgctgaggaactctggatatttcaactagtttacatgactttcttacctaygctaccttataatccttttataaattttgctttacgttttaacaacggaaaacacttaaggtttttttcctttcttttttttttaattcttccgccagct

SEQ ID NO: 59003 - DNA, 201 bp, Homo sapiens
tgtacaaagctgataaataactgaaaccaaattagctcaaactggttatatttctgggtacaaaccaggtgtatagttaatccattgttgtttctgtgtcraccaccattgtcctcacctatacttgggcagtgggggtggggaggagaacataaaaacccaccaagcctcatttttcttgctaatttatttccttgaact

SEQ ID NO: 59004 - DNA, 201 bp, Homo sapiens
tcccatttcaggctgattaaaaggcaaaatcttcacagtaggacaccaaaccctctgtatgccctgcctgcctccccccctctgacccgcctgcctccccvctgtgagctttttccacctactggcctcttgttcttcttcagctgttcctcagacatgccaggtgtgttcctgtctcagacgctttgcctttgctgctcc

SEQ ID NO: 59005 - DNA, 201 bp, Homo sapiens
gcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgcccgtgctttctgatgcc

SEQ ID NO: 59006 - DNA, 201 bp, Homo sapiens
tcttcttcagctgttcctcagacatgccaggtgtgttcctgtctcagacgctttgcctttgctgctccttctgcctggagtattcttccacgtagcaccaygagctgttcttctccaaaaggctttgctcaactgacactttctcagtgaagctgtttctcaccactcactataaaatggcagcctgcctctctgagcctt

SEQ ID NO: 59007 - DNA, 201 bp, Homo sapiens
tggccatggtgctcacagtctctcaatcctttatgttgagggagaaatgataaccagatctcattttgtgtgccaacccgaaagcctgacttgactgcctmaaatgttaggaaggactctaaagccctatctggattccaaatttatggttggtgcagactggatttttacaatttgtgcttagtagtatcttattatatt

SEQ ID NO: 59008 - DNA, 201 bp, Homo sapiens
cataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccaga

SEQ ID NO: 59009 - DNA, 201 bp, Homo sapiens
tttataggctctagcaggtcccttctctttgcgtcaccagagaggaagatcccctaagacaaagcattccctgtagtttttagcataactagtactggctsagtaagtatccactggggttcggaatacaactgccctgcctcttgagcagccatgcctgcttccgaggtggtgctgcatgctattcaggaggacagacca

SEQ ID NO: 59010 - DNA, 201 bp, Homo sapiens
ttttagcataactagtactggctcagtaagtatccactggggttcggaatacaactgccctgcctcttgagcagccatgcctgcttccgaggtggtgctgmatgctattcaggaggacagaccatggatgggaatcctgagccacaactccttagcctcatgacgttgggcagatgactgagcttgtctgagttacaataa

SEQ ID NO: 59011 - DNA, 201 bp, Homo sapiens
cggaatacaactgccctgcctcttgagcagccatgcctgcttccgaggtggtgctgcatgctattcaggaggacagaccatggatgggaatcctgagccasaactccttagcctcatgacgttgggcagatgactgagcttgtctgagttacaataaataaaaataccatgctgaatgatggcctagcatgacattgggaa

SEQ ID NO: 59012 - DNA, 201 bp, Homo sapiens
tgctattcaggaggacagaccatggatgggaatcctgagccacaactccttagcctcatgacgttgggcagatgactgagcttgtctgagttacaataaayaaaaataccatgctgaatgatggcctagcatgacattgggaagtacagactttgcaggcaggcccctgggttcaattcctgcccctgtcattgagtaaag

SEQ ID NO: 59013 - DNA, 201 bp, Homo sapiens
gcacctgcatgttgtaaaaacacaaaataaaaaaaaaataaataaaagcagaccccttggttcagatatctttgtttgtgtaaatgttttggcattctttrtgaaaatcttcagattttcaagagcttaagatgacctcctctagccggctgcagcagtgtctaggtatctgtgaatgtgtaagaaattgagacagcctgc

SEQ ID NO: 59014 - DNA, 201 bp, Homo sapiens
cgctgccattcagttttactctgcacaaaatacagccaacatttttgcatttctttcttccttcctccttttcttctttctttccttccttccttcctttytcccttcatctatctttgttccgcttttgtttgtttttttttagatcgctgcatgctgccgcgttgggttaaccatggtagcattttaccatgagaagcc

SEQ ID NO: 59015 - DNA, 201 bp, Homo sapiens
taaattgaattattcccgctgccattcagttttactctgcacaaaatacagccaacatttttgcatttctttcttccttcctccttttcttctttctttcyttccttccttcctttctcccttcatctatctttgttccgcttttgtttgtttttttttagatcgctgcatgctgccgcgttgggttaaccatggtagcat

SEQ ID NO: 59016 - DNA, 201 bp, Homo sapiens
attctccatgccactccttatctctttagtgcagaaaacggagaggaggttcagtattcttaagaaactcccatgattgctttgaggcaatggatttaacrggtatctttatcccttatttacgcactgactgtggtactgagtcatccctggtgtttctggattttattggcaatgccaagagagcaggaagactgggac

SEQ ID NO: 59017 - DNA, 201 bp, Homo sapiens
aatttaaaaacacactttactacaatccatagcaggtagttttgccaatttgggaagttatggtgccttgcagtttccaaagtaagctgaacagtgttttytaacagtgctgcccctctctcccactagaaatgcgagtccatccttttaccaagtgtggtacgacaaaggtttctctggttttcttttggtattctcaga

SEQ ID NO: 59018 - DNA, 201 bp, Homo sapiens
ccttccaacatctagcattattgtgtgttgaataaatacttgttcgattaggtctaatcactcttcatgattggatttccaaaatgtggactctcagcagkacattacagggacagtggttgggtctggagatgtcacccttagctgtttttcacaatgagaggttgttttatcataaataaatcaataaatggcagatta

SEQ ID NO: 59019 - DNA, 201 bp, Homo sapiens
caggcacgccaccacacctggctaatttttgtatttttagtagagatgggggtttcaccatgtgggccaggctggtcttgaactcctgacctcaggtgatygacctacctcggcctcccaaagtgctgggattacagtcatgagtcaccatgcccgaccagcaagaccccactgctattgtccagtgtggtaggtaccttt

SEQ ID NO: 59020 - DNA, 201 bp, Homo sapiens
aatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttttcattgttaacgtggcatcggagtag

SEQ ID NO: 59021 - DNA, 201 bp, Homo sapiens
tggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccaaagggtgag

SEQ ID NO: 59022 - DNA, 201 bp, Homo sapiens
tctgttggctgcataaatgtcttcttttgagaagtgtctgatcatatccttcgcccacttgggtggatgaagctggaaaccatcattctcagcaaactgtygcaaggacaaaaaaccaaacaccgcatgttctcactcataggtgggaattgaacaatgagaacagttggacacaggaaggggaacatcacacaccggggc

SEQ ID NO: 59023 - DNA, 201 bp, Homo sapiens
attgtttgtttaaaatcactttggattctcatttaccttttccccctcaagatctttgtttttgactttggagataaccagaaataactaagcatgcttcsttccctctacgatttcatcctcatggggaagcaagaccccactcttttattttcatgtatgtatatatgtatgtatgcatgtatgtatgtatgtttgaga

SEQ ID NO: 59024 - DNA, 201 bp, Homo sapiens
taattgtgtagctttgcctttccttagttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattattatcaattgcctctct

SEQ ID NO: 59025 - DNA, 201 bp, Homo sapiens
taacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccag

SEQ ID NO: 59026 - DNA, 201 bp, Homo sapiens
tctgatggccagtgatgatgagcattgtttcatgtgtctgttggctgcataaatgtcttcttttgagaagtgtctgatcatatccttcgcccacttgggtsgatgaagctggaaaccatcattctcagcaaactgttgcaaggacaaaaaaccaaacaccgcatgttctcactcataggtgggaattgaacaatgagaaca

SEQ ID NO: 59027 - DNA, 201 bp, Homo sapiens
cactttaaacattgcatccttgagttgcatatgatgggatctcttgaatcatttacattttgaaaaaagaaagtgaaatattctttaagaagccaaagtamtccacgagaatgtatggtgtttgttcagctggatatcttatttatttgaagtactgagagagaaatcttttctgactgctcaaaacagggaataataaac

SEQ ID NO: 59028 - DNA, 201 bp, Homo sapiens
gaaattgtctctaccttcaaggttctcacagtctggagggaacagagagccatcagggacaataggtccctgtgccatcagctactgggatgtatgacttyccagtagaggtacacagcacttgttccaaaaggagcctatgtagctttgggagttctctatttagtcaccttattttttttgtcttcttgttaaactagc

SEQ ID NO: 59029 - DNA, 201 bp, Homo sapiens
ttgtctttatggtgtttttcattgttaacgtggcatcggagtagctcgacttttgcatcatgataaattcataacccaagagaaggcagaaaacataattrttatcaattgcctctctcctggaattgccattggctgagtggaacaaaatacgaacttaaggagtagctgattcagagaaatccagggtaggaacgggtc

SEQ ID NO: 59030 - DNA, 201 bp, Homo sapiens
caaagaattgtagttggatcaaatgagttggagtgggatacagcaacaatctatattctgatttcagcaacactgtgcagtgtaattccatattatattayaccacatcttctgtgggtctttctttgggggaagctaacattttaaaaggtttccctttgtaacctgtaaccccctctaccccaaaagtatattcaagag

SEQ ID NO: 59031 - DNA, 201 bp, Homo sapiens
aggctagccaatcatttcaaagcctgtgtagaatatctagactatatgtaatcctaggatttgttgttgttttgttatgattttttttaagcaggaagctwaaaaaaataaccacccgttactttgctgcttttagaaaataggtttgagattgattttgaatactaaagtatagttttcatgttataaagccaaccatgt

SEQ ID NO: 59032 - DNA, 201 bp, Homo sapiens
aaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgca

SEQ ID NO: 59033 - DNA, 201 bp, Homo sapiens
tctttatggtgtttttcattgttaacgtggcatcggagtagctcgacttttgcatcatgataaattcataacccaagagaaggcagaaaacataattattrtcaattgcctctctcctggaattgccattggctgagtggaacaaaatacgaacttaaggagtagctgattcagagaaatccagggtaggaacgggtccca

SEQ ID NO: 59034 - DNA, 201 bp, Homo sapiens
aaaaactagccagaaagcgtgaactttttttttttttaagccataaagcttggtaaggctagccaatcatttcaaagcctgtgtagaatatctagactatwtgtaatcctaggatttgttgttgttttgttatgattttttttaagcaggaagctaaaaaaaataaccacccgttactttgctgcttttagaaaataggtt

SEQ ID NO: 59035 - DNA, 201 bp, Homo sapiens
atagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaat

SEQ ID NO: 59036 - DNA, 201 bp, Homo sapiens
gcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagt

SEQ ID NO: 59037 - DNA, 201 bp, Homo sapiens
tggccatggaattgagaagcaggagcatggctcacaaattcacaaatcagcttctccactaatgaggggtgaggaagttaaaatatagactttgttgttgktgctgttttaatgaagaggctggacattaaaatcaaggggaggaataatcatgtcttctcttgaaatgggcagtgaacttcccggaaccagagtgttgcc

SEQ ID NO: 59038 - DNA, 201 bp, Homo sapiens
ttcttttcttttcttttctttttttttaagatggagtctcgctctgtcaccgggctggagtgcagtggtgctatttcggctaactgcaatctctgcctccygggttcaagcaattctcctgcctcagcctcccaagttgctgggactacaggcgtgcgccaccatgcccagctaatttgtaattgtttgtttctaaaagga

SEQ ID NO: 59039 - DNA, 201 bp, Homo sapiens
ttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatctta

SEQ ID NO: 59040 - DNA, 201 bp, Homo sapiens
tctgtcaccgggctggagtgcagtggtgctatttcggctaactgcaatctctgcctcccgggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaa

SEQ ID NO: 59041 - DNA, 201 bp, Homo sapiens
tggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatggg

SEQ ID NO: 59042 - DNA, 201 bp, Homo sapiens
gttttttccattttaagatacagaaagtgggccttaaaggtgctactgacttgctgatatgctttggctgtgtccccacccaaatcttaacttgaatcgtrtctcccagaattcccacgtgttgtgggagggacccagggagaggtaattgaatcatgggggctggtgtttcccatgttattcttatgaaagtgaataagt

SEQ ID NO: 59043 - DNA, 201 bp, Homo sapiens
gctgttcttaactctgaaagcagagtgggccatttgaatgctcactttgatattttttaaaggaaaaatttgaggcattgacacatgccttttgcttactygcttggattggtttgatcaactttgttgcggtctaatttatgtaaaataaattgcatccatttaaatatacaattcaatgagttttgacagatgcacatg

SEQ ID NO: 59044 - DNA, 201 bp, Homo sapiens
cgatctcggctcattgcaagctccgcctcccgggttcatgccattcttctgcctcagcctcccgagtagctgggactacaggcgcctgccactacacctgkctaatttttttgtagttttagtagagatggggtttcaccgtgttagccaggatggtctagatctcctgacctggtgatccgcctgtcttggcctcccaaa

SEQ ID NO: 59045 - DNA, 201 bp, Homo sapiens
actatgtaaaaccaaacaaattattagctttcttactgtgtgtttgcatttgctgtgcccagggaaatgggaagtgcattgaggaagaggccccaagacawggagaagtcactccaactttccgggaacaccttttgctgtgccatgtgcatggaaggagaggaatgaatgactgttgaagccagatggccttgctcattg

SEQ ID NO: 59046 - DNA, 201 bp, Homo sapiens
ggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctt

SEQ ID NO: 59047 - DNA, 201 bp, Homo sapiens
cctcccgggttcatgccattcttctgcctcagcctcccgagtagctgggactacaggcgcctgccactacacctggctaatttttttgtagttttagtagrgatggggtttcaccgtgttagccaggatggtctagatctcctgacctggtgatccgcctgtcttggcctcccaaagtgctaggattacaggcgtgagcca

SEQ ID NO: 59048 - DNA, 201 bp, Homo sapiens
agctttcttactgtgtgtttgcatttgctgtgcccagggaaatgggaagtgcattgaggaagaggccccaagacaaggagaagtcactccaactttccggraacaccttttgctgtgccatgtgcatggaaggagaggaatgaatgactgttgaagccagatggccttgctcattgattctctcctttcccgccctctcaa

SEQ ID NO: 59049 - DNA, 201 bp, Homo sapiens
cctcctaatactgcatgacggataatatgccatcacatggtgtcatttaatatattcattcctatttatagacattgaagttagatccatgtcttactatyacacatgacttagtaatgaatgttcctgcatgtatatttggtctgcttgagcaaggatattgggagggaggatttccagcagcagaagtggtggaacaaa

SEQ ID NO: 59050 - DNA, 201 bp, Homo sapiens
ttcttactgtgtgtttgcatttgctgtgcccagggaaatgggaagtgcattgaggaagaggccccaagacaaggagaagtcactccaactttccgggaacmccttttgctgtgccatgtgcatggaaggagaggaatgaatgactgttgaagccagatggccttgctcattgattctctcctttcccgccctctcaagcca

SEQ ID NO: 59051 - DNA, 201 bp, Homo sapiens
tgttgtgggcttggggaaacagaaggaaattggagacattgatatgcttcctgagaggtggaaggggccacttaacacagctttcatttttcagttgccartgggagaggagctggggtgggcatataatgagtaacattcaaagctccttctgtctttttttcagagaattcacaaaacaactcagggcctcctggtcct

SEQ ID NO: 59052 - DNA, 201 bp, Homo sapiens
tgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattg

SEQ ID NO: 59053 - DNA, 201 bp, Homo sapiens
tgctcacagtctctcaatcctttatgttgagggagaaatgataaccagatctcattttgtgtgccaacccgaaagcctgacttgactgcctaaaatgttargaaggactctaaagccctatctggattccaaatttatggttggtgcagactggatttttacaatttgtgcttagtagtatcttattatattagcccggca

SEQ ID NO: 59054 - DNA, 201 bp, Homo sapiens
tttagaaatatttctaacctctggccttttttcttatctctacttaaagcttttctggaaggaattcattttccactttccttaatgttccttaaatgttstacatatcttaaaagtggattcctcataaaacaatatggactatggtcttattctgtttaacggtatgaaagctcgcctgaaaggccaagagtaagattc

SEQ ID NO: 59055 - DNA, 201 bp, Homo sapiens
gccagggaaccaaggcctttcaaagttgaggacacttcccggtgccgtgcggtgtaaatcacagtgcaaactatgcgattatcccctgcagaggaatcgastgtgactttatgggattcttcaccaagcacttaggaataatctgatataaaacagcaggggtggagagtaatgacaacttcaaattagtttaatgaatgt

SEQ ID NO: 59056 - DNA, 201 bp, Homo sapiens
ggaaggaattcattttccactttccttaatgttccttaaatgttgtacatatcttaaaagtggattcctcataaaacaatatggactatggtcttattctstttaacggtatgaaagctcgcctgaaaggccaagagtaagattcttttaaaatcatgcccaagttttaaaggaatataaaactttctctttaaaaatata

SEQ ID NO: 59057 - DNA, 201 bp, Homo sapiens
aaatgtccagctttctttcttttattcaaaatttatacttcataattgaagttcacctcccaaaagacatagcttggtttagcatagagctatgatgtgtkttctctttgttccttttgcacactttccttgtctggaggcgttgggcttggatccttcattcttcatgaggctgatgtttttccatttcggtttccttaa

SEQ ID NO: 59058 - DNA, 201 bp, Homo sapiens
aaaatgtccagctttctttcttttattcaaaatttatacttcataattgaagttcacctcccaaaagacatagcttggtttagcatagagctatgatgtgktttctctttgttccttttgcacactttccttgtctggaggcgttgggcttggatccttcattcttcatgaggctgatgtttttccatttcggtttcctta

SEQ ID NO: 59059 - DNA, 201 bp, Homo sapiens
ctcctggttttcagcctgaggaggaaggtggctttatttaactccttcagccccggaacatcacagggcccttctttgtgcattctgggttctaacagccmcttgaacagtgcttgagagtatttccattataaatgtcgaatcggcattgaaggaacatctgttttaagtcaacttagactcaatccaggaaaaaaaata

SEQ ID NO: 59060 - DNA, 201 bp, Homo sapiens
cgcctgaaaggccaagagtaagattcttttaaaatcatgcccaagttttaaaggaatataaaactttctctttaaaaatatacctttctgctttcatcccytaacccacaaagctcaagtctagtttaattcaaacttggaaatagttcttttattattgctccctgcaatgggaacagagctgaggctcctaaggtctag

SEQ ID NO: 59061 - DNA, 201 bp, Homo sapiens
ggtgcctaaagtttgagaacttctgatcaaaaatgccagataagaaaaaaaaacctttcgagacatcatttgaatcaattatcaaatgtttccaaagtgcrcttgctttgcaaaccactgtactactcatctctgcctccatcggagcgagttcaggagagttgtgtttacttttctaaaggagccttttccttcccattt

SEQ ID NO: 59062 - DNA, 201 bp, Homo sapiens
aactcctgagggatgctcaggaaaccaaaaaggatgtctgcatggaggacaagaaggcacaaatcgtctgatttcaccccatcctaagatcttgtgacttmagctttgttttggactggggcattggatctcccacatgccctctcttaagtcgtgcatttgacgcatatttaataagcacctactgtgtgccattagaga

SEQ ID NO: 59063 - DNA, 201 bp, Homo sapiens
atttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctggcgtgcgta

SEQ ID NO: 59064 - DNA, 201 bp, Homo sapiens
ccaaagtgctaggattacaggtgtcagccacagtgccatgccctgatgtgatgcttaaattcagaaattgggaaggagggtcaggtagctataagcaaaayacaagagaaatataagagaaagaaagacttgtatctgttgttagtgagtttttgtggtggtgatacattaatggaggcaacagagggtcagaaatcaggg

SEQ ID NO: 59065 - DNA, 201 bp, Homo sapiens
atatactgaatgctaagccctccccactttttttttcttttttaaattcagaaatttctagttgtgtttattcccctcgtcagcatactttatcatatcaragccttttcagacactgtaaaactactgagttatgtttgggtcatgttttgcggtatgccctttaatagtgtagctttagaaatgcaattttcagcctct

SEQ ID NO: 59066 - DNA, 201 bp, Homo sapiens
gatttagaatcagaaagtgtgagttcaaattgccttcggctcttcacctgggtgggcgatttgaatagagctcacagccctgaaaaccctggttttcagaytctttattggtaaatgaagtcagcttagtgatatgagaattatgaaacataaatccctttgtaaaaatataaaataatcttacaatcatcatcgtcatcc

SEQ ID NO: 59067 - DNA, 201 bp, Homo sapiens
ttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagac

SEQ ID NO: 59068 - DNA, 201 bp, Homo sapiens
gtgttttagatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaactt

SEQ ID NO: 59069 - DNA, 201 bp, Homo sapiens
ggctgatgccttctttcactagctttatgtggctggcagttctgtcctgccactcttttcctcatcatctcagcctccctgcccatggcactcaagagtcsaccttggcagaacctgcaactcttcagcgcctccctaatgaactccttgcaagggcccttggttaagttacagtagagaagtggttgcttaagcaagtag

SEQ ID NO: 59070 - DNA, 201 bp, Homo sapiens
gttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcag

SEQ ID NO: 59071 - DNA, 201 bp, Homo sapiens
gcatttcaggttggtctttcccgcaagaaggtaaactcatctgcagctgtattcgctgtgcctatggtagtgcctggcaaatgcacagaagtgggtattastgaggactttgtggttcgaatggaatgagtgtgctgctgacagtgttgcgagtcatctgcaaatgaaaagtccttccttctcttcccttctggaaccttc

SEQ ID NO: 59072 - DNA, 201 bp, Homo sapiens
gatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacaccagtaccaaacgaagatatc

SEQ ID NO: 59073 - DNA, 201 bp, Homo sapiens
acgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaaaaaaaaaaattagccaggcgtgggggtgcatgcctgtgctcc

SEQ ID NO: 59074 - DNA, 201 bp, Homo sapiens
ggcaccacacacgatgagattggaggcacctgggtgtcagcctcttgggctggctcattacaggccactctgtctgaggaacactcaggtttgcaaaccgkttcttaaaattacaggatacctagggacctgttggggtgggagggaagaaccctatgggcagaaatgtgactttctgtagcaaagatgtactgtttccca

SEQ ID NO: 59075 - DNA, 201 bp, Homo sapiens
aaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttc

SEQ ID NO: 59076 - DNA, 201 bp, Homo sapiens
aacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaa

SEQ ID NO: 59077 - DNA, 201 bp, Homo sapiens
gtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagcta

SEQ ID NO: 59078 - DNA, 201 bp, Homo sapiens
cagttgctcacactcggtcaatacttgccttcctttgaggccatctgcactcactgacaatctgatcgctcccctgaatggaggtgaaagcatgcaagctmggagttaagatctttaactcagggaagaccctgtctatggaagtgctgagctcttcagtgtcatcacagaaaagcatgagcccctccctggtacggagtc

SEQ ID NO: 59079 - DNA, 201 bp, Homo sapiens
tagtgtcaagcagtacaggctttattcaatggccatggaattgagaagcaggagcatggctcacaaattcacaaatcagcttctccactaatgaggggtgrggaagttaaaatatagactttgttgttgttgctgttttaatgaagaggctggacattaaaatcaaggggaggaataatcatgtcttctcttgaaatgggc

SEQ ID NO: 59080 - DNA, 201 bp, Homo sapiens
gggtcaacttcttaccgacaaagctggtgccccaaaagaatggggtcttatcctgttgggtgtcatgaagccaacacacaaaaccgaaagtagtgtcaagyagtacaggctttattcaatggccatggaattgagaagcaggagcatggctcacaaattcacaaatcagcttctccactaatgaggggtgaggaagttaaa

SEQ ID NO: 59081 - DNA, 201 bp, Homo sapiens
gttctgaacttgctgttataattattcacattttcttgcagtgaaaatctacaggtcaaggtcatcttcacgtctttagttcttgttttgcttcaggtcastttagaaccgaatgttaaaaggatattgtctattcgaagggtcagattgtggcacgtggaccaaatccagccccccgaggcccacttttgtaaatcaggt

SEQ ID NO: 59082 - DNA, 201 bp, Homo sapiens
ggccacaaaaatcatgtcacaagatcttgttgatgtgcatgcattcattcattcaacaaatattattgagcatctaacataagccgggtgctttgctaggkacagaatgctgtacaaggtccctgtcctcatggggaccgtatgttgggaagacagatgataggcatggaaatgaagagacaaaccactccgacttcagcc

SEQ ID NO: 59083 - DNA, 201 bp, Homo sapiens
tagagtctggattctttttatccagaagccattctttcagcctgtgcctttttgtaaataccataccccatctatttccacaaaggatttggggcattagsgagtaaagggggaatatgttctagaagaagggcgctcacctcagtaaattgatgggtgggccacaaaaatcatgtcacaagatcttgttgatgtgcatgc

SEQ ID NO: 59084 - DNA, 201 bp, Homo sapiens
acctctttttcttcccggtctcaggttatgtctttatcagcagtgtgaaaatggactaatacagtgaattggtaccagtagagtggggcattgctgaaaasatatctgaaaatgtggaagtgactttggaactgggtaacaggaagaagttagaaccgttgggaggtctcagaagaagacaggaaaatgtgggaaagtttg

SEQ ID NO: 59085 - DNA, 201 bp, Homo sapiens
gatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatca

SEQ ID NO: 59086 - DNA, 201 bp, Homo sapiens
catgttaattagatatgcatgtatgtgtatgtatgatgtatatacccatatacacacagtctatatatacatgtatgcgcacatacacatattttaaggaragaattataaaatgatcaattcaagcttactatatgctagaggtgaggaatatttgaatacaagtcttatctagtagattaaaacagaaattaaagactg

SEQ ID NO: 59087 - DNA, 201 bp, Homo sapiens
ttaggagaggaatcactgtgaatgtagacctcgggttggtcattttcctagtaagatagaccagactgactggaaaagtcaccctcttgggctatcctgcrtatgtggctcggcattgcttccgtcaggataatgcatcagtttcttggacaaagggtgcatttctgctatttgaatgcagacatatttttggatataagc

SEQ ID NO: 59088 - DNA, 201 bp, Homo sapiens
cggtctcaggttatgtctttatcagcagtgtgaaaatggactaatacagtgaattggtaccagtagagtggggcattgctgaaaacatatctgaaaatgtsgaagtgactttggaactgggtaacaggaagaagttagaaccgttgggaggtctcagaagaagacaggaaaatgtgggaaagtttggagcttcctagagac

SEQ ID NO: 59089 - DNA, 201 bp, Homo sapiens
cggtggggaggagttcatattcattttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattaattttg

SEQ ID NO: 59090 - DNA, 201 bp, Homo sapiens
ctggcagagggcttttttctgatcaccacccatgttaattagatatgcatgtatgtgtatgtatgatgtatatacccatatacacacagtctatatatacwtgtatgcgcacatacacatattttaaggaaagaattataaaatgatcaattcaagcttactatatgctagaggtgaggaatatttgaatacaagtcttat

SEQ ID NO: 59091 - DNA, 201 bp, Homo sapiens
ggtggctcatgcctataatcctagcacgttgggaggctgaggtgggtggagcacctgaggtgaggagttcgagaccagcctggtcaacatggtgaaacccyatctgtactgtaaatacaaaaaattagctgggcatggtggcaggcacttgtaatcccagctacttgggaggctgaggcaggagaatcacttgaacccgga

SEQ ID NO: 59092 - DNA, 201 bp, Homo sapiens
tttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatca

SEQ ID NO: 59093 - DNA, 201 bp, Homo sapiens
tcccctttctggcagagggcttttttctgatcaccacccatgttaattagatatgcatgtatgtgtatgtatgatgtatatacccatatacacacagtctrtatatacatgtatgcgcacatacacatattttaaggaaagaattataaaatgatcaattcaagcttactatatgctagaggtgaggaatatttgaataca

SEQ ID NO: 59094 - DNA, 201 bp, Homo sapiens
tactggccaggtagaaagggcgtccaggtgaagggaccctggttcagtgatctccaacctgcacgtctcatttgtgaggaagccgtagggtgtggactttycttgtttctgaccttgagtgattagaaaatagcagcttttatatgtcacaaatggactttagataagcatgaagatgacgaagactgtggaatatgtagc

SEQ ID NO: 59095 - DNA, 201 bp, Homo sapiens
tctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgggggggt

SEQ ID NO: 59096 - DNA, 201 bp, Homo sapiens
gagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagcaacct

SEQ ID NO: 59097 - DNA, 201 bp, Homo sapiens
tgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttac

SEQ ID NO: 59098 - DNA, 201 bp, Homo sapiens
tagataactcaagagactcaatcaacttcgtgtttaatgttttcgtaagaatacttcagaggcagtggtgtaatcgtccaagagtacacacaggcctgatygccaaagccagttttcttcaggcccagcacgtcctgacctcctcactcctctgcccactctctgtttactcactcccattttcattcattgattctgtta

SEQ ID NO: 59099 - DNA, 201 bp, Homo sapiens
gtcgttgtgagcagtgccttggtcccgatgatgattctccaaaatgtaatctctgctgacagaacaagagtctgcaaattgggagtctggaaagggaagakaagggctttgtccctggccccaaagactcagggagaggtttactggccaggtagaaagggcgtccaggtgaagggaccctggttcagtgatctccaacct

SEQ ID NO: 59100 - DNA, 201 bp, Homo sapiens
cccctggctgtccaccagcccctttgtgatagtctcatagtcttatttgtcttttggcttgtatcccacctgttcactttttaccatagctaacctttctmagtggtcaggtgggactcatggagattttccgttctttggagactagcagcgactgcagattactcatcagctgtctccttgagtccacaatgccgggcg

SEQ ID NO: 59101 - DNA, 201 bp, Homo sapiens
tctctagcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacagga

SEQ ID NO: 59102 - DNA, 201 bp, Homo sapiens
tagtaaccatgaacctgtatatcaaaaagcgtgactagagtttcatagttaaacatgtgctgaaatccacagtggacaccagagagggtcatggaatctgrgaatggatgacttgtcccatgatgataatatctgtgttcctacggctgggcccggtggctcacacctgtaatcccagcactttgggaggccgagatggga

SEQ ID NO: 59103 - DNA, 201 bp, Homo sapiens
tggccccccagaaattatctccagcagcagcaacagagaggactggaatgccattgacaggtcccacaagtcagcaatcagcacgccattttttaaaattwatgttgctattgtatcgtaaggttcttctgaagcgaccacttcataacactgtgtagtccaatccctaagctgggcaatttttttttcccctttcaatac

SEQ ID NO: 59104 - DNA, 201 bp, Homo sapiens
ccaagagtacacacaggcctgatcgccaaagccagttttcttcaggcccagcacgtcctgacctcctcactcctctgcccactctctgtttactcactccsattttcattcattgattctgttattctccactaagttttctgggtggtcagcccaggaagcctcagcctgcttccagatagttctcctcagagttagcgg

SEQ ID NO: 59105 - DNA, 201 bp, Homo sapiens
gcccggtggctcacacctgtaatcccagcactttgggaggccgagatgggaggatcacgaggtcaggagttgaagaccaccttgatcaatatggtgaaacsctatctctactaaaaatacaaaagttagccggtgtggtggtgcatgcctgtaatcccagctactcaggaggctgaggcaggagaatcacttgaacccagg

SEQ ID NO: 59106 - DNA, 201 bp, Homo sapiens
ttaacatgctgttagtgcatgcaaaaaaaagcccagtaattgtagggctcatcagtacattgttaattgatcctcatttcctattattttacctcaaagcmaacacatcattcaccatagtgacaccagagttgtttatcttctctgtgcaagtgtgtgctctttttagcaagctttttggatcctctgtttcagagggcc

SEQ ID NO: 59107 - DNA, 201 bp, Homo sapiens
ttaccagacacatctcactttatggagcctggggctattggtaatatgcatttctttctcatcttgatcgtaaaatgatcttagaaaggtttctgagaatwtatagagtttaagacagcaataagacaactaattaattaaacaggaaaaggggatgttgtgctcagagaggaagtgtgggtctcataagggctttcacaa

SEQ ID NO: 59108 - DNA, 201 bp, Homo sapiens
tctacctataagtaccttccaactgttccacttttgtaaatttagttcaaataatacatatgctgaaattcctatatcccccccatactccagatcttcaktgtggaatttaaatataattccttattgtaaaaaaaaaaaatttttttttgatcaaggtgattttgataaactaaatgcatctttaattttactcacagc

SEQ ID NO: 59109 - DNA, 201 bp, Homo sapiens
caagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgca

SEQ ID NO: 59110 - DNA, 201 bp, Homo sapiens
ccagcactttgggaggccgagatgggaggatcacgaggtcaggagttgaagaccaccttgatcaatatggtgaaaccctatctctactaaaaatacaaaarttagccggtgtggtggtgcatgcctgtaatcccagctactcaggaggctgaggcaggagaatcacttgaacccaggaggcggaggttgcagtgagccgag

SEQ ID NO: 59111 - DNA, 201 bp, Homo sapiens
ggacccggttggctctgcaaaccgcatttccttggctgaacgccagaggagagaaatgatccggcaagaagacacaccattccccgtcagccccttcccgwcccttgcacccctggatcttctgctgagtatcggattggtctgcgtccaagagctcctcgcttggccagcaggggctgcctggagaaggggaggacaggc

SEQ ID NO: 59112 - DNA, 201 bp, Homo sapiens
cttttttccactttcaaatgtataacaaaatagaactttatatttccagatggactgcctggaacccggggagtggctcagctaccaggccccagtggccsttgtcttgttatttcctccattagagacctggcgtataattgtgggagggagaagccagtggagcagtcaggggactccctggctgtttctgtgtctggt

SEQ ID NO: 59113 - DNA, 201 bp, Homo sapiens
ttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtccca

SEQ ID NO: 59114 - DNA, 201 bp, Homo sapiens
gaaagtgtcatgtcaaagataaagggagaacagcattttctttttttacaagtcactcttacttaaacacacagcatgactctccttacacatttatttcrgaagagcaaagtccgggtccccaggctcaactatcagccgccttctcatcccaagggctgtcaccaccagaaatttaacatgctgttagtgcatgcaaaa

SEQ ID NO: 59115 - DNA, 201 bp, Homo sapiens
gttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattca

SEQ ID NO: 59116 - DNA, 201 bp, Homo sapiens
actttatatttccagatggactgcctggaacccggggagtggctcagctaccaggccccagtggcccttgtcttgttatttcctccattagagacctggcrtataattgtgggagggagaagccagtggagcagtcaggggactccctggctgtttctgtgtctggtcttatgggtctgggcactgaattcagtcacaaac

SEQ ID NO: 59117 - DNA, 201 bp, Homo sapiens
tcagaaattgggaaggagggtcaggtagctataagcaaaatacaagagaaatataagagaaagaaagacttgtatctgttgttagtgagtttttgtggtgrtgatacattaatggaggcaacagagggtcagaaatcagggaaatcagggtggaaaatagcccagcagaggggaaaagaggaagtctgaacgagggccaca

SEQ ID NO: 59118 - DNA, 201 bp, Homo sapiens
ccctggttgacctggaatgacctagaccagcagtcacaagctcctgcccatggacaaaatacagccggtacctctttggctatggcctgcaggctcagaayagttcttacattttcaatcatctgcaaaaaagaataaagaggagaatattatttcttgaaggaggaaaatgatatggaattctgatttcagtgtcataaa

SEQ ID NO: 59119 - DNA, 201 bp, Homo sapiens
aaggaccctatgttatatgatttcatttacatgaaataccccaaagaggcaaatctgcagaaacagaaagtagagtggttgccaggggctggggatggggygtggatggaggcatttgggattaacagctaaagatagcaggattccttctaaagcaataaaaatgttgtaaagttgattgtggaaattctttcacaactc

SEQ ID NO: 59120 - DNA, 201 bp, Homo sapiens
aggcaacagagggtcagaaatcagggaaatcagggtggaaaatagcccagcagaggggaaaagaggaagtctgaacgagggccacattgcagatagaggcyggtgtactggtctgctcaggctgccataacaaaataccacaggctggatgacttgaacaacaaaaatacattttctcatagttgtggagcctagaattcc

SEQ ID NO: 59121 - DNA, 201 bp, Homo sapiens
agctggcatggtggcacatgcctgtagtcccagcttctggggatgctgcagcgagccatgattgtgccactgctctctggcctgggcaacaaagagagatyctgtctccaagtctgtctgtctgtctgtctgtctgtctgtctctctcggaaatattccttcagtgtattagtaaagaagttacttatgagtcacttatgc

SEQ ID NO: 59122 - DNA, 201 bp, Homo sapiens
ggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcct

SEQ ID NO: 59123 - DNA, 201 bp, Homo sapiens
tccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactgtggccatgaaaccttgcct

SEQ ID NO: 59124 - DNA, 201 bp, Homo sapiens
aaatattttgagaactctgaaataatgcacaccagaaacgtccagctgaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcga

SEQ ID NO: 59125 - DNA, 201 bp, Homo sapiens
cagtacttctgctacgagtgtatacaggctgaggatgggtgctttgtggcccttttcttttaccggctgactagaatgttgacgttaaagcagttagagtycgagcaggcaactccgaccccaagttggagctgtgtgttgaagatagaagagcaaatatgtagaaggaacctggatttctatttttttaaaaaatataat

SEQ ID NO: 59126 - DNA, 201 bp, Homo sapiens
tagttctgtccctggaggtgagggccagacaacacatcaaaactgactttttattttttttcaaagttgttaagactatctaagattcagatctccctaawactgttcctagttagtatttagaacgtatttgtttagaggatactagcctgaaatagccctatctccaggttgtctgatgcgatgaggatgtggtgttaa

SEQ ID NO: 59127 - DNA, 201 bp, Homo sapiens
ccggctgactagaatgttgacgttaaagcagttagagtccgagcaggcaactccgaccccaagttggagctgtgtgttgaagatagaagagcaaatatgtrgaaggaacctggatttctatttttttaaaaaatataataaatcatccagccccaaatgtcaggaacctgggtttctaatgatggttggctgtcaccccca

SEQ ID NO: 59128 - DNA, 201 bp, Homo sapiens
aatctctagcttctcaaactgtttcgtggtggagtgccttttgggcacaggagaaggaaataagagcctcgcgaggtttgggaatgctgcctctagctctyacactgcatgcagaattcctactctgagagctcactttatctcaaaaacccatgcatattctgcatctactctgaattccgcagtgttgtgtgttactat

SEQ ID NO: 59129 - DNA, 201 bp, Homo sapiens
atacgaagatttttgagaaaaactttgcatattttaattgctgtctggaatcctccttcagctgggatgagaaatcatctctgggttagttctgtccctgraggtgagggccagacaacacatcaaaactgactttttattttttttcaaagttgttaagactatctaagattcagatctccctaatactgttcctagtta

SEQ ID NO: 59130 - DNA, 201 bp, Homo sapiens
gcagttagagtccgagcaggcaactccgaccccaagttggagctgtgtgttgaagatagaagagcaaatatgtagaaggaacctggatttctatttttttwaaaaatataataaatcatccagccccaaatgtcaggaacctgggtttctaatgatggttggctgtcacccccatttcccacactttaaatgagagaagta

SEQ ID NO: 59131 - DNA, 201 bp, Homo sapiens
tttgaaaacttaccttgtttatatgtttcttctgttgcaatttcttccattacctggaatagctgctttggacggcaaaccaagcaatgccctttcacagstgtgggatgaatggggaaagaagtcttggtaaggaagcaattcagagaacatggaagcatctcatggcagcagtcacaattttgtgttgcgtaatatttc

SEQ ID NO: 59132 - DNA, 201 bp, Homo sapiens
tatttaaagctgtcatggaaagccttaaagttaaaatacgaagatttttgagaaaaactttgcatattttaattgctgtctggaatcctccttcagctggratgagaaatcatctctgggttagttctgtccctggaggtgagggccagacaacacatcaaaactgactttttattttttttcaaagttgttaagactatc

SEQ ID NO: 59133 - DNA, 201 bp, Homo sapiens
tccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgc

SEQ ID NO: 59134 - DNA, 201 bp, Homo sapiens
ttctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcag

SEQ ID NO: 59135 - DNA, 201 bp, Homo sapiens
tgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgcct

SEQ ID NO: 59136 - DNA, 201 bp, Homo sapiens
tgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaacgttggatcatg

SEQ ID NO: 59137 - DNA, 201 bp, Homo sapiens
acgaaggaggaggaggaggaaaaggtgacttgcctctagctgatgtggattatttctcttttttaatttccatgtctgcgtagcttcatcatagatctcarcttaaggacaatgaaagtcgtttattgagtacttagtatgtgctggttgcagagccaagtcttttttttttttttttttttcctccttttttgagagaga

SEQ ID NO: 59138 - DNA, 201 bp, Homo sapiens
atctcaaaaaaacatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaaccattttct

SEQ ID NO: 59139 - DNA, 201 bp, Homo sapiens
tgccatccacggacggcttaagtgttaacagttcagtggagggtcagcgtgacagccttttgcacccacatctgggttcttgtccagtgtccaggaggaaygaggtctcatgagcaaattttaaggatggcaaatgtgggggattttattgctgatgaaagtggctttcactgggaagataagctaaaaagaagacaaagc

SEQ ID NO: 59140 - DNA, 201 bp, Homo sapiens
cttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggcc

SEQ ID NO: 59141 - DNA, 201 bp, Homo sapiens
tttctttcttttttttttttagggagggtctggctgtattgcccaggccggagtacagtggcacgatcttggcttactatagccttgacctctctggctcmagtgatcctcccacctcagcctcctgagtcactgggactacaggtgcacactaccatgcccagctaagtttgttcattttttgtagatacagggtctgac

SEQ ID NO: 59142 - DNA, 201 bp, Homo sapiens
tcagccttttctctcgatctttttttttttttttttcctttcttaagaaagggtcttgctcttttgcccaggctgcagtgcagtggtacaatcagagatcmctgcagcctccaactcctaggctcaagcgatcctccagcctctgcctgccaagtatctgggactacaagcatgcactcctgtgcttggttaattttgact

SEQ ID NO: 59143 - DNA, 201 bp, Homo sapiens
aaaattttcccctttctggcagagggcttttttctgatcaccacccatgttaattagatatgcatgtatgtgtatgtatgatgtatatacccatatacacwcagtctatatatacatgtatgcgcacatacacatattttaaggaaagaattataaaatgatcaattcaagcttactatatgctagaggtgaggaatattt

SEQ ID NO: 59144 - DNA, 201 bp, Homo sapiens
acccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagag

SEQ ID NO: 59145 - DNA, 201 bp, Homo sapiens
aaagtaaacagatcttagagagggacaccgatccctaccctgcatggggttattcacagagccatggggacactaaacgtaccttatctcttgaccatgcyattgattagttatgtgtttgcctgtgttattaataatgtatacattgaaaaatctatgtgcattatagtctttgatcttgtcatgaatttcaaagccaaa

SEQ ID NO: 59146 - DNA, 201 bp, Homo sapiens
gtaatatgcagtatatgtgctaaattactttttttgttgttgttgagatggagtttcgctcttgttgcccaggctggagtgcagtggtgtgatcttggctygccgtgatctctacctcccaggttcaagcgattctcctgccgcagcctcccgagtagctgggattacagacatgtgccaccacacccggctaattttgta

SEQ ID NO: 59147 - DNA, 201 bp, Homo sapiens
agattttggaggacttgaaaggttcctgctacctttggctggggatggagggaacatggaagatgggtctttgtttagaggaagctctttatcctggtacsctggaagttggcatagtcttagcagttagtccagatgtgaatttcaggattattctgtgagtcttccaagtcctgtctcagcagtgaaataggctcagtg

SEQ ID NO: 59148 - DNA, 201 bp, Homo sapiens
tatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctcc

SEQ ID NO: 59149 - DNA, 201 bp, Homo sapiens
atgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtat

SEQ ID NO: 59150 - DNA, 201 bp, Homo sapiens
tctctgccttcctttctctccctccttggtctgcttcctcctgttgctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggct

SEQ ID NO: 59151 - DNA, 201 bp, Homo sapiens
cttgggaagtggactcagaggccaagtgactttgatttttcactttatcctggagtttctcaaccttggcactattgacattttaggccaggagattcttkgttgggggggatttcctgtgagttacaagacattaagcaacatcactggcctctacccactagatgccagtagcatcttctatttcctcaagtctcaaaa

SEQ ID NO: 59152 - DNA, 201 bp, Homo sapiens
ccgatatttaatattatcaattgctggttcctgtaaatttgcatttatggatcacattataaaagcaattactcttatggattgttcatgcagaaatgcaytatgatgataatatacttttaaaagtatatttatttccagaattcaatttgtaagaggtttgagggaaaaataatactgagttttgagtgtttctgattt

SEQ ID NO: 59153 - DNA, 201 bp, Homo sapiens
ccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattca

SEQ ID NO: 59154 - DNA, 201 bp, Homo sapiens
tacttttgttctcaccttgggaagtggactcagaggccaagtgactttgatttttcactttatcctggagtttctcaaccttggcactattgacattttargccaggagattctttgttgggggggatttcctgtgagttacaagacattaagcaacatcactggcctctacccactagatgccagtagcatcttctattt

SEQ ID NO: 59155 - DNA, 201 bp, Homo sapiens
tattatcaattgctggttcctgtaaatttgcatttatggatcacattataaaagcaattactcttatggattgttcatgcagaaatgcattatgatgatamtatacttttaaaagtatatttatttccagaattcaatttgtaagaggtttgagggaaaaataatactgagttttgagtgtttctgattttaaaaatgtgt

SEQ ID NO: 59156 - DNA, 201 bp, Homo sapiens
ttaacacaacttctccgtgtgtgggctaaataaatattcgggcaacactgattgagcactgccttgggtaaataattctctctccacacatttcctagttyataatgaggagttttcttcgtggtctgaccaaatgtaacattccattgaaaatgagacataaatccttgagtgagggagacgtggaaccagggtttgagg

SEQ ID NO: 59157 - DNA, 201 bp, Homo sapiens
cttttcaagtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtc

SEQ ID NO: 59158 - DNA, 201 bp, Homo sapiens
gcccctctgaaagcccttcactgcggctcagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggtt

SEQ ID NO: 59159 - DNA, 201 bp, Homo sapiens
ggctggagtagtgtgcagagcctggcggtgattgttctcattagaaagtatagtgtaatactcaataaattacttttgttctcaccttgggaagtggactmagaggccaagtgactttgatttttcactttatcctggagtttctcaaccttggcactattgacattttaggccaggagattctttgttgggggggatttc

SEQ ID NO: 59160 - DNA, 201 bp, Homo sapiens
ggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacgtcttggaatcaaccttacagggaacacttggtcgaaa

SEQ ID NO: 59161 - DNA, 201 bp, Homo sapiens
cctttgtatgtaaatgtctcatatacccctctaagaacgggagcgaatagtattttccaaacttacgtcaccacttaccatccacctgcatactttacacrtcttggaatcaaccttacagggaacacttggtcgaaaaacagtgttttctaaatttatattacagttcccactccccccgcccccacttgtatcactttg

SEQ ID NO: 59162 - DNA, 201 bp, Homo sapiens
tccacctgcatactttacacgtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgt

SEQ ID NO: 59163 - DNA, 201 bp, Homo sapiens
gatcacctgaagtcaggacatcaagaccagcctggccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagc

SEQ ID NO: 59164 - DNA, 201 bp, Homo sapiens
cgcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatactattccatagctgactattttctgaaatgattttgttactt

SEQ ID NO: 59165 - DNA, 201 bp, Homo sapiens
tatatatttaaagctgtcatggaaagccttaaagttaaaatacgaagatttttgagaaaaactttgcatattttaattgctgtctggaatcctccttcagmtgggatgagaaatcatctctgggttagttctgtccctggaggtgagggccagacaacacatcaaaactgactttttattttttttcaaagttgttaagac

SEQ ID NO: 59166 - DNA, 201 bp, Homo sapiens
gcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctactttaaggttttctcacagattaagagagtagc

SEQ ID NO: 59167 - DNA, 201 bp, Homo sapiens
gacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacata

SEQ ID NO: 59168 - DNA, 201 bp, Homo sapiens
caggttttgtttttttgtgtgtgtgttattttgttttttgtttttttgtttttcgggggctggagtagtgtgcagagcctggcggtgattgttctcattaraaagtatagtgtaatactcaataaattacttttgttctcaccttgggaagtggactcagaggccaagtgactttgatttttcactttatcctggagtttc

SEQ ID NO: 59169 - DNA, 201 bp, Homo sapiens
gtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatc

SEQ ID NO: 59170 - DNA, 201 bp, Homo sapiens
aaaagaaaagtagagaggatagtataatgaggttcctgtctgccagtcactctatagtaactattaggaaacccctttttttctctgaagtcattgctccggtgtgtgtgtgtctgtatataaaaaaaagtatgtatacatatacgtatatgtatgtgtatagataaaaatgcatgtatggtgctgggcgcagtggctcac

SEQ ID NO: 59171 - DNA, 201 bp, Homo sapiens
agaaacttggacagaggaaaatgaaaatgttctattaattccactagcatgagataatcactcttaatattttgttgcatgttcttttctttcttctgagkgatagcatttttttcaacaaattgggctcgtaatatataggcacatagatatataattaaaaaaacaagaatttctcatgtcattaaacattgcttgaaa

SEQ ID NO: 59172 - DNA, 201 bp, Homo sapiens
taagccctgaagtctggacactgagagaattctaggcttgacttctctgtacagccatcttgggagtgctcaaccctttgaatcggatgtctagaatggaytcagatgtcactgtgcaggtgactcacgcctagaatcctctgcctatcgtgacagggagaagcctgtgtgaccctgtggccatctcagtctctgcagggc

SEQ ID NO: 59173 - DNA, 201 bp, Homo sapiens
aagatcctcaagctgttccttccaccccctgggatgctgattaagttaagatttcagattttatttattctacgggtatttgttgaatatttatttcttamgataccacgcactgctttaggcactgggaatatagcaggatatacaaaacagaaaaatcatggccctcatggattattggttgtgagtaataggaacctt

SEQ ID NO: 59174 - DNA, 201 bp, Homo sapiens
gtataatgaggttcctgtctgccagtcactctatagtaactattaggaaacccctttttttctctgaagtcattgctcctgtgtgtgtgtgtctgtatataaaaaaaagtatgtatacatatacgtatatgtatgtgtatagataaaaatgcatgtatggtgctgggcgcagtggctcacgcctgtaatcccagcactttg

SEQ ID NO: 59175 - DNA, 201 bp, Homo sapiens
tctatgtaacctcagccatcttggattcccagcttactcacatcatagatggagagtcagttgtttagaaaaaaactttcttttttttttctttccttttkcttttcttttctttctttctttcttttttttttttagggagggtctggctgtattgcccaggccggagtacagtggcacgatcttggcttactatagcct

SEQ ID NO: 59176 - DNA, 201 bp, Homo sapiens
tcctcaagctgttccttccaccccctgggatgctgattaagttaagatttcagattttatttattctacgggtatttgttgaatatttatttcttacgatrccacgcactgctttaggcactgggaatatagcaggatatacaaaacagaaaaatcatggccctcatggattattggttgtgagtaataggaacctttcaa

SEQ ID NO: 59177 - DNA, 201 bp, Homo sapiens
agcaacacacaaggattgggagatgttcatggcaagaaaaattcagaagggacattgttgtttcactaattctgtaaaggagagcagcggcatttacttakgccgattccccattctctctttctgtttttaaacagagacagatcttgctctgttgcccaggctggagtgcagtggcatgatggcatgatcatagttcac

SEQ ID NO: 59178 - DNA, 201 bp, Homo sapiens
cactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggataccagagaatcccgtggaatcccacagtgacacagccaagccttgggaggggtg

SEQ ID NO: 59179 - DNA, 201 bp, Homo sapiens
cccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaacc

SEQ ID NO: 59180 - DNA, 201 bp, Homo sapiens
caaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgaagcaggagaatttctggaacctgggaggtggaggttgaagtgagctgagatggcaccattgcac

SEQ ID NO: 59181 - DNA, 201 bp, Homo sapiens
gaggtggtagatgcttttaaacaaacagatctcaggagaactctttcacaagacagcactagggggatggtgattagaaagcacctcatgatcccgtctasttcctgcagagaacagactagccccctatgcagcacacacctttgtgaggtccctcctccaacacagggattacaattcaacctgagacgtgggtgggga

SEQ ID NO: 59182 - DNA, 201 bp, Homo sapiens
tgcacattatagtcacaaccatacctagaaccaaattgcctaacactgaatcccaaatccaaattcctgggagatagaattcaattcttctcttgccacamatcagctgtttatactcctctttgcacgttgcagaagatcaggaatttgcacattatagccacaaccatacccagaaccagattgtctaacactgaatct

SEQ ID NO: 59183 - DNA, 201 bp, Homo sapiens
aaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcacca

SEQ ID NO: 59184 - DNA, 201 bp, Homo sapiens
atatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgagagttacatcaggggagggtcatgaggtcacctt

SEQ ID NO: 59185 - DNA, 201 bp, Homo sapiens
ccgtttctgcttcttcccagggtgtgacctcagcggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggag

SEQ ID NO: 59186 - DNA, 201 bp, Homo sapiens
tataatttttttcttcttttctatctgctagcaaagtgggtaagttgacccatgacatggtccactggagggaccacatttgtgactctagcaattaagcytcccttctcatctgtggataaaactgacctcccagtgtgctggagtcaaacatattcagcatccaatccacattggactgtttgcatgtaacgtacagaa

SEQ ID NO: 59187 - DNA, 201 bp, Homo sapiens
caaatgcagcatcgcttgaagctgtgataaaatatcacacctttggaaatcaaggctcttcttgtttatttatttaactcacattaattagccttaatttwaaaaaaatgagaagagccagcatcatgatgcaagcattgactttgctcacaaaaacatcttgtggtcaacagtggggcttagggggcaggttttgtggct

SEQ ID NO: 59188 - DNA, 201 bp, Homo sapiens
agttccattaggtgacagtgtgtgcacagtttatggaggatgaagcggaaaacctgagccacaaggcagtagaggttggacgagacactcattccgaaggsgggtgtgtatgtgcaaactgtataatttttttcttcttttctatctgctagcaaagtgggtaagttgacccatgacatggtccactggagggaccacatt

SEQ ID NO: 59189 - DNA, 201 bp, Homo sapiens
taagtgtgtaagcagggaacagaaagtactgtgatttaaaatatgttaatttttctactgtacagatgagagccagcttggagatgggctgtagctcaagyatcttacctacctctgatttcttaatgccacgttataaggctgctgcttatagctcttgaagtcactccaaaaacagatgagtgagaccctgttgctaaa

SEQ ID NO: 59190 - DNA, 201 bp, Homo sapiens
ggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccga

SEQ ID NO: 59191 - DNA, 201 bp, Homo sapiens
agaaaggaagagtttcctgagtcacctttgggaggtaggaagggtttgacatgtaggctgggcatctgggaacgagtgagggattctgtgagccccatctyagtggaccactcaaggaaggtgggtaagccctgggtataagtgtgtaagcagggaacagaaagtactgtgatttaaaatatgttaatttttctactgtac

SEQ ID NO: 59192 - DNA, 201 bp, Homo sapiens
tgtgtcattccgttgtgcctgtcgtcttgaccttgtaaaaggtcttgggtaagcatgcaagaagttttgaagagggagatacagctaatttgcagataaaragcaagggaagaattcctggagaaaggaagagtttcctgagtcacctttgggaggtaggaagggtttgacatgtaggctgggcatctgggaacgagtgag

SEQ ID NO: 59193 - DNA, 201 bp, Homo sapiens
acttgtgtcattccgttgtgcctgtcgtcttgaccttgtaaaaggtcttgggtaagcatgcaagaagttttgaagagggagatacagctaatttgcagatraagagcaagggaagaattcctggagaaaggaagagtttcctgagtcacctttgggaggtaggaagggtttgacatgtaggctgggcatctgggaacgagt

SEQ ID NO: 59194 - DNA, 201 bp, Homo sapiens
cagcactttgggaggccaaggtgggtgggtcacctgaggtcaggacttcgagaccagcctggccaacatggtgaaaccgcatctctactaaaaataaaaawaaaaaaaaaattagccaggcatggtggtgcatgtctgttatcccagctacttgggaggctaaggcaggagaatcacttgaacctgggaggcagcggttgc

SEQ ID NO: 59195 - DNA, 201 bp, Homo sapiens
gctggagtgcagcagtgtgatcttggctcactgcaaactccacctcccaggttcaagggattctcctgcctcagtctcccaagtagctgagattacaggcscccaccaccaagcccagctaatttttttggttttttttgtattttagtagagacgggatttcaccatgttggccaggctggtctcaaactctggacctca

SEQ ID NO: 59196 - DNA, 201 bp, Homo sapiens
tactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatg

SEQ ID NO: 59197 - DNA, 201 bp, Homo sapiens
agtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcaccgc

SEQ ID NO: 59198 - DNA, 201 bp, Homo sapiens
taatataattaatgtaaaaacacatacttcttttcaacaaaaactggctctctttgtagtctcttttttaatttggtgcaatcacttaaaaagtttagcasatttaaaattttacatcattttaaaattgtttctcttttataagaaggatgctatttactattaatgtagaagtacaaaggaaacggttactttggattt

SEQ ID NO: 59199 - DNA, 201 bp, Homo sapiens
tgttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagat

SEQ ID NO: 59200 - DNA, 201 bp, Homo sapiens
acgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggt

SEQ ID NO: 59201 - DNA, 201 bp, Homo sapiens
gaaaaaaacttgcttgtttactgtcttctgagctgatttctcacctactggcaagtggataggtctactttttgtttagctgtttttctaatttaatcttrtacatgagacagctatagatggatgtatagtctttgaagtggggccagttggctccgtctattagctgtgtggcttttgtgcaggtgacttgtggccccc

SEQ ID NO: 59202 - DNA, 201 bp, Homo sapiens
caacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcagg

SEQ ID NO: 59203 - DNA, 201 bp, Homo sapiens
tcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcactatctgggctcactgcaacctgtgcctcccggattcaagag

SEQ ID NO: 59204 - DNA, 201 bp, Homo sapiens
ctctcctcggccttgcaaagtgctgggattataggtaccccgcctggctgatactttccttagttgttttcagtgtaataacctgtcttcagtctactctwtgtccttttctctcctttcctccctgaatactcaagcttccagtgcacagatttctccaaccctgaatgtgactgataccaacaccatactagctcttcc

SEQ ID NO: 59205 - DNA, 201 bp, Homo sapiens
agcctggccagcatggtgaaaccccgtctctactaaaaatagaaaaaattagccgggcatagtggcatgagcctgtaatcccagcgactcgggaggctgargcaggagaatttctggaacctgggaggtggaggttgaagtgagctgagatggcaccattgcactccagcctggcagacagagtgagactccatctcaaaa

SEQ ID NO: 59206 - DNA, 201 bp, Homo sapiens
tgggattacaggcgtgagccactgtgcccagccaaacctcggcacttttatccaacaaatatttatttcgtgactattatgagtcaggcttaagaatacaytagtaggtacagcaggagagcatgtagaagaggatagatgtagaaaatcgggacggcatgttaggaatatagataggaattactaaggaaaattgtattt

SEQ ID NO: 59207 - DNA, 201 bp, Homo sapiens
atgtgtggccaatctcacaagatactaattctttttttcaaatgcagcatcgcttgaagctgtgataaaatatcacacctttggaaatcaaggctcttctkgtttatttatttaactcacattaattagccttaatttaaaaaaaatgagaagagccagcatcatgatgcaagcattgactttgctcacaaaaacatcttg

SEQ ID NO: 59208 - DNA, 201 bp, Homo sapiens
tttgctctgttacgtgaggacacatcacttgcacctcagtgtgagtttgaaagtgttttctctggagaataattctgaagaaataggccctccagatatcrgtagtgacaggggtatcagtaatgttgattactaagttcttgccacaggtagaagccatgctactgcacaagtttcatacttgaagagtggacatctgac

SEQ ID NO: 59209 - DNA, 201 bp, Homo sapiens
agatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttcagccattttcatcttcactgtaaatctagaca

SEQ ID NO: 59210 - DNA, 201 bp, Homo sapiens
gtgaaaccccgtctctactaaaaatagaaaaaattagccgggcatagtggcatgagcctgtaatcccagcgactcgggaggctgaagcaggagaatttctkgaacctgggaggtggaggttgaagtgagctgagatggcaccattgcactccagcctggcagacagagtgagactccatctcaaaaaacaaacaaaaaaaa

SEQ ID NO: 59211 - DNA, 201 bp, Homo sapiens
ttcctccccttttatcaagagccgtaagtccttggaaaatgcaaagagggggaaaaagaagaaaaacagcaacgagtttattggagagttaacacttaaakactccagtacattgagtgtgacatgcctgtgtaggagactgtctgtcccccaaataattgacaatttctctccatctaacaagaaaatatatggcacttt

SEQ ID NO: 59212 - DNA, 201 bp, Homo sapiens
ttttttttttaatacttttctttttgccggcatctgcgtagaatttttttttttttttttggtagtttcttaatggtctttagcaaaggaagtaagtgacrctgatcggtgaaggcagacagtaagatttataatgtatttgtgctagctgattgccaacagaaccggcctttcccagtggtgctgtacgcagactcggaa

SEQ ID NO: 59213 - DNA, 201 bp, Homo sapiens
caggctctaatgcacgataagacagttaggttcgaaggaaaacaaagacaattgcacggcacagagggaatatactgctacggtaaaccgatcactaacayccggccctgaatttgcttcaaagttttcactaaggcacaaagggagccgtgtggagctccggagttcccatctgaggtcttgtctaactccttggcaact

SEQ ID NO: 59214 - DNA, 201 bp, Homo sapiens
atacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagacct

SEQ ID NO: 59215 - DNA, 201 bp, Homo sapiens
tcgcagacacggaaaaaaggattattcctccccttttatcaagagccgtaagtccttggaaaatgcaaagagggggaaaaagaagaaaaacagcaacgagkttattggagagttaacacttaaatactccagtacattgagtgtgacatgcctgtgtaggagactgtctgtcccccaaataattgacaatttctctccatc

SEQ ID NO: 59216 - DNA, 201 bp, Homo sapiens
tgatgcacccgcatcggcctcccaaagtgctgggattacaggcatgagccaccgcacctggaggacaagtaatttctaagtattatttcttttaatcctcrcagtgactccttgttagggtttgctgcattttatacaaagaagaaaggagtctgtggaagtgacataaagtaggacatgtattcatttactgattcaacc

SEQ ID NO: 59217 - DNA, 201 bp, Homo sapiens
gtggcgtttccacacacagggaagcagatagttccattaggtgacagtgtgtgcacagtttatggaggatgaagcggaaaacctgagccacaaggcagtakaggttggacgagacactcattccgaaggcgggtgtgtatgtgcaaactgtataatttttttcttcttttctatctgctagcaaagtgggtaagttgaccc

SEQ ID NO: 59218 - DNA, 201 bp, Homo sapiens
cccaaagtgctgggattacaggcatgagccaccgcacctggaggacaagtaatttctaagtattatttcttttaatcctcacagtgactccttgttagggwttgctgcattttatacaaagaagaaaggagtctgtggaagtgacataaagtaggacatgtattcatttactgattcaacctttcatttgtacatatatgt

SEQ ID NO: 59219 - DNA, 201 bp, Homo sapiens
aagatgagtggcgtttccacacacagggaagcagatagttccattaggtgacagtgtgtgcacagtttatggaggatgaagcggaaaacctgagccacaakgcagtagaggttggacgagacactcattccgaaggcgggtgtgtatgtgcaaactgtataatttttttcttcttttctatctgctagcaaagtgggtaag

SEQ ID NO: 59220 - DNA, 201 bp, Homo sapiens
gctggacaagaagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagt

SEQ ID NO: 59221 - DNA, 201 bp, Homo sapiens
tggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcat

SEQ ID NO: 59222 - DNA, 201 bp, Homo sapiens
ccactttttaaacatgacattcgatccacgtggcatagcaaggatgggatccacaagatggagtgatctttacgccatcctcctgaccataaatactaaaygaatactctatttcagttgagtttttagtttgctctgttacgtgaggacacatcacttgcacctcagtgtgagtttgaaagtgttttctctggagaataa

SEQ ID NO: 59223 - DNA, 201 bp, Homo sapiens
tgaaattcagtatatttgaaatgagcccttatcttgagctcactgagcttattattttgggttaaataaaaaagaaaacagagtcttactttttctgatcmttttattgtctttctgactaatgttaaaaagtagtaacctctagtaggtgggatagtagcaatttttagggatgtattgagaagagtacaaatgggaata

SEQ ID NO: 59224 - DNA, 201 bp, Homo sapiens
tgacagggagatggagggaggcaaaaagaaaaagggagaaggaaagagaggaaagaggggaagggaggaaggaaagaagagagagaaggaggaagagaggraaggaggcacagaggtagagaggcagggagataatggagatcctggccaaaagttaatgctccgtttctagtagtccacagaaagcaccttgaccaagtg

SEQ ID NO: 59225 - DNA, 201 bp, Homo sapiens
gctatgtcagaagcaagtcaggatttgaaggcagatctgtctgcttttgcccctctgtaaatccagagctgctgcctcatttcttacgttgcccccacccrtgcagcaattcttcctgggaggcctcattgttcatattcataaagggccccattcagtctcctttttggagaaatggccactgcaactctctgttctgac

SEQ ID NO: 59226 - DNA, 201 bp, Homo sapiens
gctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctagg

SEQ ID NO: 59227 - DNA, 201 bp, Homo sapiens
cgcagattgccagtgactccgggaatgcctaggtttatgtatggattaacacagtgatagaccctgagtagcaaaagacgaagactaattacctgacagarctcccctccactcgcctgggtcattgaaattaatttctgctttcaagcttggcagaaagcagctgcagaatttcagttcaatacttaaattaacggggag

SEQ ID NO: 59228 - DNA, 201 bp, Homo sapiens
ggattaagttagggagacagtaatggtattgttagcaggctatttcaatgattttctctgcggaagagtagggaaaggtgacattccaactgggaatattmgactctgcagatccctactcggagtttttcagccctgttttaagtgccgagctgggttttgcctcatgatccaattgttttattagcgaaatcatcatct

SEQ ID NO: 59229 - DNA, 201 bp, Homo sapiens
tccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagt

SEQ ID NO: 59230 - DNA, 201 bp, Homo sapiens
tacagaccccaaagcttgctgtcccctgggcaggtgcatgagggggtcccaggcaatcaggctcttctcaaacctgaattatacccggcctcagggtatargggtcaggcagctgtttgacaggattcttgcaaatgtttttggtttctctgtctactcattacgtacactctgccagaggttgaaaactcaatgttgaga

SEQ ID NO: 59231 - DNA, 201 bp, Homo sapiens
tgttgaaggtcatttgaaaaatactctgtctttattctttgaaatggatttactctcaagaaagttgcatgtcactttacttggaagagacgggtctcagkgaggtgtgcctccgctttcatgaaaagtctcccgtctgcagaagcattggctgacatggaagattttttttttttttaatacttttctttttgccggcat

SEQ ID NO: 59232 - DNA, 201 bp, Homo sapiens
ggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttccctt

SEQ ID NO: 59233 - DNA, 201 bp, Homo sapiens
gcaaagtcaagttggagatggctctcgatatgcatgagtgtgttagactgcttttcttctattttttaaaaatgcacccaaatgtaaaagacacttttacstttttgatttgatgttgaaggtcatttgaaaaatactctgtctttattctttgaaatggatttactctcaagaaagttgcatgtcactttacttggaaga

SEQ ID NO: 59234 - DNA, 201 bp, Homo sapiens
taatttttgtatttttagttagacaccaggtttcaccatgttagccatgctggcctcgaactcctcacttcaggtgatctgactgccttggcctccgaaartgctgggatgacaggcgtgagctgccttgcctagccaaataactccattatttaagaaaaattaaccagtatttattgaatacttactgggccctgtgct

SEQ ID NO: 59235 - DNA, 201 bp, Homo sapiens
tcttgcttgtaggaagaacaagagacgagacacagcaaggtgatgatgggtatgtgaagcaggataaagaaaaaaacaggacaggcattacaggcttaagyctgtaatcccagcactttggaaggccaatgcgggtggatcacctgatgataggagttcaagaccagcctcaccaacatggtgaaaccctatccctattaa

SEQ ID NO: 59236 - DNA, 201 bp, Homo sapiens
ttcacagtgtttctagctcccctttccaatacatctctctctctctttctctctctctctctctctctctcacacacacaacacacacacacacacacagscaaatcagacaccaacataaactgtagagttaacattctttttccaccctcacactttttttagctccgatctgtgttcaatttctgcctgagagagtga

SEQ ID NO: 59237 - DNA, 201 bp, Homo sapiens
cagcccaacacaaatgtataaacttgcttaaaacatgatgagatattttttgccattttttttcaactcatcagctatcattagggttagtgtattaataytttatgcacagcccaagataattctttgtccagtgtcacccagggaagccaaaagattggacaccctgggaataaaacagaaaaaaggtgtaaaaggctt

SEQ ID NO: 59238 - DNA, 201 bp, Homo sapiens
aagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaacagcttgtttgtggtt

SEQ ID NO: 59239 - DNA, 201 bp, Homo sapiens
agctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcgccctcactaataaattctg

SEQ ID NO: 59240 - DNA, 201 bp, Homo sapiens
aatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagcta

SEQ ID NO: 59241 - DNA, 201 bp, Homo sapiens
agatgcctccagcaattataattgaatcttgaagctagagtttcttggctatcctatttcccttttgtttccaccatgaagaagtggagagccgtgtgacstcagtggtagagctgatgtagaagcgccctctctgttcctggcagtgcctgtcctgctaacctcgtgtctcttgctggggtcttcatcagtaagagacct

SEQ ID NO: 59242 - DNA, 201 bp, Homo sapiens
ttttttgcccttttgggggacaaaatgtctttatgttaaattgttttattattgttatctttatggagttaagggcacataaaatattcttacagagagarattctgtagtttccacaagtaaccagagaattgttcatggcagagaattattttttcaatgcctattttctcctgaattttctgacggagttagagatag

SEQ ID NO: 59243 - DNA, 201 bp, Homo sapiens
tttctgttttcttcttccatttttatgttttgctatgccattcattcattctattcttttcatttctttttctttttgtaaaaattgtacagagtttaaarttagtcaggtatgtctattaaatttttacgtaaaaagttaaagcagccctcagcatcaacttcttcttcatttctaactcatttagtgaattcagttggt

SEQ ID NO: 59244 - DNA, 201 bp, Homo sapiens
aggcagcagaattgcctgaactcgggaggtggaggtagcagtgagctgagatggcaccactgcactccagcctgggcaatggagcaagactctatctaccmcccaccctgcaaaaaaagaaaagaaaggaaaaaaaatcttggtgcttgtaggagaggcatttatttcttttaggactggacggggcttggagggtttcca

SEQ ID NO: 59245 - DNA, 201 bp, Homo sapiens
taaacaagaacaaatggagaatctttcactatgactgcaactgaaaagaggagtaatggaaggacatgtactcttcccatatatttttaaacaattactgkatctgatttttcatttttcattttttttttttctggaagaaagagcagatctggataaagtcagtatacaatgtggtctttggtgacagacccaagttca

SEQ ID NO: 59246 - DNA, 201 bp, Homo sapiens
ttgataactccctggcaggttctcttcatcgggcctccacatagggtatgcgaacctcttcatgtttttaaaagggagagatttaataaaggcaatttggkacttaaaaattgttagaagagctaaaagagtagttttgaggttgaccttcagaacggcttcctgaataatacagaagtgaccctccaggaaggcccttcc

SEQ ID NO: 59247 - DNA, 201 bp, Homo sapiens
gtgacaataatggagatagagaaaacaggatggattcaggaaacatgaccacactgagcatattcaaatgtaattgtcagttttcgtgtctccctcccackggaccacaagcccctaactcttcatgtacacaccctgactcccagtgtgggctggccacccaggaggcacccagtttatgtgtgctgcgtgagtgatgtg

SEQ ID NO: 59248 - DNA, 201 bp, Homo sapiens
ttgtgatttattaaccatttacttggctttggagaaggcagcatttttagtagtactgttgagcctgcatgtagcttttccaggagggcagggtgcctggatatctgatcttacagttattactttgtgtcatatataattttgttttctccctgcaacaaataaatctttgggactccggaagaaaaaaaaatgggaaag

SEQ ID NO: 59249 - DNA, 201 bp, Homo sapiens
gcaacctctgtcgattctccttcctcggcctccgtagtagtcaggactacaggcatgcaccaccatagctggctaatttttgtatttttagttagacaccrggtttcaccatgttagccatgctggcctcgaactcctcacttcaggtgatctgactgccttggcctccgaaagtgctgggatgacaggcgtgagctgcct

SEQ ID NO: 59250 - DNA, 201 bp, Homo sapiens
gggaaagaaaaaaaaaatttgtggttacagtataataaaaataaactgtttgtcgtgactgcagctgacatttatcagcctgtttgtgggtgatctttctctctctctataatacagaacataatttgtcactttgtaaatacattccagtctaaatccctgccagcatctgttagtgtttgaaggattaatgtgctaccc

SEQ ID NO: 59251 - DNA, 201 bp, Homo sapiens
attagtgaagcagaggttgaaggaggtcacttgctttttatcccaatgtcaaataactccataattttttttattattttttgagacagagtcttgctctkttggccaggctagagtgcagtggcgcgatcttggctcactgcaacctctgtcgattctccttcctcggcctccgtagtagtcaggactacaggcatgcac

SEQ ID NO: 59252 - DNA, 201 bp, Homo sapiens
gaaagaaaaaaaaaatttgtggttacagtataataaaaataaactgtttgtcgtgactgcagctgacatttatcagcctgtttgtgggtgatctttctctctctctataatacagaacataatttgtcactttgtaaatacattccagtctaaatccctgccagcatctgttagtgtttgaaggattaatgtgctaccctg

SEQ ID NO: 59253 - DNA, 201 bp, Homo sapiens
gtcattgattgaaagagtcatggcatagatgctgaagttttgatgggaactttgcaggatgttcgtttgtttatcattagccctgggagagtcatccctcrcctcccaccaccccttaatttaaagggatttaaaatattttcaagtacatcctgatatcagcacgtggtacactgagcctagttgatggaattgtgaaaa

SEQ ID NO: 59254 - DNA, 201 bp, Homo sapiens
cttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacag

SEQ ID NO: 59255 - DNA, 201 bp, Homo sapiens
caacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctcttttt

SEQ ID NO: 59256 - DNA, 201 bp, Homo sapiens
attataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgcttt

SEQ ID NO: 59257 - DNA, 201 bp, Homo sapiens
tttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgc

SEQ ID NO: 59258 - DNA, 201 bp, Homo sapiens
caagcacctatcgttttcctgtgtattccaagaggccagtgtggctggtggaataagatgttttcctgttttcaagatgcagtggactctcttttatttarcagcagtgtctatgtgttaggaatccatgtgagttctctaagtctgggacaacgataggtgtgtctgagtcctgcattaccatggtttattctttccttt

SEQ ID NO: 59259 - DNA, 201 bp, Homo sapiens
ttctttttctttttgtaaaaattgtacagagtttaaagttagtcaggtatgtctattaaatttttacgtaaaaagttaaagcagccctcagcatcaacttyttcttcatttctaactcatttagtgaattcagttggtctttatatatgtagctttaagtaattgcatgtaaactgttacttcttcattttctagtcttag

SEQ ID NO: 59260 - DNA, 201 bp, Homo sapiens
ttccttctactttggtgccccatgatgatgtgcatcttttttatttctgcatcatatccatatagtgatatcatgtataatgatgtttaagaagacagttwtttttgtttaaattgttataaataagtaagtgtatgcaccactatgccatgtagcatatcaagattatttttctttcctgcaccttattttttccctgga

SEQ ID NO: 59261 - DNA, 201 bp, Homo sapiens
tatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatac

SEQ ID NO: 59262 - DNA, 201 bp, Homo sapiens
agaagacagttttttttgtttaaattgttataaataagtaagtgtatgcaccactatgccatgtagcatatcaagattatttttctttcctgcaccttatwttttccctggagttaatactcatctttttttagaaatttgctgagtttgtgatgtacctatcattcaacctcaaactttcatgtgattgtctaaatctca

SEQ ID NO: 59263 - DNA, 201 bp, Homo sapiens
tatcattcaacctcaaactttcatgtgattgtctaaatctcagttccttttattagaaaaaaaaaaaaaaacaactcccctggagcctttgtaccttctgyagtttggggttgttgtcctttttgcttggtgcacaggaatacttggtgatgttctttttaaaactgccctcacattgtatcctggaaagttcatttacct

SEQ ID NO: 59264 - DNA, 201 bp, Homo sapiens
ttaaaggtagaaacagaaaaaaacaggcagaaacataaaaagctcggagatggcttcctattgcttcttcattctgggccagagcaaatcatatggtcgtrctccagggtgaggaagtatgtcccacttacagactgaaaaggtgctgcaagtctgcacggcagagggcatggataaggggttcgtaaaaacttagggcca

SEQ ID NO: 59265 - DNA, 201 bp, Homo sapiens
tcttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatga

SEQ ID NO: 59266 - DNA, 201 bp, Homo sapiens
ttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaa

SEQ ID NO: 59267 - DNA, 201 bp, Homo sapiens
acacatgtgcagccactgtatgacgtctggattttccttgacttatggtgatcactattgggaggtggtaagcaaacaggtgacataatttgaatcatggktttaaaagacgccatggttgccatgaggaggacaatgcgtaggaggcaggagtgaaagctaaaggatatgctgggaggtgaccctggagttaaagagagc

SEQ ID NO: 59268 - DNA, 201 bp, Homo sapiens
tgcaaaggccctggggtggaaacacactcgatgtgttcaagggagagtaagtggtgaatgggtttggagccaacagggataatagacaacgctatcaagargggggccaaccacacatgtgcagccactgtatgacgtctggattttccttgacttatggtgatcactattgggaggtggtaagcaaacaggtgacataat

SEQ ID NO: 59269 - DNA, 201 bp, Homo sapiens
tctaaatccctgccagcatctgttagtgtttgaaggattaatgtgctaccctgtgtatgtctgcacttccagggaacagtgtagcatctgattacagatcktgggagagcaggagggaacaaggtgttttctgtgctttttcctacatgcagtcgttttggcctttttctgatttttcttgtctttatcccattctgtcta

SEQ ID NO: 59270 - DNA, 201 bp, Homo sapiens
aaatctcaagcacaggtgcagcaagtgcaaaggccctggggtggaaacacactcgatgtgttcaagggagagtaagtggtgaatgggtttggagccaacarggataatagacaacgctatcaagaggggggccaaccacacatgtgcagccactgtatgacgtctggattttccttgacttatggtgatcactattgggag

SEQ ID NO: 59271 - DNA, 201 bp, Homo sapiens
ccagatgtggaagaaatagcctcattagtaacttttctgtaagcaatctccttatttcttgttttttgttcttttgttttttgtgtgtgcttctgcgtgcmcctcctctatggctccccccaccaaatttctgtgtcttcatttgcaactctcttttctccagtaaagaggaaagtgtatagttctcctttccttacagaa

SEQ ID NO: 59272 - DNA, 201 bp, Homo sapiens
atagaatgatccaagtttataatttgtaaataagtagacatcttttgaggcgtatgcccttaatttttctaactgatgaaagcgtacttccatcaactcargacagttcaaagcagcttggagcctcttggattttaaaaagactctgtggcctctgtctctcttggttttcagtgctcagctgaggtctactctgtttat

SEQ ID NO: 59273 - DNA, 201 bp, Homo sapiens
ggactattgttgtccatatttcacagatgaggaaagagatgtgctaagaaaagaggtggcagagtagggattccagctcagtagccactttcagggtcccrtacttttcaatgtaagcatattggctctcaatttaaaaatgttattttttacagatagtacacagatgcactgacacaggtaccctctccagtcctctga

SEQ ID NO: 59274 - DNA, 201 bp, Homo sapiens
tatagaacatttctaccatagtagaatgctcttttggatacatctgctttaaagcattagtccccaaagtgtgaaggatgaaccacttgggttccgagagraaacattataacttctgtttatccattaaactctttcatttattattaaacatctcaacacatttattgggtggcaggtactgttttaagtgttttgcat

SEQ ID NO: 59275 - DNA, 201 bp, Homo sapiens
aggctcattgcttacataccgacagcatacaaattgtcaagtacttaaagttccattgttgctgaaagggcctccacccaatgtccttaaatggtcccccytttttttttttttttcaaaccacaggatttacatctctcgtagcatctaatgaaataccagcaagaattgtgtgttggtgtaagaaataataatctttcc

SEQ ID NO: 59276 - DNA, 201 bp, Homo sapiens
cagtctattgttacaatattgcgtgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcccataaaa

SEQ ID NO: 59277 - DNA, 201 bp, Homo sapiens
tatatattttgaggtataaaaagtacgtgctcaaggtattggtcactcctcaatttgttttccttgaaacaaaatgaaggtataaatatttcagccgggcrcggtggctcacgcctgtaatcccagcactttgagaggccgaggcgggtggatcatgaggtcaggagatcgagaccatcctggctaacaaggtgaaacccc

SEQ ID NO: 59278 - DNA, 201 bp, Homo sapiens
ttgacactaaaagcttaagtcccatgatttgcctttgtggatggaaggccttggccttcttttatgatatatgtgttggggggaggcatgtggtatgtggrgcgggtaaaatacgagcctcatgcctgtctaagctggtgacttggcttggaaaagatgatcattcgtcaacgcatcacaagtcacagggcttatctccat

SEQ ID NO: 59279 - DNA, 201 bp, Homo sapiens
ttctaaatactctcccagagtagggaggaaaaatcatccaaactacttggtaattgaattcaagagtgatggaccaaaaattattaatgcattcccttccstccaccagccaaagaggattccatctttattctcctcccaaatgcaggctccattaaccttttacctttctttctttccggtctttcttttctatatctt

SEQ ID NO: 59280 - DNA, 201 bp, Homo sapiens
tgaggcaggagaatcccttgaacctgggaggcagaggttgcagtgagccaaggtggtgccactgcattccagcctgggcgacagagcgagattccgtctcaaaaaaaaaaaaaaaagtaatcattttagaattgctttctcttcgggatggtttacctcgtgtttagtctgtaaacgcggataaccgagagctggtcaaat

SEQ ID NO: 59281 - DNA, 201 bp, Homo sapiens
aagaaatggagcaagggaggggtttcatcccgccgtgttcatttgcttggctgtcctgaaattgcgaatacgcagttgttacctgctcccggtgggagggrggggatatttatttggcatcttgcaattgataggagctgagtgattttagtaggtagtttaactccttaaaaacttccagtggtttcatattctacctag

SEQ ID NO: 59282 - DNA, 201 bp, Homo sapiens
tgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgctcctgccagctctaatagggaatgtgtg

SEQ ID NO: 59283 - DNA, 201 bp, Homo sapiens
agtagtagtgaatgccctgactttggggtttgcagtaagctaggattaagtgcttcacagtgaggcacagtggggagctactctgaggatgaattgcctartaaataagtgaggtttgtataaccgaggccagatcttagaacctcctgctatctgtacatagaagaatgttttagtcagaggcaaggcaaggtcaccagg

SEQ ID NO: 59284 - DNA, 201 bp, Homo sapiens
gtacaatggctgacgcccgtaatcccagcgctttgagaggccgaggccggtgtatcgcctgagtccaggagttagagaccagcctgggcaaacagcctgargcaaaacctcatctctacaaaaaatacaaaaaatcagctgggcgtggtgatatgcatctgtggtctgagctactcaggaggataaggtgggaggatcatt

SEQ ID NO: 59285 - DNA, 201 bp, Homo sapiens
acactctaaggaatggcatgacattctcctttcttctcctgcattcattggaacctgaatgtagtattaattataagactgttagacttcaggggactacmctcttattctaaaatagtggtcaactaactgtgcccttcagacagaattcctgcccagcacctggctttgtaattaaagttttactggaacagaggaata

SEQ ID NO: 59286 - DNA, 201 bp, Homo sapiens
ttgctgagaggtggggagggggtgggggctctgtgcatggaatggggggaaaagcttcagggaagggcagtgcaaattgtttctggactgatgccatcttytaataatagtagttaatagactgggtacaatggctgacgcccgtaatcccagcgctttgagaggccgaggccggtgtatcgcctgagtccaggagttaga

SEQ ID NO: 59287 - DNA, 201 bp, Homo sapiens
agaggaataccagttaatttatatctcgtctgttgccacttttgctttcatgctattaaagctgagtatttgggagatacttgaaaaatctaaaatgcttmctatctggccctttagagaaaaggttttccaatctctgttctagaggattcgtggtcatttggaaagaaaagtatgttaagacaaaatgagcaggtggtt

SEQ ID NO: 59288 - DNA, 201 bp, Homo sapiens
gaaaagtatgttaagacaaaatgagcaggtggttggattagtattttctttctacacatatagaaactgttcctatcatacctgactcagttttcaaactkgcttaatccaaagcctggggggtggatgtaggagagaagttgaaattagctggggttttttttttgtatcacaaaagttacatttttttttttttttttt

SEQ ID NO: 59289 - DNA, 201 bp, Homo sapiens
gcaaccaaagggagcataactctgataagaataataaaaagaaacaattcagcaactctcttacagatttttatcatcatcccattcataattgattccaracgtgcatgaatctttcaagataagtgtcttattgattatcctgaaaacaagcgatcacttggtgtcctgagattcgctcactgccctcccctgattacc

SEQ ID NO: 59290 - DNA, 201 bp, Homo sapiens
tggaactacaggtgcccgccaccaggcctggctaattttttttgtattattagtagagatggggtttcaccgtgttagccaggatggtcttgatctcctgwccttgtggtccgtctgcctcggcctcccaaagtgctaagattacaggcacgagtctccgcacccggccctgtttttgcatttttagtagagacgggtttt

SEQ ID NO: 59291 - DNA, 201 bp, Homo sapiens
gacgggttttcaccaggttggccagcctggtctcaaactgttgaccttaggtgatctgcctacctcggcctcccaaagtgctgggataacaggcgtgagcmactgcgcctgtctacattttctgtctttactggtattatggtgggaacccataaaccactgcgaggcagataccattttaagcaggaaaccttatttttt

SEQ ID NO: 59292 - DNA, 201 bp, Homo sapiens
aattctacattcctaagaagctcctaacaggctgataatccatggatcgcattttgaatagaaaggattatgcaaaaagccagagtttttttttcccttgycttataccagtggtgcctagcatggtgtcaggtttatagaggactaatacatataagaaggagaaagggagggaggaggaattccagttgtttttttttt

SEQ ID NO: 59293 - DNA, 201 bp, Homo sapiens
attgggtagcaccgatatagaacatttctaccatagtagaatgctcttttggatacatctgctttaaagcattagtccccaaagtgtgaaggatgaaccamttgggttccgagaggaaacattataacttctgtttatccattaaactctttcatttattattaaacatctcaacacatttattgggtggcaggtactgtt

SEQ ID NO: 59294 - DNA, 201 bp, Homo sapiens
acatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgca

SEQ ID NO: 59295 - DNA, 201 bp, Homo sapiens
tatggagtgtcagaaatagtgaagcttctggagcttcactgtccaatatggtagccacgtgtgactattaaaatgtaaattaattaaaattaaaagttcarttgctctgaaatagcagccacatttcaaatcttcagtagccagatgtggttattggctaccatattgggtagcaccgatatagaacatttctaccatagt

SEQ ID NO: 59296 - DNA, 201 bp, Homo sapiens
aaaacagcaggaaaaactacatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggct

SEQ ID NO: 59297 - DNA, 201 bp, Homo sapiens
atcactgtgtaacttcatccaatacgtattgaatacctactatgtgtctggcaccacttcagacagtaaggatatggatatgaatttgtatcagtcaagcyttccaggatcttattatctagagagaaagattaaaacatatgcaaataattttgatagaagcaaagacctaactcagcctgagaggaggttgggtttaga

SEQ ID NO: 59298 - DNA, 201 bp, Homo sapiens
cttcttccccctacttccttcttatatctggctatctgggagagaaaaaatttaatacaattgattactttttagaagagttaatttttacttattactgkggattttttgttttttaacagtcacaccgaggagaagactcagtgggaacatccaaaaactggaaaaagaaaacgagtggcaggaggtttgtatgttgtt

SEQ ID NO: 59299 - DNA, 201 bp, Homo sapiens
ctgagtagctgggactacaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggcccccctttcttcttttttaaagtggggtattaag

SEQ ID NO: 59300 - DNA, 201 bp, Homo sapiens
atctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtag

SEQ ID NO: 59301 - DNA, 201 bp, Homo sapiens
agtaagcacagtggctgggataggaccttggcatctcgtgcgaagcccctctgcctggagtcctgcctctgtgacacttgcttactgtgtgacctgggtcractcatacctactgttcgtcagttttctcatctgtaaaatggggattccagtggttattatgagaattaaatatgacgatacataaatagcacctggaaa

SEQ ID NO: 59302 - DNA, 201 bp, Homo sapiens
tcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagag

SEQ ID NO: 59303 - DNA, 201 bp, Homo sapiens
aattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagagg

SEQ ID NO: 59304 - DNA, 201 bp, Homo sapiens
atgtaagtgtagctccaatgtgagttgttacttgtagagaacagctatgtcaaaaccacaccaaaaacgatttggaaaggaaataatttgactggtcattktgtttatccatcaactgagttggattgatatatttttcctttggccttcaaaggaaatttgagcattcattcattcatccttttagagaaatattctcta

SEQ ID NO: 59305 - DNA, 201 bp, Homo sapiens
ggaacatgtgctctgtgtgctggaagctcctggaggccccagggttatctctgctcacttaggtttgtgatgttgggcaaaaggagaaaatgctgagtctrttcggacccaacttccattaatgcctgagaaataatttaaatcgcaagatttccaatcccataagcagccctagcctctcttctcctgatactccacata

SEQ ID NO: 59306 - DNA, 201 bp, Homo sapiens
gttgctgagaggtggggagggggtgggggctctgtgcatggaatggggggaaaagcttcagggaagggcagtgcaaattgtttctggactgatgccatctyttaataatagtagttaatagactgggtacaatggctgacgcccgtaatcccagcgctttgagaggccgaggccggtgtatcgcctgagtccaggagttag

SEQ ID NO: 59307 - DNA, 201 bp, Homo sapiens
aggtgtttcttatttttatcattttccgtaaaggtaggattgtgttgacagccctgtaataaatgtctcttggaagagatgtgttgctgagaggtggggarggggtgggggctctgtgcatggaatggggggaaaagcttcagggaagggcagtgcaaattgtttctggactgatgccatcttttaataatagtagttaat

SEQ ID NO: 59308 - DNA, 201 bp, Homo sapiens
tcttcttgtaaggtgtttcttatttttatcattttccgtaaaggtaggattgtgttgacagccctgtaataaatgtctcttggaagagatgtgttgctgaraggtggggagggggtgggggctctgtgcatggaatggggggaaaagcttcagggaagggcagtgcaaattgtttctggactgatgccatcttttaataat

SEQ ID NO: 59309 - DNA, 201 bp, Homo sapiens
ccatgcccaccttgctgttgcaccccccaccccaaggaaagccttcccacctttggaagctgcattaattcttccaggccacaagggggccgttgagttastggttcactgcactggctggcaggaaagagttttaatgcaggctccaaaggtgcttaatttcctgtggtccttatgaatatgcatacagtatgtgctcag

SEQ ID NO: 59310 - DNA, 201 bp, Homo sapiens
atagagttgtgtattgttgggaactaattatatgtattataaatccaagaattaatttaaatgacccagtttccacagagaaaaagccacattgtttttamatagctaactaaacaaaatgctaacccatatgggagaaatttccaaagaattaaaaccacccaccaggaaaatgggaaagtctcccctccacacacacac

SEQ ID NO: 59311 - DNA, 201 bp, Homo sapiens
acatcgcataaagatgcagatttgattccccctttactcacactataaaaacaaagtttttaaagtggttagccatacctggaaatgtaaatgcattcgcstaatgtaatgccaaagaaaaattaagacaaatgataccacatcgctgccacaaactgcggctcgtacaaaattcactttagttattatgctgtgaatacg

SEQ ID NO: 59312 - DNA, 201 bp, Homo sapiens
agaatacatacttcataagcaggaggcatatatgtttgtatatatgtatgtacatagacttcatacacatgaaataaaatttcaaatggttcctctgttcmgcaaacgtgacccaaagttttggcttatttggcgttttgttttcttgaagacatacttgaattttaaatagttaatccatttaagaagtttcatttaagg

SEQ ID NO: 59313 - DNA, 201 bp, Homo sapiens
gatgttaattgagatataggagtacttcattaagtctccagaatacatacttcataagcaggaggcatatatgtttgtatatatgtatgtacatagacttsatacacatgaaataaaatttcaaatggttcctctgttcagcaaacgtgacccaaagttttggcttatttggcgttttgttttcttgaagacatacttgaa

SEQ ID NO: 59314 - DNA, 201 bp, Homo sapiens
tattgtgaaataccatttgacccagcaatcccattactgggtatgtaaccaaaggaatagaaatgattgtattataaaggtacatgcacatgtatgttgaytgcagcagttttcacagtagaaaagacatggaattcacccaatccgaattttaacaagtcttccatgtgattctgagacagactcatgttcgtgtggttc

SEQ ID NO: 59315 - DNA, 201 bp, Homo sapiens
tttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccacact

SEQ ID NO: 59316 - DNA, 201 bp, Homo sapiens
cacccaatccgaattttaacaagtcttccatgtgattctgagacagactcatgttcgtgtggttctggctctgcagaactgaggtgggccccaaaacttgmgtttctaaaaggtactagctgagcatgatgactcacatttgtaatcccaccactttgtgaggccgaggcgggtggatcgcttgaggccaggagtttgaga

SEQ ID NO: 59317 - DNA, 201 bp, Homo sapiens
gaaggcctaggaggtgcagggatgtttatatgggctgctagcgcttagtttcctgccacagggagacagtaagaaaggtgacgtcaatctgagatgagagrgagagcaaaacagttcttttgaccaccttgaccccgaccttgaaataaggtggaactaataaatcccgctttgtgctggagcaagttttggctgagtttc

SEQ ID NO: 59318 - DNA, 201 bp, Homo sapiens
ttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctattttt

SEQ ID NO: 59319 - DNA, 201 bp, Homo sapiens
gccaccttttgccgcagtaacaaacaatcccagactctcaaggcttgcaaaaataaatgtgtgtttgtttgctcataacacatgtggctgagggttggccrtggctccacagtcacaggtgggctttcctgggctcagcttctcacagcgtctccttgcagggcccaggctgtaggagatgtcatcagggcctgcagaggg

SEQ ID NO: 59320 - DNA, 201 bp, Homo sapiens
caggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcg

SEQ ID NO: 59321 - DNA, 201 bp, Homo sapiens
ttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaaga

SEQ ID NO: 59322 - DNA, 201 bp, Homo sapiens
tttatgttgctattgtatcgtaaggttcttctgaagcgaccacttcataacactgtgtagtccaatccctaagctgggcaatttttttttcccctttcaawacatcacattgattttctgtatgactttatctgcttaatacaaagtgggattgaacagttatttgtctggatttgatcattccttattaaacatttatga

SEQ ID NO: 59323 - DNA, 201 bp, Homo sapiens
aggcaaacaaaagaagccacaacagtctaggaagaaatctttaatttctattcagctttaaagagtttgagagcgttttttcccctctgttaacaaacgasttcaagtacatgccttcatattataaaagtacctgaaattgcctagaatagcagcatgcatagcttgttagtatttacatatatttacatagggaaacaa

SEQ ID NO: 59324 - DNA, 201 bp, Homo sapiens
gctctctgagccaataaaagaagctatattcagcactggctgtataagatctttaatgttttaggctgtcaatgttggctgtggttaggctgacataattrtgagctgcatgtaccaatatatagctctttacccacaaaagcatgctgcaacggggaatctttcagagataataaaaggattcatcaagtgtctatacga

SEQ ID NO: 59325 - DNA, 201 bp, Homo sapiens
agcctctgacttgcaaggtgtgcttcagaaatttgcagcttctatttaggtaggaagagtttgccagcccgaaaactccagtaagcaaacagctttatagyaccccagccatagaaagtgagagctttcgaagaatctgtggttagaactaagaggatttttctttctcctttttctgctgttattatctcaaggagagag

SEQ ID NO: 59326 - DNA, 201 bp, Homo sapiens
aaagatagtgtgcatgcctcatctctaaggggcagccattattgacgtccagctgaatgttgccacgtggaaattagctataaacttgccagaacctccartttttctggagagattagattagaaattcatatatttttaaatattaaatcatccctttttcttgagatggtgtcacgtcgttgcccaggccaccgttta

SEQ ID NO: 59327 - DNA, 201 bp, Homo sapiens
gctaaatctatgtccccaatatagggaagacaggagaaagtgccaaagatagtgtgcatgcctcatctctaaggggcagccattattgacgtccagctgartgttgccacgtggaaattagctataaacttgccagaacctccagtttttctggagagattagattagaaattcatatatttttaaatattaaatcatccc

SEQ ID NO: 59328 - DNA, 201 bp, Homo sapiens
gccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattatt

SEQ ID NO: 59329 - DNA, 201 bp, Homo sapiens
cctttcccaaaccatagattcatggaactgtcaaagagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgctt

SEQ ID NO: 59330 - DNA, 201 bp, Homo sapiens
ttggccattgcccactaagaaaatttaggtggtttttattgggattagtggatgaacttaggattagtgtggcccttccttgagatataatgacaaccttsgtgaaagcaagaccacagggcctatcttcagggaagtgccttgcattttaataccaaccatgccacgtgtatgtgtttcctgggcctgccataacaaatt

SEQ ID NO: 59331 - DNA, 201 bp, Homo sapiens
ttcgtcctgaaatcctccctgctcacaaaacagccagctacttggttttctaaaagacgtaattttgcaggcagacttcgtagagccattctgtgcagaasaagggaagggagaagctgtttgttttacctgtagtatgaagatattctttgcgctgttagaactgagctcattaattctgcctggcaataatttcaaagg

SEQ ID NO: 59332 - DNA, 201 bp, Homo sapiens
tattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaaggcaggctcgatgatacctgcaca

SEQ ID NO: 59333 - DNA, 201 bp, Homo sapiens
tttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttg

SEQ ID NO: 59334 - DNA, 201 bp, Homo sapiens
ggaaaatgtgatatgacagactggaaccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaattt

SEQ ID NO: 59335 - DNA, 201 bp, Homo sapiens
caatttcctcatgatactggaaggcagtctccggtcagcacggggctgggtctagagttttcagttcacaaaagtggaaaatgtgatatgacagactggawccagcacagggacgcagcccctcacctgctgggggtctttgggtgggtcctgtagccccagagcctctcgatgacctatgaacaggaacagaaccagcac

SEQ ID NO: 59336 - DNA, 201 bp, Homo sapiens
gcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataa

SEQ ID NO: 59337 - DNA, 201 bp, Homo sapiens
ggggtcagggggagggtgcacctgtccgccaccccaatttcctcatgatactggaaggcagtctccggtcagcacggggctgggtctagagttttcagttyacaaaagtggaaaatgtgatatgacagactggaaccagcacagggacgcagcccctcacctgctgggggtctttgggtgggtcctgtagccccagagcct

SEQ ID NO: 59338 - DNA, 201 bp, Homo sapiens
tgaggctaaaataagctgcttttagtatcacatttggcaagtagtaaactctggataaatatacttttgaattgtgtgattattgttgttaccatttattraaagggaatgatgaatgtagtgagagaaggaaggaagagagagagggaagaaggggaaaaagagggatggaaaggaggaaggaaggaaaggagggaggag

SEQ ID NO: 59339 - DNA, 201 bp, Homo sapiens
acctacagaaaaaaatgccaagaatgcacgctgggaattcattaagagatttcaggacgttgaaatactgtgtgtacttgcaatccccacttgaccaaagstgtccaaacctcgacagacagcggccagagaaggccccatcatagactctgcgcctggctaattactcaggagcaaagcaggtcgttaggggtcaggggg

SEQ ID NO: 59340 - DNA, 201 bp, Homo sapiens
gtcagtagcaggccaccaagagccatcccacctcagaaagacagaagccatcactgcaaatggcaagggcatgaggcagtttgaaactggcaaaactggasctttcatggaatccagggcttgagctttaatgctttacacttttgttttttcattccatacgcttttgctttagcttcctggcaaaattcagacaaacct

SEQ ID NO: 59341 - DNA, 201 bp, Homo sapiens
acagttgatctaactgattcatggggaccctgggagtatgtttgtgtatttgggggttgggatgggggggtgggtggagggtcagagaggtggcaaaagcrggtgggaacagggttacagagcaaagtaattagatgccctttagatgctcttagttaaagaccatgcaaaaaggatgaaatcttttgatcatgttcttca

SEQ ID NO: 59342 - DNA, 201 bp, Homo sapiens
ttggagacctacagaaaaaaatgccaagaatgcacgctgggaattcattaagagatttcaggacgttgaaatactgtgtgtacttgcaatccccacttgascaaaggtgtccaaacctcgacagacagcggccagagaaggccccatcatagactctgcgcctggctaattactcaggagcaaagcaggtcgttaggggtc

SEQ ID NO: 59343 - DNA, 201 bp, Homo sapiens
gccttgctgaggaaattaaattcctgttcgagtgctatttctttatggcactgaggagcaagcatttctaacaatcatattgcttaagaagtggatggcargaagataattactaatatgtctgcaattgatctgaaattgacacagttgatctaactgattcatggggaccctgggagtatgtttgtgtatttgggggtt

SEQ ID NO: 59344 - DNA, 201 bp, Homo sapiens
tgagtccttttcagagagtcatttggagacctacagaaaaaaatgccaagaatgcacgctgggaattcattaagagatttcaggacgttgaaatactgtgygtacttgcaatccccacttgaccaaaggtgtccaaacctcgacagacagcggccagagaaggccccatcatagactctgcgcctggctaattactcagga

SEQ ID NO: 59345 - DNA, 201 bp, Homo sapiens
tgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagat

SEQ ID NO: 59346 - DNA, 201 bp, Homo sapiens
atcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgata

SEQ ID NO: 59347 - DNA, 201 bp, Homo sapiens
aagggaggctgggaaatatagtttgctgtgtgctgggtgggtgggagggagcgtccacattagtgaacagccaggcagtcgctgcctcaaatttctttagkgttatcctttcattccagcaattgaatttgatttgcactgtttcacttctctacaagggtgtaaaaagtagaggttcctcttgaaagaatttcctcccca

SEQ ID NO: 59348 - DNA, 201 bp, Homo sapiens
caacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttata

SEQ ID NO: 59349 - DNA, 201 bp, Homo sapiens
tggccattgcccactaagaaaatttaggtggtttttattgggattagtggatgaacttaggattagtgtggcccttccttgagatataatgacaaccttgstgaaagcaagaccacagggcctatcttcagggaagtgccttgcattttaataccaaccatgccacgtgtatgtgtttcctgggcctgccataacaaatta

SEQ ID NO: 59350 - DNA, 201 bp, Homo sapiens
ccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttgg

SEQ ID NO: 59351 - DNA, 201 bp, Homo sapiens
ttttagtcagggtacataagtgtcagctgctacgacaaacaacttgcaacgtctcattatcttcatacaacaaacgctgatttgttcctttcattacatayccagtgtgagttggctggaaggtccaccctacacaaccactcgtgaaggcagacttgaaggggactccactgtcttggagctacactctaaaacaaatag

SEQ ID NO: 59352 - DNA, 201 bp, Homo sapiens
ttatgagggaggctgagatgtgagaagcacatgggtgttgggagagcactaaaggtctctagcccagaagcatgacttccagccaagtgagacagggaagsccagaaaaatgtgtcacagaacttatggcatcagaatctgattcccaggcatgctttccaccatatgcatagacatttgcaccccagggatagcaccatt

SEQ ID NO: 59353 - DNA, 201 bp, Homo sapiens
ttgtacaattatttgagtatactaaaacagctgtacagtatacataggtagattttatggtatgtgcattatatttcagtaaagttctttaataaattagytaatgcttattgtagaaaagttggaaaataccaaaaaccataaacaggaaataggaaaaaaagtaatcctgactgtatatctggaaatcttttcgtgggg

SEQ ID NO: 59354 - DNA, 201 bp, Homo sapiens
ttctaggcacattaaacggtcagtgcacaggtcctcatttttctcatgcttccatttccatattctcaatcaatcactgatggccagctgtcaacaggcaycatttttggtgggacctgaagatgtatatcccttgttttcagattcctcgcctctcatcatgtaaggtgatgctctgagctgggtcttaaagcttctggg

SEQ ID NO: 59355 - DNA, 201 bp, Homo sapiens
gtacactgatggtgttttgggaataagagtgtaggtagatagagggtggctagtgattgctaatttttttttttttttttgagttaaaaaagtgctataawattagaatgtagttatggttgtacaattatttgagtatactaaaacagctgtacagtatacataggtagattttatggtatgtgcattatatttcagtaa

SEQ ID NO: 59356 - DNA, 201 bp, Homo sapiens
atatgcacccggctagggacctctttaatggtcattcatttgggagatgacctttggttcctaaactggtggacataccaaggactaaaggagtgacttgytctcagttctttgtcattcagctgctttaatattaatatgacacccgttttgggcttgaaaagttttccttctgctgagaaatgatgatggtgacaatga

SEQ ID NO: 59357 - DNA, 201 bp, Homo sapiens
taaaatgtccggaataggcgaatctataggacagaaagtacactgatggtgttttgggaataagagtgtaggtagatagagggtggctagtgattgctaagttttttttttttttttgagttaaaaaagtgctataaaattagaatgtagttatggttgtacaattatttgagtatactaaaacagctgtacagtatacat

SEQ ID NO: 59358 - DNA, 201 bp, Homo sapiens
acgtattgtatggttccatttagtatataaaatgtccggaataggcgaatctataggacagaaagtacactgatggtgttttgggaataagagtgtaggtrgatagagggtggctagtgattgctaatttttttttttttttttgagttaaaaaagtgctataaaattagaatgtagttatggttgtacaattatttgagt

SEQ ID NO: 59359 - DNA, 201 bp, Homo sapiens
ctgttcctgaggcccccactgggaacccttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcata

SEQ ID NO: 59360 - DNA, 201 bp, Homo sapiens
gaaaacagtttggccattattcaaaaagttaaacattgaattaccatatgacccaataatcccactcctagatgtatcttgaagagaaatgaaaacatgcrtttccatagcatcttacaaatgaatgtacatagtagtgatattcctaatagccaataaatggaaacaatccaaatatccatcattggtgaatggataaac

SEQ ID NO: 59361 - DNA, 201 bp, Homo sapiens
gggaaatacttacaaattaaatattaaataagggatttgtatctagaataaagaacttttacaattcaataatgaaaactcatttaaaaaatgagcataaratctaaatagatattcctccaaatatgatacacaaattgccaatgaatacataaaagatgttcaatctcattagggaaatgcaaatgaaagccacaatga

SEQ ID NO: 59362 - DNA, 201 bp, Homo sapiens
ctttctctgttaccttcggaggaagccttctctagataccatctttaaaacagcaatcttccttctccatccccagcagcacctctgacccccttcacctsctttatttttctccatattatcattgccatcaatccaagcacaatttccagttacttacccattttgctttctccccgctctttgagaatgctggctcca

SEQ ID NO: 59363 - DNA, 201 bp, Homo sapiens
aagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctacc

SEQ ID NO: 59364 - DNA, 201 bp, Homo sapiens
agttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccag

SEQ ID NO: 59365 - DNA, 201 bp, Homo sapiens
ggtatttcctggcaacctttggtgtttggggcatgttgtcacctcattgccatctctgcctctgtcttctcaccaccatcttccttgtccatgtctctctrtgtcttcaatgttcttcttataaggacaccagtccttggatttagagtccaccctaattcactgtaatcacatcttacctaagtccatctgcaaagaccc

SEQ ID NO: 59366 - DNA, 201 bp, Homo sapiens
tgtaggttccgtatctccctggagaagcaccagcaattctctttcttttactgttatagaatagcctgaggtcccctcgtcccatccagctaccaccacgrccaccactgcagccaggggctggccttctcctacttagggaagaaaaagcaagtgttcactgctccttgctgcattgatccaggagataattgtttcatt

SEQ ID NO: 59367 - DNA, 201 bp, Homo sapiens
aaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaa

SEQ ID NO: 59368 - DNA, 201 bp, Homo sapiens
acagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccatagg

SEQ ID NO: 59369 - DNA, 201 bp, Homo sapiens
tcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaac

SEQ ID NO: 59370 - DNA, 201 bp, Homo sapiens
tctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaa

SEQ ID NO: 59371 - DNA, 201 bp, Homo sapiens
ttggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcattctacttggggaaagagacgtgaaagaaatcaagacatgcaagcaagg

SEQ ID NO: 59372 - DNA, 201 bp, Homo sapiens
gagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactg

SEQ ID NO: 59373 - DNA, 201 bp, Homo sapiens
gtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgt

SEQ ID NO: 59374 - DNA, 201 bp, Homo sapiens
actggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggt

SEQ ID NO: 59375 - DNA, 201 bp, Homo sapiens
ggtgatgtttgaacttaagaatcaaaaacagtgcaagcgctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgt

SEQ ID NO: 59376 - DNA, 201 bp, Homo sapiens
aaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaaggagctcagcctctttgttagctagaacaagaaagggg

SEQ ID NO: 59377 - DNA, 201 bp, Homo sapiens
aaggcctctgacttaacaggacttccgtgatgcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaa

SEQ ID NO: 59378 - DNA, 201 bp, Homo sapiens
tcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggagttaaagaaattaaactggtccttgtggaagc

SEQ ID NO: 59379 - DNA, 201 bp, Homo sapiens
ttctcttctccttccaagaaaaaacacccataccattcttaacatctctggaagctgggggtcaggagagggagatccataaagttcttgtcttccccgaytcaagaagcttaagggtacattcactcactcatgaattgactggtttattcattcactggttgattaattcattcattcactggttaattaattaattca

SEQ ID NO: 59380 - DNA, 201 bp, Homo sapiens
tcccctcctctccagccctcacctggttttctcttctccttccaagaaaaaacacccataccattcttaacatctctggaagctgggggtcaggagagggrgatccataaagttcttgtcttccccgactcaagaagcttaagggtacattcactcactcatgaattgactggtttattcattcactggttgattaattca

SEQ ID NO: 59381 - DNA, 201 bp, Homo sapiens
tggtgtggccatggttctcgtacttcaggtccctgtgagcccctggggtcctacacaacttggggtaatgctatggtcacctgcatcccctcctctccagycctcacctggttttctcttctccttccaagaaaaaacacccataccattcttaacatctctggaagctgggggtcaggagagggagatccataaagttct

SEQ ID NO: 59382 - DNA, 201 bp, Homo sapiens
tgcatagacatttgcaccccagggatagcaccattactcccaaaaattgcaggtttgaaagggtacctaaaaacaagccaccagattgtcccattccactrtcattctgccatcaacaccgaggtgtcggagtagcaggagagccacatatttcttagtgaggggacccagaatgatcccttttgtgctagaggatctgag

SEQ ID NO: 59383 - DNA, 201 bp, Homo sapiens
gggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtag

SEQ ID NO: 59384 - DNA, 201 bp, Homo sapiens
tcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaata

SEQ ID NO: 59385 - DNA, 201 bp, Homo sapiens
ctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctc

SEQ ID NO: 59386 - DNA, 201 bp, Homo sapiens
atgaaagccagccgggcacagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatga

SEQ ID NO: 59387 - DNA, 201 bp, Homo sapiens
gcctgggaataggatggcaggtcgtgggaccagcattttaattacctaaagggaacttattgattttagtccagaacacggtggggaggagttcatattcwttttttttttgagtctggattttagaataaattcactgtgtacatagctattccatctttaaaaacctttgtgaatgctaatatacagcctttataaatt

SEQ ID NO: 59388 - DNA, 201 bp, Homo sapiens
cctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaa

SEQ ID NO: 59389 - DNA, 201 bp, Homo sapiens
tcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcag

SEQ ID NO: 59390 - DNA, 201 bp, Homo sapiens
cccaaaaattgcaggtttgaaagggtacctaaaaacaagccaccagattgtcccattccactatcattctgccatcaacaccgaggtgtcggagtagcagkagagccacatatttcttagtgaggggacccagaatgatcccttttgtgctagaggatctgagttcatttcatgaaactgaagcatcttcttggagatata

SEQ ID NO: 59391 - DNA, 201 bp, Homo sapiens
tcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgaactcttgagctcaaga

SEQ ID NO: 59392 - DNA, 201 bp, Homo sapiens
gcaggagagccacatatttcttagtgaggggacccagaatgatcccttttgtgctagaggatctgagttcatttcatgaaactgaagcatcttcttggagmtataagctcaccttgggataggcccttgcagatgacaataaaggtattttggcacataaaaaaactgctcagcacaccttgtatttgtatttcctttgac

SEQ ID NO: 59393 - DNA, 201 bp, Homo sapiens
aataaaaccaatgagcttaatctacttgtggaatgttatagccggaagggattcatagagatcactctatcgcctaaaattctctcttctacatatctcastgttggaaaacataaatgtgactccaacttgtcttttttgttgtttgtttttgagacagggtctttgtttcccaggctggagtgcagtggcatgatcttg

SEQ ID NO: 59394 - DNA, 201 bp, Homo sapiens
ttagtgaggggacccagaatgatcccttttgtgctagaggatctgagttcatttcatgaaactgaagcatcttcttggagatataagctcaccttgggatrggcccttgcagatgacaataaaggtattttggcacataaaaaaactgctcagcacaccttgtatttgtatttcctttgacgtgaaccatggccatccagt

SEQ ID NO: 59395 - DNA, 201 bp, Homo sapiens
tccatctatttcaggggatgaccagtctgaataaaaccaatgagcttaatctacttgtggaatgttatagccggaagggattcatagagatcactctatcrcctaaaattctctcttctacatatctcactgttggaaaacataaatgtgactccaacttgtcttttttgttgtttgtttttgagacagggtctttgtttc

SEQ ID NO: 59396 - DNA, 201 bp, Homo sapiens
tgtgaaatgggaacatgacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcc

SEQ ID NO: 59397 - DNA, 201 bp, Homo sapiens
agttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatgga

SEQ ID NO: 59398 - DNA, 201 bp, Homo sapiens
ccgcagctcctgtagtagttatggtcactgactccgggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaa

SEQ ID NO: 59399 - DNA, 201 bp, Homo sapiens
gccacgcaacattcccactgccatgttggcttgtttttcttttgttttcttgtcaacataagcctcatgagacaacagcaggatgcaagattgtacaatgrcaccatgactctgctttctgggtgtcctctgtgggctctcagcagtgtccccgatgtggagggtcttcttattctgtgtgtgtgccctctgctgttgaaa

SEQ ID NO: 59400 - DNA, 201 bp, Homo sapiens
ccaaggaaatgaccagcacgtggctcactccctgtctgtccagtagaggacaccaaggcacgatgaccgcagctcctgtagtagttatggtcactgactcygggttcagacggacttggggttcagtcctagctctggcgcttaccagttttctcaagtgactttgagcatctttactcaaggctcttggtctcagttttc

SEQ ID NO: 59401 - DNA, 201 bp, Homo sapiens
gttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcct

SEQ ID NO: 59402 - DNA, 201 bp, Homo sapiens
ggtggaggttgcagtgagctgagatcacaccactgcactccagcctgggtgacagagcaagactgtctcaaaaaaaaaaaaaaaaaaaaaaaaattcaacwtacgaattttgcgaggacgcaaacatttaatccgtagtactgatgtggatatgatttgagctaagactctgctgttgattctcttcaaaaacttggcagt

SEQ ID NO: 59403 - DNA, 201 bp, Homo sapiens
atttcacagtgtttctagctcccctttccaatacatctctctctctctttctctctctctctctctctctctcacacacacaacacacacacacacacaccgccaaatcagacaccaacataaactgtagagttaacattctttttccaccctcacactttttttagctccgatctgtgttcaatttctgcctgagagagt

SEQ ID NO: 59404 - DNA, 201 bp, Homo sapiens
aaccacacttacatttaaatacaggcctttcccatttcacagtgtttctagctcccctttccaatacatctctctctctctttctctctctctctctctcwctctcacacacacaacacacacacacacacacagccaaatcagacaccaacataaactgtagagttaacattctttttccaccctcacactttttttagc

SEQ ID NO: 59405 - DNA, 201 bp, Homo sapiens
aaaaccacacttacatttaaatacaggcctttcccatttcacagtgtttctagctcccctttccaatacatctctctctctctttctctctctctctctcwctctctcacacacacaacacacacacacacacacagccaaatcagacaccaacataaactgtagagttaacattctttttccaccctcacacttttttta

SEQ ID NO: 59406 - DNA, 201 bp, Homo sapiens
ttgaaattttttatactatgttctattgggaaccatttcagggttttgagatatagtatgatataataacagctatgctaaattctttgaagttattggtrgtggaatatcaatccagaatgaaaataaataattttggaaatgagcctgtcattgaaatatactttatttctcgttaaatgtcccagcaaaagtattttg

SEQ ID NO: 59407 - DNA, 201 bp, Homo sapiens
ctttattattttaatggagtgcaaggtgcagtctttttgaagatgtagaatgtggccttataaaagctaagtgctactttatatttctgctgtccttgccsgtggcctgcactggggagttgtatattgtatcagtaattttaaaagccagcaagtgttctaccagctgaagaagttttcctaatggtggctggtcaaacg

SEQ ID NO: 59408 - DNA, 201 bp, Homo sapiens
tgaactgaagtgctaatgtgaaatgttcatgatggtacccgagtacttgcggtggtacctagcgtgtgctttccaagtgctggcaaagaaaagaaaagaawtgcttggggctctgcctacctgtctaggctcctgtctggccattctctttcttgttccaaccatatcaaactcactgctgttgctaaaccttcctgtctc

SEQ ID NO: 59409 - DNA, 201 bp, Homo sapiens
ttaatatcctcaaattaaaacatacgtttttaaagaaagattttgcagacttttaagctgggcaactgtctgccttacaagatgcgtctggaaaccccagygccatcctccttttttagtcttgtatatttatgtatccccggccagagttggctggggcacagtctaacagtgtcaccgtgtaagctgacccagtgacct

SEQ ID NO: 59410 - DNA, 201 bp, Homo sapiens
ggaatttattttaaattacagctttttctattggaagcattcatttatgttggattattgttccctgagtgaaatttcactgatgctgtataattaaatayagatttttttagagatagtatatattttagatgtataagtggataaactggaggtatggaaggtctttatttaaggagaataaatagcccaccccatcaa

SEQ ID NO: 59411 - DNA, 201 bp, Homo sapiens
ggctgggcacggtggctcactcctgtaatcccagcactttgggaggccaaggcagatgggtcacctgaggtctggagttccagaccagcctgaccaatatwgtgaaaccccatctctactaaaaatacaaaaagttagccgggcgtggtagcacacacctgtaatcccagcaactcgggaggctgagacaggagaattgct

SEQ ID NO: 59412 - DNA, 201 bp, Homo sapiens
tgactttaagccttaatgaaactaaggccggagcgggtggcacactccgtggctgggatccacagtgaaatctacgctgggagaggaggaatttagggtgrtaatttggttctttgctattgacgaaattttctaattgactggggttacttaataccagataatatttttttcttgctataaagagagtaaatttgtttt

SEQ ID NO: 59413 - DNA, 201 bp, Homo sapiens
agggtcattcatgttgtagcatgtatcagtacttctttttttagggctgagtaatattccatttacggatatgccacatttcatctatgcattcagttcayggacatgtgggttgtttccacattttggctattgtgcataatgcttccaggtacacttgtctacacatttttgtgtggatataggttttccttttttggg

SEQ ID NO: 59414 - DNA, 201 bp, Homo sapiens
ccactgccatgttggcttgtttttcttttgttttcttgtcaacataagcctcatgagacaacagcaggatgcaagattgtacaatgacaccatgactctgytttctgggtgtcctctgtgggctctcagcagtgtccccgatgtggagggtcttcttattctgtgtgtgtgccctctgctgttgaaagttgcctgtcaccc

SEQ ID NO: 59415 - DNA, 201 bp, Homo sapiens
ttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctc

SEQ ID NO: 59416 - DNA, 201 bp, Homo sapiens
caacagcaggatgcaagattgtacaatgacaccatgactctgctttctgggtgtcctctgtgggctctcagcagtgtccccgatgtggagggtcttcttaytctgtgtgtgtgccctctgctgttgaaagttgcctgtcacccatgatgctgtgctgattgagcaaactaatccataacccaccgccacgttcctcgccta

SEQ ID NO: 59417 - DNA, 201 bp, Homo sapiens
tcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctggga

SEQ ID NO: 59418 - DNA, 201 bp, Homo sapiens
atgctaaggtaggagaatcgcttgaacccaggaggtggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatg

SEQ ID NO: 59419 - DNA, 201 bp, Homo sapiens
ctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccatctgaaaaaaaaaaaaaaaaaaagacatttacattt

SEQ ID NO: 59420 - DNA, 201 bp, Homo sapiens
ggtggctcacgcctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggagg

SEQ ID NO: 59421 - DNA, 201 bp, Homo sapiens
ctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgtctgtacaaaaa

SEQ ID NO: 59422 - DNA, 201 bp, Homo sapiens
ccaaaccataccactcatggcatctcgtttttacagagtatatgtgttttcagattttgcatgacattttaggataaatgtgatgaaaatgaggaaaattrggaatgaagtttaggtcagaaaagtttcagtgattattttttcagaatcattgtttcttggtttctagggtccaacatgccattgttcaatggctgtatt

SEQ ID NO: 59423 - DNA, 201 bp, Homo sapiens
gcatttatctttgatgctgggaatgcgttcattttctttatcttgccattactgtacctctattgggaaatttactctctcttcatagataggatccgathcagtacatatttataaaaccacacttacatttaaatacaggcctttcccatttcacagtgtttctagctcccctttccaatacatctctctctctctttc

SEQ ID NO: 59424 - DNA, 201 bp, Homo sapiens
aaaaaaaatccccaaaaaatctcataatgttttaagaaagtttatgaatttgtgttgggccagattcaaagttgtcctgggccgcatgtggcccaccagcyatggtttggacaagcttagtctacaggttcttcaagaggggcttgagcatttgaaagacttctagtgggagagatcacaaggtacaagtagaaaatcctg

SEQ ID NO: 59425 - DNA, 201 bp, Homo sapiens
atgctttgtaattttttttaaggattgatactagctagggtgttgataagaaacagcaggcatagttactgggtgattgagaagagtttaacaaaagactrtattagtctgttttcatgctactgataaaggcatacccaatactaggtcatttacaaaagaaaaaggtttattggacttacagttccttgtggctgggga

SEQ ID NO: 59426 - DNA, 201 bp, Homo sapiens
gcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaagcagaaaacagaggtctcaatttgccttttcagcgtgaatg

SEQ ID NO: 59427 - DNA, 201 bp, Homo sapiens
ttcattctgtttctttattattttaatggagtgcaaggtgcagtctttttgaagatgtagaatgtggccttataaaagctaagtgctactttatatttctrctgtccttgccggtggcctgcactggggagttgtatattgtatcagtaattttaaaagccagcaagtgttctaccagctgaagaagttttcctaatggtg

SEQ ID NO: 59428 - DNA, 201 bp, Homo sapiens
ttataagttacattttacataaaaaggcagcagtggtgaagctggaagagggcacctagactttgatttcaggcaagattttgttaggtcccagtattggracttccggttggtggattttgctcaagaatagttttctctttgtctaacgcttcatgagagacaacctaaataaagccacagccagtgttacagaaatag

SEQ ID NO: 59429 - DNA, 201 bp, Homo sapiens
caatcatatttaaatcattgctgctggaactttagttgactttataagttacattttacataaaaaggcagcagtggtgaagctggaagagggcacctagrctttgatttcaggcaagattttgttaggtcccagtattggaacttccggttggtggattttgctcaagaatagttttctctttgtctaacgcttcatgag

SEQ ID NO: 59430 - DNA, 201 bp, Homo sapiens
aaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaa

SEQ ID NO: 59431 - DNA, 201 bp, Homo sapiens
tgatgattaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacatt

SEQ ID NO: 59432 - DNA, 201 bp, Homo sapiens
atggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtc

SEQ ID NO: 59433 - DNA, 201 bp, Homo sapiens
tctttgaaagttgtccttctgcacccattttccccagacctaacctcgatttgtgctccaggtctgagcagaaatgttattccctccagaaagccttcccyggatgttgagggatgaagttgtagccccctcccgaatgcgtcctcagaactcgctggttctcgtcctcgccctcagcatacttgctcattgtttgtttcc

SEQ ID NO: 59434 - DNA, 201 bp, Homo sapiens
tgattattttgctctttgaaagttgtccttctgcacccattttccccagacctaacctcgatttgtgctccaggtctgagcagaaatgttattccctccaraaagccttccctggatgttgagggatgaagttgtagccccctcccgaatgcgtcctcagaactcgctggttctcgtcctcgccctcagcatacttgctca

SEQ ID NO: 59435 - DNA, 201 bp, Homo sapiens
tggcccaccagccatggtttggacaagcttagtctacaggttcttcaagaggggcttgagcatttgaaagacttctagtgggagagatcacaaggtacaastagaaaatcctgggctggcctgagaggcagacctgtgattattttgctctttgaaagttgtccttctgcacccattttccccagacctaacctcgatttg

SEQ ID NO: 59436 - DNA, 201 bp, Homo sapiens
tcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttg

SEQ ID NO: 59437 - DNA, 201 bp, Homo sapiens
gttttaagccagagagagattgataagacatggaatgatatggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgg

SEQ ID NO: 59438 - DNA, 201 bp, Homo sapiens
attggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcaactcatacctactgttcgtcagttttctcatctgtaaaatggggattccagtggtt

SEQ ID NO: 59439 - DNA, 201 bp, Homo sapiens
ctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactga

SEQ ID NO: 59440 - DNA, 201 bp, Homo sapiens
gagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtt

SEQ ID NO: 59441 - DNA, 201 bp, Homo sapiens
tgtgatctgtctacatatgtagctgtttgtattcatggtgattaaatagttgggtgctagacatgcccttagcgagcagctcatgagagcagattttgccwgtttcttccaaaatctggattcagtgacatcgtgttggtagcttgaaactgaccgtggtgagaatatttacaccatggaaagtggcaaatgctactaata

SEQ ID NO: 59442 - DNA, 201 bp, Homo sapiens
ggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatgggg

SEQ ID NO: 59443 - DNA, 201 bp, Homo sapiens
cttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcac

SEQ ID NO: 59444 - DNA, 201 bp, Homo sapiens
tgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttgg

SEQ ID NO: 59445 - DNA, 201 bp, Homo sapiens
tcagtggagggtcagcgtgacagccttttgcacccacatctgggttcttgtccagtgtccaggaggaatgaggtctcatgagcaaattttaaggatggcaratgtgggggattttattgctgatgaaagtggctttcactgggaagataagctaaaaagaagacaaagcaggaaggtaattttcccctggagctatgccat

SEQ ID NO: 59446 - DNA, 201 bp, Homo sapiens
cctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggc

SEQ ID NO: 59447 - DNA, 201 bp, Homo sapiens
gtgagccctcttactgaattatgtggctggggttcttgggtatgttttgttctattttctggttggtggttttctttctgtcgggtcccgtgggctctttytggacctcttctcagaatgtttttcgttttttttattttttgagatggagtcttgcactgtgtcctgggctggaatgcaatggcaagatccctgctcact

SEQ ID NO: 59448 - DNA, 201 bp, Homo sapiens
ttaacattctttggcagttgtaatttattaattgatttttaaatttggccggtgaaaatgaactttaggtaggggtttgaggaaaatgaaaaggcctattkgtttttcagtggctggttcttcgtgttcagcattaaggattggtagaaatcaggcaacctctatgtaacctcagccatcttggattcccagcttactcac

SEQ ID NO: 59449 - DNA, 201 bp, Homo sapiens
atgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacag

SEQ ID NO: 59450 - DNA, 201 bp, Homo sapiens
atactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgt

SEQ ID NO: 59451 - DNA, 201 bp, Homo sapiens
agccccagtaaccctaagattgaacaaaaccctacttacgtgctacggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccac

SEQ ID NO: 59452 - DNA, 201 bp, Homo sapiens
atcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagcattaattccttacaaccctgatgggtcccagctgtgcacacgca

SEQ ID NO: 59453 - DNA, 201 bp, Homo sapiens
ctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggt

SEQ ID NO: 59454 - DNA, 201 bp, Homo sapiens
aacttgtgtagggaaactctcccttatgataccgtcagattccttgagacttatttgctattgtgagaacaccttgggaaagacctgcctccatgattcarttacctcccacctggtccctcctgcaacatgtgggaattcaagaagagatttgggtgggtacacagccaaaccatatcaaaaaccatttacaaaactcta

SEQ ID NO: 59455 - DNA, 201 bp, Homo sapiens
ttcagcagtctgcctttccctttctgttataaaatcatgtttttattgaattacattttaatattggtatcactttaaaatgaaaatgagtacttgcaaamtgtatttttgaaggagttgggtggtggtggggggatgccattttggcaacagatgacttcggttcaagtcctctctctgtctcttacttgctttgtggct

SEQ ID NO: 59456 - DNA, 201 bp, Homo sapiens
cttctaagcacttcttaggtgcctctgggctttttaacattctttggcagttgtaatttattaattgatttttaaatttggccggtgaaaatgaactttargtaggggtttgaggaaaatgaaaaggcctatttgtttttcagtggctggttcttcgtgttcagcattaaggattggtagaaatcaggcaacctctatgta

SEQ ID NO: 59457 - DNA, 201 bp, Homo sapiens
ccatgtatgtgtcagtcctactatgcaccttacagctcactaaccctgtttaataatgtatgttgctacatttaatctttatggtagcctcatgaacaggytcttatttagttcagtggttcttgatcaggagtgatattgcctgccagggaatgcatgtcaatgtctggagacatctggggttgtcagttcaggagggta

SEQ ID NO: 59458 - DNA, 201 bp, Homo sapiens
aaaaaacaaacaaacaaacaaacaaaaaataggaaaaaaagaaagagcgtatttatagatggtagagaattctgggcatgagaaacccagccaaacaagtrgaatgtgtgcataggtgggactgctgatcttgttttatgaaagaaataaaggcaagtcaaacagatcctttcgcaaggatccccatgtgtgtatgtctaa

SEQ ID NO: 59459 - DNA, 201 bp, Homo sapiens
actgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcc

SEQ ID NO: 59460 - DNA, 201 bp, Homo sapiens
cgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctc

SEQ ID NO: 59461 - DNA, 201 bp, Homo sapiens
gcactttgggaatacgaggtgggccaatcactgaggtcaggagttcgagaccagcctggccaacatggtgaaaccccgtctctactaaaaatacaaaagtkagtcggggttggtggtgtgctcctgtagttccagctacttgggaggctgaggcaggagaatcacttgaatccgggagccagcggttgcagtgagcttaga

SEQ ID NO: 59462 - DNA, 201 bp, Homo sapiens
tggtgggtcatgcatgtaatcccagcactttgggaatacgaggtgggccaatcactgaggtcaggagttcgagaccagcctggccaacatggtgaaacccygtctctactaaaaatacaaaagttagtcggggttggtggtgtgctcctgtagttccagctacttgggaggctgaggcaggagaatcacttgaatccggga

SEQ ID NO: 59463 - DNA, 201 bp, Homo sapiens
aataaaaaataaaataaaaaaataaaaataaaaataaataaaaagtagttgggcgtgtgttgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagt

SEQ ID NO: 59464 - DNA, 201 bp, Homo sapiens
atcagtgtggacaacatagggaggtcctgtctctacaaaaaataaaaaataaaataaaaaaataaaaataaaaataaataaaaagtagttgggcgtgtgtkgtggagcatgtgggggtcccagctacttggcaggctgaagcaggaggatcgcttgagctcaagaggttgaggctgctgtgagctatgatctcacctctgt

SEQ ID NO: 59465 - DNA, 201 bp, Homo sapiens
ttgcctaggctggagtacaatggcgcgatctcagctcacagcaatctctgcctcctgggttcaagcgattctcctgcctcagcctcccgagtagctgggawtacaggcatgcgccaccatacctagctaattttgtgtttttagtaaagacagggtttctccctgttgttcagggtggtcttgaactcctgacctcaggtg

SEQ ID NO: 59466 - DNA, 201 bp, Homo sapiens
gctgagaaaggattcccagtccccctggtaaaaagtctgaaggatgccgaggagttcactgtgcccttagataataacagtttgtcttggctctgatcacycctttttgtgacttagctggctgggaagtagcaaaagtatcttccaagctcagcttctctctgcttgcattctttccaaatacgtgattccaaagcccat

SEQ ID NO: 59467 - DNA, 201 bp, Homo sapiens
caaagccagcaacagaaactctcttgtgcatggagtcccctcctgctttgaatctctctgactttccttgactttgatgtctaggtctggatttcaagggytcagaaactctctcatgcatgtagttccctcctgctttgaatctctctgactttccttgattttgatgtctaggtctggatttcaagggctcacgtgatg

SEQ ID NO: 59468 - DNA, 201 bp, Homo sapiens
ttttttttttttttttttgtttttcctcccagcctctctcctttcccattatgcacaatgcgctgagaaaggattcccagtccccctggtaaaaagtctgraggatgccgaggagttcactgtgcccttagataataacagtttgtcttggctctgatcacccctttttgtgacttagctggctgggaagtagcaaaagta

SEQ ID NO: 59469 - DNA, 201 bp, Homo sapiens
tccccactttcaggctctcctttcacacgcatgcattaattcgttcattcttggaatctacccacctgtgatgtgctagttactaaagatgcagcaatgartgaaaggtaatcctgtccttgaggcattcacaggtaaagaagcctgcttgggacattgggccgtgagctccaacaatgtcactattcttctaggctttgt

SEQ ID NO: 59470 - DNA, 201 bp, Homo sapiens
tattcctttccaacttccacttgccccaaataggtagaagttagcctttatttttggtgtcatgtcttctttccctcctcctatcagtttttcagaaactscagaaatttaacctagtacacaggggccccccacccctgtttccagatgccttctagaaagaggactgggagtgtgaatgaggccatgtgggctttgttt

SEQ ID NO: 59471 - DNA, 201 bp, Homo sapiens
atttatgacttggcttacaatccgttgcagaaagcctagctccccagcttctcctgaatctacgtttttctattttgtctgaactagccaaggtctctggwgtttgctgttatattgcttcagagaaattagtgacattgaaaggctgttgtcttttttagtgtacttttggttgttaggagaaatttacaaggccatttt

SEQ ID NO: 59472 - DNA, 201 bp, Homo sapiens
caccacccaagttgtaagatggtagagcgaacaggccagaatgtgataaagtaaaatgaaagaagaaaaaggaggaaggaaaaagagagagggagaagcasatagaggaaagaaggaagaaggaaggaggaaggagggagggagggagacagggaaggaaggaagtctggcaagagggcacagtcagacctgccaggatcc

SEQ ID NO: 59473 - DNA, 201 bp, Homo sapiens
aaagcaaagccaatagagatcttgaaaaaaaaaaaaaaaagaaaaaaccaccgtggtattctaggaagaaaaaagcatttttcgaatgaaaactttttatkatatttgatatattctgcttcccttccctagtatgtattaatgagatgaaatcacttcttaattttcaggttaatattaaagttgaagcccatccctcta

SEQ ID NO: 59474 - DNA, 201 bp, Homo sapiens
tcctcctcaagggaaacattcttctcacaatagcttcctggtagaaagttctaactaatgactttaatcgtgtgaatgtattgcagaaatggacaggacarttctcagcccattcatcttacagacctcaagtgaacaggcacaaaacaacaggctccaccctccttcccccctctatctcatactttacctcaatttatg

SEQ ID NO: 59475 - DNA, 201 bp, Homo sapiens
cattctatcaatgccaaaatgcacatcacactgacaacagctctttgtttacaccggggagcccccaaagccccagggtaattccatcaccacccaagttktaagatggtagagcgaacaggccagaatgtgataaagtaaaatgaaagaagaaaaaggaggaaggaaaaagagagagggagaagcacatagaggaaagaa

SEQ ID NO: 59476 - DNA, 201 bp, Homo sapiens
caactgttctctgcacgacctagttctgggctagggaatggctgtctagcttcagtggatttccagggtccggagctactaaaggtcaacagctgtgttaytgcaaactctgtggcctgcattctatcaatgccaaaatgcacatcacactgacaacagctctttgtttacaccggggagcccccaaagccccagggtaat

SEQ ID NO: 59477 - DNA, 201 bp, Homo sapiens
tttcctgcatcagctaagcatttatttcatgtagtcctcacactagattgagtggttccatattaatatcctacgtcaaagatgagtaaattgagatgcgkaggttctaatttgcccagtgtcgtggtgtgtgatcttgaccactagcctaaactgctattttatgtccacccatcaacctctacggctgcccctcatttg

SEQ ID NO: 59478 - DNA, 201 bp, Homo sapiens
ccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatc

SEQ ID NO: 59479 - DNA, 201 bp, Homo sapiens
cagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatga

SEQ ID NO: 59480 - DNA, 201 bp, Homo sapiens
tgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtat

SEQ ID NO: 59481 - DNA, 201 bp, Homo sapiens
tggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttt

SEQ ID NO: 59482 - DNA, 201 bp, Homo sapiens
ggatcgcttgcatccaggaggttgaggctgcagtgagccatgactgtggcactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgta

SEQ ID NO: 59483 - DNA, 201 bp, Homo sapiens
tttggttctttaacattctcttcttcactaaacccaaattaataattccttactattgtcattaaaagttctcactggatcattccatttatactcagagkaacaaagcaaacccaattatttgagagacactgaaatgaattttgagtctagaacagcatctgcaaactttgcaaaggttcacatgataaatattttctg

SEQ ID NO: 59484 - DNA, 201 bp, Homo sapiens
gagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggt

SEQ ID NO: 59485 - DNA, 201 bp, Homo sapiens
ctttggttctttaacattctcttcttcactaaacccaaattaataattccttactattgtcattaaaagttctcactggatcattccatttatactcagartaacaaagcaaacccaattatttgagagacactgaaatgaattttgagtctagaacagcatctgcaaactttgcaaaggttcacatgataaatattttct

SEQ ID NO: 59486 - DNA, 201 bp, Homo sapiens
tctttatttcaaaaagagtggctgtgaatctttaaaaatttctttggttctttaacattctcttcttcactaaacccaaattaataattccttactattgkcattaaaagttctcactggatcattccatttatactcagagtaacaaagcaaacccaattatttgagagacactgaaatgaattttgagtctagaacagc

SEQ ID NO: 59487 - DNA, 201 bp, Homo sapiens
attaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaaga

SEQ ID NO: 59488 - DNA, 201 bp, Homo sapiens
cgtagtactgatgtggatatgatttgagctaagactctgctgttgattctcttcaaaaacttggcagtagcccttggatcccattaattgcattcaacagkcatgtattttattaatttttgttcctaaagaaaaaaaaaaatccagattgcttagaaaataaatgtgactcacgcagagcagaatccgaattttctaagt

SEQ ID NO: 59489 - DNA, 201 bp, Homo sapiens
actaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaac

SEQ ID NO: 59490 - DNA, 201 bp, Homo sapiens
tagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctt

SEQ ID NO: 59491 - DNA, 201 bp, Homo sapiens
cctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttactt

SEQ ID NO: 59492 - DNA, 201 bp, Homo sapiens
ggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgg

SEQ ID NO: 59493 - DNA, 201 bp, Homo sapiens
ggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttga

SEQ ID NO: 59494 - DNA, 201 bp, Homo sapiens
ttgagaagggccctgtccgcagcctgaggagcctcaactgttctctgcacgacctagttctgggctagggaatggctgtctagcttcagtggatttccagrgtccggagctactaaaggtcaacagctgtgttattgcaaactctgtggcctgcattctatcaatgccaaaatgcacatcacactgacaacagctctttgt

SEQ ID NO: 59495 - DNA, 201 bp, Homo sapiens
gaaaattcaaaaaattgcaacctgaggcataaatgggttttaagctccatacagtaaaacctagcatatgaaaacagttctggctgatgggttggtagaartgatagatatagatacatatatacacatatatgcacagtaatagatataggtaaagaccttgatatatgtacatatattgtatgatacatatccatgcat

SEQ ID NO: 59496 - DNA, 201 bp, Homo sapiens
tatatcctaccgctcaaagccatcaccaaggtctgatcgtgaaaattcaaaaaattgcaacctgaggcataaatgggttttaagctccatacagtaaaacytagcatatgaaaacagttctggctgatgggttggtagaagtgatagatatagatacatatatacacatatatgcacagtaatagatataggtaaagacct

SEQ ID NO: 59497 - DNA, 201 bp, Homo sapiens
gatattttctactatggatgaatgctcctcttttgaattttcatttttgtctgacataactcaaagtgcttgctttgggagttcttgttaaccctgacaawtcttgtcaaatatcttactcctgggctgtgctggggatggcagcagagtggggtggttggatgggaaggcgggaaagagctagcttggagatgatacgct

SEQ ID NO: 59498 - DNA, 201 bp, Homo sapiens
aacctttttgatgcctccaggcaatttcctacaagctctaatatcttcctctttactcccatatgtggtatctctggtaccctatatatcattcactcaastgtttgttttgaaccacttattttggcaagacttcttcagacaggagagccctgagagctcttcaaaggctgggcctgatggtgtttgtcagagaggttc

SEQ ID NO: 59499 - DNA, 201 bp, Homo sapiens
aaagttaccttgatagttcaggtgtgcagagaaaattcacagccatcaatagaaaagaaaaaaaaatcctgtttataccttaggcattctgtgatccttasgatgtagccatgacagtattacgggttttaaaagccacccaagtaatctaaatttcctccaaactaacaattcctgaaagattgaaatattgctaccaat

SEQ ID NO: 59500 - DNA, 201 bp, Homo sapiens
tgtcctgtcgctgtcacaagtttttaataagggctgggggtcctcttgaagagcccaggaactgcagtccctcctctatgccttcccctgaacacagtgcrccctcactaataaattctgagggctgacactgcctgagccggctggtctttgccctcaatttcattgagatgggccattgaaaactcattacaagctgtt

SEQ ID NO: 59501 - DNA, 201 bp, Homo sapiens
tggaagaaggaaggcgcccctccttcttagctgattgatgatgagatagaaagatagaaacagccccatcactatgagatggaaacccttctttccttcakctgacttccctctccttcattcccaaccaagtttgaccccgccgcagtggagattgtggcagatgggtcagatagcatgtgtcctgtcgctgtcacaagt

SEQ ID NO: 59502 - DNA, 201 bp, Homo sapiens
gggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccagattcaaagttgtcctgggccgcatgtggcccaccagccatggttt

SEQ ID NO: 59503 - DNA, 201 bp, Homo sapiens
ttcttaaccctttaagaaatatgacttgttctaattgccttttcttatttacattatacttaggctggtgttaggatgccgtggctgccaagtttacacartgcactttctctctctctttcttcttttggtttatgatgtttttcaatagtgtcatggaactcacttaatctgatttcatcaagtaaatatatgggaagt

SEQ ID NO: 59504 - DNA, 201 bp, Homo sapiens
gctgggaagtccaagatcaagctgctggcagattgagtgtttggcaacggcccactttctggttcctagatgttcacctccttgctatgtcctcatatcgkgggaggggcaaagggtctctctatctggcctcttttaagcccttaacccattcatgaaggctttgcctcaatgacctaatcacctcccaaaggccctacc

SEQ ID NO: 59505 - DNA, 201 bp, Homo sapiens
cttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaataca

SEQ ID NO: 59506 - DNA, 201 bp, Homo sapiens
gggtgagatgaacattgattgagcctttacatcggagacactataacaaatgctttgtgtacatcagctctttcaaattaatacaattctactagaggggrcactattagtatccccaatttacagatgaaaaaaatgagggacagagaggttagatgtgtatctaaggtcacatagctcacaaacgacacagcatgcacc

SEQ ID NO: 59507 - DNA, 201 bp, Homo sapiens
agatgaggttcttgagtactttcaattaggtttaccactgaccccatcagtgtgcagacgaagggagatgagagatacagatggttaatgggatttttggrgtatcttccagcctttgtgagcacagaggtttcgctacattttgaaaattaaaattcatttcattcgcattacagattttaaatcctagctcctttttaa

SEQ ID NO: 59508 - DNA, 201 bp, Homo sapiens
caaggcctgttggaatgtctgccagtttcaacccacggggatagggtgagatgaacattgattgagcctttacatcggagacactataacaaatgctttgygtacatcagctctttcaaattaatacaattctactagaggggacactattagtatccccaatttacagatgaaaaaaatgagggacagagaggttagatg

SEQ ID NO: 59509 - DNA, 201 bp, Homo sapiens
cagatgaggttcttgagtactttcaattaggtttaccactgaccccatcagtgtgcagacgaagggagatgagagatacagatggttaatgggatttttgkggtatcttccagcctttgtgagcacagaggtttcgctacattttgaaaattaaaattcatttcattcgcattacagattttaaatcctagctccttttta

SEQ ID NO: 59510 - DNA, 201 bp, Homo sapiens
tcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgacc

SEQ ID NO: 59511 - DNA, 201 bp, Homo sapiens
atcaaatggtagttctacttttagttcttcaagaactctccacactgttttccatagtggttgtactagtttacattcccaccagcagtgtagaagtgttscctgttcaccgcattcacgccaatatctattattttttgcatttttggtaatggccattcttgcaggagtaagatggtatcgcaaatgcaacaaaaacaa

SEQ ID NO: 59512 - DNA, 201 bp, Homo sapiens
gccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggc

SEQ ID NO: 59513 - DNA, 201 bp, Homo sapiens
aggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatg

SEQ ID NO: 59514 - DNA, 201 bp, Homo sapiens
ctcccgagtagctgggattacaggggcacatgccaccatgcccagctaattttgtatttctagtacagacagggtttcaccgtgttggccaggctggtctsaaactcctgacctcaagtgatccaaccgcctcagcctcccaaagtgctgggatgacaggtgtgagccaccacacccagccactctctttcaactagaaca

SEQ ID NO: 59515 - DNA, 201 bp, Homo sapiens
tctctctctctcttttttttttttttctttttgaggaagggtctctctctgtcacctggctggaatacaatggtgctatcttggcccactgcaccctccayctccctggttcaagggattctcgtgcctcagcctcccgagtagctgggattacaggggcacatgccaccatgcccagctaattttgtatttctagtacag

SEQ ID NO: 59516 - DNA, 201 bp, Homo sapiens
ctgggcaaggaaacaaaactgaacaacattagcaaaatcactacatattataggaatcaagtacattctgaacggcttaatcctacagtttagatatgaascctaagggtaagatgaacgtcttagatgatctgagatatccaaatacctgtaacaaacatttgtatggtgtatgtagggcaggaaccccatcagaattgg

SEQ ID NO: 59517 - DNA, 201 bp, Homo sapiens
taataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttct

SEQ ID NO: 59518 - DNA, 201 bp, Homo sapiens
catgctatctcgacttctgtgtgtctcctttttgtccatctcttaaatcagtcacttggcagcagcaagacatgtggccactccagaccatttgatcgaaragctcttgttaggagattaggctgctaatctgcaagcgagctaatggaaatcattctgggcaaggaaacaaaactgaacaacattagcaaaatcactaca

SEQ ID NO: 59519 - DNA, 201 bp, Homo sapiens
tccattagagacctggcgtataattgtgggagggagaagccagtggagcagtcaggggactccctggctgtttctgtgtctggtcttatgggtctgggcaytgaattcagtcacaaaccctagcatgctcctttgctacctcaggggacaaagtcaagaaaataacactaggattgccaccctgctctctctctctctctc

SEQ ID NO: 59520 - DNA, 201 bp, Homo sapiens
aaagtaaagtaataaacaaataagttttgggttgggcgggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctt

SEQ ID NO: 59521 - DNA, 201 bp, Homo sapiens
gaccattaatcatgctatctcgacttctgtgtgtctcctttttgtccatctcttaaatcagtcacttggcagcagcaagacatgtggccactccagaccawttgatcgaagagctcttgttaggagattaggctgctaatctgcaagcgagctaatggaaatcattctgggcaaggaaacaaaactgaacaacattagcaa

SEQ ID NO: 59522 - DNA, 201 bp, Homo sapiens
aatagcacagcttttttccactttcaaatgtataacaaaatagaactttatatttccagatggactgcctggaacccggggagtggctcagctaccaggcyccagtggcccttgtcttgttatttcctccattagagacctggcgtataattgtgggagggagaagccagtggagcagtcaggggactccctggctgtttc

SEQ ID NO: 59523 - DNA, 201 bp, Homo sapiens
gtatgtgtttaatctaccattccttgtggcacagtgcatggtctgcatggcacagtgtgtggtctgtatggcacagtgcatggtccgcatggcacagcgcrtggtccgcgtggcacagcgcgtggtccgcgtggcacagcgcgtggtccgcgtggcacagcgcgtggtctgcgtggcacagtgcgtggtctgcatggcaca

SEQ ID NO: 59524 - DNA, 201 bp, Homo sapiens
atagttctctctgtgaccctgtagaatgcactgaagcaaaaataacaggtaatgctaatcataaagttttacaaatctcctgaagagtcttgttggtttcygtgttgatgaagcaggaaatttccctgacccctttgcaggcaggaagtggagtgcggatgctggaactagctggctgctttggtgccagtagaggtgaac

SEQ ID NO: 59525 - DNA, 201 bp, Homo sapiens
agttctgtgtttatacttctcatttagcccataccccactatattaaaagaagatgtataagtgtatgtgtttaatctaccattccttgtggcacagtgcrtggtctgcatggcacagtgtgtggtctgtatggcacagtgcatggtccgcatggcacagcgcgtggtccgcgtggcacagcgcgtggtccgcgtggcaca

SEQ ID NO: 59526 - DNA, 201 bp, Homo sapiens
acctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctact

SEQ ID NO: 59527 - DNA, 201 bp, Homo sapiens
acatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccagcctgggcaaaaagagcggggtaaaaaaacaacaaaaaaatgatgt

SEQ ID NO: 59528 - DNA, 201 bp, Homo sapiens
ttggcctcccagagtgctgggattacaggtgtgagccactatgcccaataccccctatgtagacttttaaagaaatacaggaaacagccaagactggtgtsattcagatttagcttgggagagtctagtgggtgttaggttcccacaggatgaaggatcaccatgaacggtcaggacctgacttaggaggactcagaagct

SEQ ID NO: 59529 - DNA, 201 bp, Homo sapiens
gagggtggcagtgatcttgaggggggtctgggagggaggagccagcctggcctggtctggcctggcccagtgtgccagctagggcaggtgcaatggctcaygcctataatcccagcactttgggaggccgaggcaggtggatcacctgaggtcaggagttcaagaccagcctgaccaacatggtgaaaccccatctctact

SEQ ID NO: 59530 - DNA, 201 bp, Homo sapiens
cctgcttaggaaatttgggttgagggtggcagtgatcttgaggggggtctgggagggaggagccagcctggcctggtctggcctggcccagtgtgccagckagggcaggtgcaatggctcacgcctataatcccagcactttgggaggccgaggcaggtggatcacctgaggtcaggagttcaagaccagcctgaccaaca

SEQ ID NO: 59531 - DNA, 201 bp, Homo sapiens
aaaaaaaaaaaaaaaaacaactacccaaggcctgttggaatgtctgccagtttcaacccacggggatagggtgagatgaacattgattgagcctttacatyggagacactataacaaatgctttgtgtacatcagctctttcaaattaatacaattctactagaggggacactattagtatccccaatttacagatgaaaa

SEQ ID NO: 59532 - DNA, 201 bp, Homo sapiens
cataccatatgctgaaagacttggaatgcaaaaacctaaggccaagggcacttctcaatattaaaccctcagttgtaatggaggcatcaagactataagayccaagaccttaacttttgtgctccttgtcttgtggagggaacatccatcctcaaaacagaaacctgtgagatcccttgaatatactgacaatacactgat

SEQ ID NO: 59533 - DNA, 201 bp, Homo sapiens
agtagatattggaaatatgaacccaatatgttcttaacatctccatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaa

SEQ ID NO: 59534 - DNA, 201 bp, Homo sapiens
ttagaagaaaaccagaggtctgtgcacactatggatttttactacaatgatgccctttcacatacagcgagaaggattaagaggtactgtattgttggttrataaagtcaaacttgtgaacagagcaaaagggcattgcttggtcattgcagcttccacccatgcaccttacacagaagtttgggccctaacatggaaact

SEQ ID NO: 59535 - DNA, 201 bp, Homo sapiens
ttcaacacagttctcttgtctctgttcatgatataacagtaaatccaagttgctttaagtagatattggaaatatgaacccaatatgttcttaacatctcyatgtcgtaattctaatttaaaatcaaaatctcatcaaattacattttagattaaagcattgtacctatcgaaagaagagaatcgaaaatgcgaaagtcct

SEQ ID NO: 59536 - DNA, 201 bp, Homo sapiens
ttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctccatgtcgtaattctaattta

SEQ ID NO: 59537 - DNA, 201 bp, Homo sapiens
aaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagt

SEQ ID NO: 59538 - DNA, 201 bp, Homo sapiens
tttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagagg

SEQ ID NO: 59539 - DNA, 201 bp, Homo sapiens
agatcttgcttttcagtctactggtatctccacttctctctgcagcgtgatgtctagtcagagtttccattctgtttttatgaccctgggaggactgggasagatctgtgaggtcatcttgtccaccctcagccagggcaggagtattccctaatggtagagtcaagtgtttggtttggtcttgtttctaatgactcaagt

SEQ ID NO: 59540 - DNA, 201 bp, Homo sapiens
agcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcattta

SEQ ID NO: 59541 - DNA, 201 bp, Homo sapiens
tatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgaga

SEQ ID NO: 59542 - DNA, 201 bp, Homo sapiens
cctagagcaggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggca

SEQ ID NO: 59543 - DNA, 201 bp, Homo sapiens
agaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcaggttgggcaagaggcttttctctcagtcaccagccccaaaccctgtggt

SEQ ID NO: 59544 - DNA, 201 bp, Homo sapiens
gtttttagacagaatatcacttttttatattattcatggtaatgtaattcccccctttaatctcttcagggtttcccattcagtcatgatatgcggttcaragaaagttggatcgaccattaatcatgctatctcgacttctgtgtgtctcctttttgtccatctcttaaatcagtcacttggcagcagcaagacatgtgg

SEQ ID NO: 59545 - DNA, 201 bp, Homo sapiens
ggttatttccttgaggagaaaggaaaggagaagttgagtacttttcagtgtttgttactacaaaagcatggtggcatgccattgttctgagaggaaggggsttttttgccttgtcagctcctgatgaaaaagatgttgggttggaaagctaagttacagcaggtgaacttgaatttgaggaaagacaaagcaaaccctggc

SEQ ID NO: 59546 - DNA, 201 bp, Homo sapiens
ggagggacaatagaacctctgtagaatcaaaggcagaattaaaatctgcatgttaatagctttcctgccagccacgaatagattcattcttcacgtctcaratatataaagcttatttcaaaataaattctggggagcgttcaacctgattgaatctgctgtaagctctgttaatatatttgttcgagtcacttgcactca

SEQ ID NO: 59547 - DNA, 201 bp, Homo sapiens
ttttcccttcttgataggttgtagattccatgtctaatccatgcttttccaatattccctcctaatctttcagttgaattatggtctttagctcaaatgcrtgacatgatgtgtgtgcctttggagtggggcggtattagtcagtcgatggttatttccttgaggagaaaggaaaggagaagttgagtacttttcagtgtt

SEQ ID NO: 59548 - DNA, 201 bp, Homo sapiens
caggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgta

SEQ ID NO: 59549 - DNA, 201 bp, Homo sapiens
gtgggcttagaagaaaaccagaggtctgtgcacactatggatttttactacaatgatgccctttcacatacagcgagaaggattaagaggtactgtattgktggttgataaagtcaaacttgtgaacagagcaaaagggcattgcttggtcattgcagcttccacccatgcaccttacacagaagtttgggccctaacatg

SEQ ID NO: 59550 - DNA, 201 bp, Homo sapiens
ttattacagcgcaggtgcatcttgcttttgagtgctaactgagatgaaaggagtgaggaaacgctctcttcttcttgcaggggagggctggcaaattcagygaatgcagagtcggctgggagcctttcggctggaaagctcttcctctgatgagctgtctgttacagattttcagggatggcccttgataaggcaggggtg

SEQ ID NO: 59551 - DNA, 201 bp, Homo sapiens
catgatctcggctcactgcaagctctgcctcctaggctcatgccattctcctccctcagcctcctgagtagctgggactgcaggcgccagccaccacgccyggctaattttttatatttttagtagagacggggtttcaccatgctaaccaggatggtctcgatctcctgacctcgtgatccaccagccttggcctcccaa

SEQ ID NO: 59552 - DNA, 201 bp, Homo sapiens
gctccaggtaaccactcatctactttctgtctctatatagatttgcctattctagacttttcatataaataaatcagatactgtgtggccctttgtgtctygatccttacacttagcatcatgttttcaagggtcattcatgttgtagcatgtatcagtacttctttttttagggctgagtaatattccatttacggatat

SEQ ID NO: 59553 - DNA, 201 bp, Homo sapiens
tcttttttttttttttttttgaaatggagtcttgccctgtcccccaggctggtgtgcagtggcatgatctcggctcactgcaagctctgcctcctaggctyatgccattctcctccctcagcctcctgagtagctgggactgcaggcgccagccaccacgcccggctaattttttatatttttagtagagacggggtttca

SEQ ID NO: 59554 - DNA, 201 bp, Homo sapiens
ggaatgcagtggcacgatgttggctcactgcaaaccctgcctcccaggttcaagcgattctcctctcccagcctcccgagtctctgggattacagacgtgyatcaccaggcccagctaatttttatatttttactcgagacgtagtttcaccatgttggccaggctggtctcaaactcgtgaccttaggtgatatgcgccc

SEQ ID NO: 59555 - DNA, 201 bp, Homo sapiens
tctaaaccaaaggacctaaataaaatattaatttttcatagtgtttaatatgtgccagtatatataaattcaaggtaaggtagacagctgtaaactggatsccctgctgtacccagcaaatgctgagagccctgcttcccctcttgtattcaaatggctctataagagaggaagtagtacagctatcagtaacaatgccat

SEQ ID NO: 59556 - DNA, 201 bp, Homo sapiens
tcaagcgattctcctctcccagcctcccgagtctctgggattacagacgtgcatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccag

SEQ ID NO: 59557 - DNA, 201 bp, Homo sapiens
gtacttcatgatcttggaagaaggaaggcgcccctccttcttagctgattgatgatgagatagaaagatagaaacagccccatcactatgagatggaaacmcttctttccttcagctgacttccctctccttcattcccaaccaagtttgaccccgccgcagtggagattgtggcagatgggtcagatagcatgtgtcctg

SEQ ID NO: 59558 - DNA, 201 bp, Homo sapiens
ccttctcagagtcagtaggatagtttcccttcctggaagattgagatgaaataaagctttaggagttggtatcgcacgcaggcattaaatggattgtgaasagggactttgttccccctcagtcttgtctctgcctccgtaaaggagtaagttaaaaaagaaagtttctttttttaaaaaaaagccttactgctcaataaa

SEQ ID NO: 59559 - DNA, 201 bp, Homo sapiens
tgatgatccagagctttggagtcagcgagacagtagagagtggtggagatggtggcgcacaagagggtcagtgccccatctcaaggaacagctgcacctcrgcctacgcgattgtgaaaatgtgagcatatgcaggccagaccttggcttctctgtcttcatttttcacaggagccagaagtttggatgtgcaatgtgaaa

SEQ ID NO: 59560 - DNA, 201 bp, Homo sapiens
aagtaaaaccacaggggatctgttggaagtggcatgatggaggaattttaaaagaattgaacaaataaaatagtcagagctcaaaaattgagtactgcttygtttctcccaaataaccatcaccagacaaacaggtgtgtgtgtgggtgggggaggtggcctggtggtacttcatgatcttggaagaaggaaggcgcccct

SEQ ID NO: 59561 - DNA, 201 bp, Homo sapiens
tccagagctttggagtcagcgagacagtagagagtggtggagatggtggcgcacaagagggtcagtgccccatctcaaggaacagctgcacctcggcctaygcgattgtgaaaatgtgagcatatgcaggccagaccttggcttctctgtcttcatttttcacaggagccagaagtttggatgtgcaatgtgaaatctcac

SEQ ID NO: 59562 - DNA, 201 bp, Homo sapiens
agcaaaatggggtaagaacagaatctgccttgcagagaattaaccgagatgatgtgtggaaagggcctatcccagaggctggtgtaccatggtggcttctyctggctctgctggttattattattagcattattgtcattgtgaaagtgacaaggaatgtgcctgtgcgtgaatctcactcttagatcagacgtgcttttg

SEQ ID NO: 59563 - DNA, 201 bp, Homo sapiens
ttgaaggaatgtttcacttccaaatccagatctctgacttcccttgaaaatttggagtgccactcaagtcggccgctctgagctagaatcctggtgttcaraattggcaggaagggcacaggggcaaggtataggctcacgtctccacattctgcacctcccaggctcctgccattgatgtgagcgggttcctgtactgca

SEQ ID NO: 59564 - DNA, 201 bp, Homo sapiens
ggatcttcaggtttggagggaggccgatagagagtgtctggagttgccaacgtcctctccttgggtcatgggtgtgtgtgtgtgtgttttcttcttgttgktgggtttttttttttttttttttttttttttggcttttgcgcctatggtgacttttagcgaatggatactattgaaggaatgtttcacttccaaatccag

SEQ ID NO: 59565 - DNA, 201 bp, Homo sapiens
aatggatcttcaggtttggagggaggccgatagagagtgtctggagttgccaacgtcctctccttgggtcatgggtgtgtgtgtgtgtgttttcttcttgktgttgggtttttttttttttttttttttttttttggcttttgcgcctatggtgacttttagcgaatggatactattgaaggaatgtttcacttccaaatc

SEQ ID NO: 59566 - DNA, 201 bp, Homo sapiens
cccctgtgggcttagaagaaaaccagaggtctgtgcacactatggatttttactacaatgatgccctttcacatacagcgagaaggattaagaggtactgwattgttggttgataaagtcaaacttgtgaacagagcaaaagggcattgcttggtcattgcagcttccacccatgcaccttacacagaagtttgggcccta

SEQ ID NO: 59567 - DNA, 201 bp, Homo sapiens
gtgggaatgtctcatccccctgtgggcttagaagaaaaccagaggtctgtgcacactatggatttttactacaatgatgccctttcacatacagcgagaargattaagaggtactgtattgttggttgataaagtcaaacttgtgaacagagcaaaagggcattgcttggtcattgcagcttccacccatgcaccttacac

SEQ ID NO: 59568 - DNA, 201 bp, Homo sapiens
cctgggaaatatagcaagatcccaaccctattaaaaaattaaaaatgaaaataaaattttaaagaaaggtatttctccccttcacggtaatttggagccartacttcttgcaccattcatttgtccacagcatgggacaaaggataatgccttaatgcctgctgcaaatagaacagtggtgcttagcagctttagataatg

SEQ ID NO: 59569 - DNA, 201 bp, Homo sapiens
atacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatgga

SEQ ID NO: 59570 - DNA, 201 bp, Homo sapiens
ttagccaggtgtggtggcatgcatctgcagtcctggctactcagaaggctgaggtgggaggattgcgtgagcccaggagttcaagaccagcctgaacgacrtaaaaagacctatctctacaaaaattagctgggcatggtgtcacgtgcctgtagtcctagctactcgggaggctgaggtgggaggatcgcttgagccccg

SEQ ID NO: 59571 - DNA, 201 bp, Homo sapiens
taatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatga

SEQ ID NO: 59572 - DNA, 201 bp, Homo sapiens
cacaggtcaaacatcctgagcctgttctgtggtcagttactcattagcagcctctgctctaggaggaatagttatgggtcctttcagacatgcaacccccmaaactccatgttgtttacagtgtgggacacctgactttcaccttttatgatacctgcctggggcatgcatgtggtgactttttccatctctggtctctat

SEQ ID NO: 59573 - DNA, 201 bp, Homo sapiens
ggtcaggcagctgtttgacaggattcttgcaaatgtttttggtttctctgtctactcattacgtacactctgccagaggttgaaaactcaatgttgagatyacatacatcctgaaaacactgtttaaataaaattttggcctgcatcctgtttttgaaaacttgcaatggcttgccaacgttttcaagttgagaagtttca

SEQ ID NO: 59574 - DNA, 201 bp, Homo sapiens
gttttcgagactgagtcttgctctgtcgcccaggatggagtacagcagtgcaatctcggctcactgcagcctccaactcccggctccagtgattctcctgyctcagtctcccaagtagctgggattacagggatgcgccaccatgcccagctaattttttgtatttttagtagagacggggtttcaccatgttggccaggc

SEQ ID NO: 59575 - DNA, 201 bp, Homo sapiens
ttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcat

SEQ ID NO: 59576 - DNA, 201 bp, Homo sapiens
caggagccagaagtttggatgtgcaatgtgaaatctcacaaattaaacatgttacataactgtattttgtttcctatctctgctgtaataaattttctcawtgttagtgacttagaaccacacaaaagttacactttacagttttggaggtcagtggtccaaaataggtctcagtgggctaaaatcgatgtgtcagcagga

SEQ ID NO: 59577 - DNA, 201 bp, Homo sapiens
ttgtttgtaagaatcagttgaggacagatgggactatttgcatggattggtgtcatgtttgaagtcagttaccagagggtttctttcaacagagtataccmaaaaaaaaaaaaaaaaaaaaaaaaaaaaagtaaattgcacagaccccagcttaggacctggacttaatcttcatgatgtttgtaaagtaatacttcttgg

SEQ ID NO: 59578 - DNA, 201 bp, Homo sapiens
acttagaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaag

SEQ ID NO: 59579 - DNA, 201 bp, Homo sapiens
agcaatttacaaaattgcacatactctataaatacacttctgttataaaaatagacacgtacggccgggcgcggtggctcacgcctgtaatcccagcactytgggaggccgaggcgggcggatcacgaggtcaggagatcgagaccatcccggctaaaacggtgaaaccccgtctctactaaaaatacaaaaaattagccg

SEQ ID NO: 59580 - DNA, 201 bp, Homo sapiens
cccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgcgataatctgcctatttgaaggtcagccaattagcaatcttaatgcca

SEQ ID NO: 59581 - DNA, 201 bp, Homo sapiens
aaactcctgagggatgctcaggaaaccaaaaaggatgtctgcatggaggacaagaaggcacaaatcgtctgatttcaccccatcctaagatcttgtgactycagctttgttttggactggggcattggatctcccacatgccctctcttaagtcgtgcatttgacgcatatttaataagcacctactgtgtgccattagag

SEQ ID NO: 59582 - DNA, 201 bp, Homo sapiens
ccgctgatctgcatagcacttcgcaatgaagctgtgctctagaaacataccacgatctactggactttcttaaataaggtggttgttcaggaaattcctcyagttaattttactttaattccccctacaagaatgccgagacacctctgcctattttctctttctgtgtttgttgtttcttttgtttttgttttcgagact

SEQ ID NO: 59583 - DNA, 201 bp, Homo sapiens
tgctcaagtccttctcaaactgccctgttcctggttctctctcttctgcttctgcttttaaggaaccttgtaacttcagggagtctaccctgataatctgsgataatctgcctatttgaaggtcagccaattagcaatcttaatgccatctacaaccttaattaccatttgctatgtaacatatttatagatatcagggat

SEQ ID NO: 59584 - DNA, 201 bp, Homo sapiens
cctaaggtattgctgtcctcaccgtcctatggggagataggtcactttcccaagtctgggcagccagcagcagggctaagatcaccactcagaccctgtgwttttatttttcatctcctcacatctggcgctgaatgtcaggaccttcctggcctctgggaaagacacaggatggctgttttgagaggagtgtgaaataca

SEQ ID NO: 59585 - DNA, 201 bp, Homo sapiens
ctcaaactgccctgttcctggttctctctcttctgcttctgcttttaaggaaccttgtaacttcagggagtctaccctgataatctgcgataatctgcctrtttgaaggtcagccaattagcaatcttaatgccatctacaaccttaattaccatttgctatgtaacatatttatagatatcagggattagttcatgaaca

SEQ ID NO: 59586 - DNA, 201 bp, Homo sapiens
ttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtcttatttattttatgtccttggagtgtatagc

SEQ ID NO: 59587 - DNA, 201 bp, Homo sapiens
ctcaaatttctggctggtacaccctgggtaaggtccacaggctggatgggttttggaacatgtcttgattgtactttttcctcttggtttggaaagcaacrtaccctaggtaaggagagatttctgacaacagctcagcaatcacagtttccagaaaatggctccagtggatcaactatgagttaagtaaaaaaaaagtca

SEQ ID NO: 59588 - DNA, 201 bp, Homo sapiens
cactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggca

SEQ ID NO: 59589 - DNA, 201 bp, Homo sapiens
gccaggggtggtggtgcatgcctataatcccaacacttttggaggccaaggtgaggagaccacctgaggtcaggaattcaagactactgggcaacatggtraagctctgtctatcctaaaaatgcaaaaattagccgggagtggtggtgcatgtctgtagtcacagctacttgggaggctgaggcaggcgaactgcttgaa

SEQ ID NO: 59590 - DNA, 201 bp, Homo sapiens
gggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgc

SEQ ID NO: 59591 - DNA, 201 bp, Homo sapiens
tggtggtgcatgcctataatcccaacacttttggaggccaaggtgaggagaccacctgaggtcaggaattcaagactactgggcaacatggtgaagctctstctatcctaaaaatgcaaaaattagccgggagtggtggtgcatgtctgtagtcacagctacttgggaggctgaggcaggcgaactgcttgaacctgggag

SEQ ID NO: 59592 - DNA, 201 bp, Homo sapiens
ggaggagactttgactctagatgacatgatgtaccctgtgttctgcaagctggagaacatcatgtagaatctgaaaattaggagagagaggcaatcagaaraagacagagtggtgttgcagggacctgcagtcagcctagtcccccagtttgcgtttgaatttggtcccagattttttttgtttttgttttttagtagtta

SEQ ID NO: 59593 - DNA, 201 bp, Homo sapiens
ggtgccattttcctgactgtagatacttgggtaaggaggagactttgactctagatgacatgatgtaccctgtgttctgcaagctggagaacatcatgtaraatctgaaaattaggagagagaggcaatcagaagaagacagagtggtgttgcagggacctgcagtcagcctagtcccccagtttgcgtttgaatttggtc

SEQ ID NO: 59594 - DNA, 201 bp, Homo sapiens
aagcacgggggtttatgtgatggctccacagagcagtgaaaagactcccgccctactgctcgcaacctcagatgtccctgggcactagcccatctgtatgkctttaaaaaaaataaattaaatttttaaaaacatgactttctggccaggcgcagtggctcatgcctataaccctgcacttagagagggcaagacagaagg

SEQ ID NO: 59595 - DNA, 201 bp, Homo sapiens
gtcaggagatcgagaccatcccggctaaaacggtgaaaccccgtctctactaaaaatacaaaaaattagccgggcgtagtggcgggcacctgtagtcccarctacttgggaggctgaggcaggagaatggcgtgaacccgggaggcggagcttgcagtgagccgagagcccgccactgcactccagcctgggcgacagagc

SEQ ID NO: 59596 - DNA, 201 bp, Homo sapiens
gtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgttta

SEQ ID NO: 59597 - DNA, 201 bp, Homo sapiens
ttctatggattttcactaaaatagaatcatcgccttggtgatggatagaaaaagtaaagcaatacatcctgataaatgctgtgccttcctccttcgtctcyctggcggtgaccttgtgcaatccataagagggcaaggctgagagccccggccaccgccgccgtgtgtcagaacttggaaatttaagtagctttgaaaccc

SEQ ID NO: 59598 - DNA, 201 bp, Homo sapiens
gatagcatgagactgtgtctcaaaaattaaaaaataaaacataaataaatttctattgttttaagacaatttgcctgtggccctaggaaaccagtatagayaacttgtgatggtttagcttatttagtacaacaaccctgccccttctagtttttatgataacctcattaattgccggtactctcagagccctgattttct

SEQ ID NO: 59599 - DNA, 201 bp, Homo sapiens
gggaggctgaggcaggtggatcacttcaacccaggagttcgagaccagcctgggcaacaaggcgagaccccgtctctacaaaaaataccaaaaaatgagcygggtgtggtggggcatgcctgtagtcccagctacttgggaggctgggatggaagcatcatttgagcctgggaggtggaggttgccgtcagctgagattgt

SEQ ID NO: 59600 - DNA, 201 bp, Homo sapiens
aacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcactttgggaggctgaggcaggtggatcacttcaacccaggagttcgagaccagc

SEQ ID NO: 59601 - DNA, 201 bp, Homo sapiens
gaagctttacccctgagaagagcaggcatcagatgggctttggaatctacatgggtgtttgtaggtagaccatcctggaagttgagtgatggggaataaarggaagaaagtgcattctgaacagagggaatagcaggtacagcagctcagacatgggcaccttcagagcgtgtctgagtcttcctgatgagacacgtggtg

SEQ ID NO: 59602 - DNA, 201 bp, Homo sapiens
gacagcagggggtgaggataagaaggaggaagctttacccctgagaagagcaggcatcagatgggctttggaatctacatgggtgtttgtaggtagaccaycctggaagttgagtgatggggaataaaaggaagaaagtgcattctgaacagagggaatagcaggtacagcagctcagacatgggcaccttcagagcgtgt

SEQ ID NO: 59603 - DNA, 201 bp, Homo sapiens
gtgttaatcttacacctacccattagtctataaaactcctgagggatgctcaggaaaccaaaaaggatgtctgcatggaggacaagaaggcacaaatcgtytgatttcaccccatcctaagatcttgtgacttcagctttgttttggactggggcattggatctcccacatgccctctcttaagtcgtgcatttgacgcat

SEQ ID NO: 59604 - DNA, 201 bp, Homo sapiens
tcaggtgggactcatggagattttccgttctttggagactagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccct

SEQ ID NO: 59605 - DNA, 201 bp, Homo sapiens
ctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaa

SEQ ID NO: 59606 - DNA, 201 bp, Homo sapiens
gggagggaagaaccctatgggcagaaatgtgactttctgtagcaaagatgtactgtttcccactgagaagaatcaaaaatagaaaagtgcttccttgtctytctatattgttattaaaacaagtagatgcattttcattgaatcaaggcagttttcctttataaaatgtcctatttcatatcactgttcaaacttgacatc

SEQ ID NO: 59607 - DNA, 201 bp, Homo sapiens
ttacaggatacctagggacctgttggggtgggagggaagaaccctatgggcagaaatgtgactttctgtagcaaagatgtactgtttcccactgagaagawtcaaaaatagaaaagtgcttccttgtctctctatattgttattaaaacaagtagatgcattttcattgaatcaaggcagttttcctttataaaatgtcct

SEQ ID NO: 59608 - DNA, 201 bp, Homo sapiens
atctgtaaagtaaaaataaccgtcgtcgtcatttctcaagcgtgacgatactgttacacgtttactgcatattctgcataccaagcacatatccgtcacaygcagtgtggccaacttccgagaggccggcattcagccaaacagcctgaagaaccaggagaaatgcctgagtttccaaatggcttatggtaagttgttgct

SEQ ID NO: 59609 - DNA, 201 bp, Homo sapiens
ccagtcactctatagtaactattaggaaacccctttttttctctgaagtcattgctcctgtgtgtgtgtgtctgtatataaaaaaaagtatgtatacatayacgtatatgtatgtgtatagataaaaatgcatgtatggtgctgggcgcagtggctcacgcctgtaatcccagcactttgggaggctgaggcgggcgaatc

SEQ ID NO: 59610 - DNA, 201 bp, Homo sapiens
taaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacataca

SEQ ID NO: 59611 - DNA, 201 bp, Homo sapiens
gtgtgtgtgtctgtatataaaaaaaagtatgtatacatatacgtatatgtatgtgtatagataaaaatgcatgtatggtgctgggcgcagtggctcacgcytgtaatcccagcactttgggaggctgaggcgggcgaatcacgaggtcaggagatcgagaccatcctggctaacacggtgaaaccgtgtctctactaaaag

SEQ ID NO: 59612 - DNA, 201 bp, Homo sapiens
tgctgggcgcagtggctcacgcctgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccgaagaattacttg

SEQ ID NO: 59613 - DNA, 201 bp, Homo sapiens
actaccttgcttgcctatgggacatgttcccatttcagtgcatacttgacctttaccataaatcacatatttgtaaactgtaccctcctgctgttttattrggcatggagaagcagtcttttctttttcttgatggcctgggttgaccagatcctgacttttgtggagacattaaagtgctagaaatgataatggtgaaag

SEQ ID NO: 59614 - DNA, 201 bp, Homo sapiens
tggctaacacggtgaaaccgtgtctctactaaaagtacaaaaaattagcctggcgtggtggcgggcacctgtagtcccagctactcgggaggctgagaccsaagaattacttgatgaaacatggcagacgacatagaccagcagcaaactaccaacactgtggaggaccccctggatcttaggctcagcccagaggagcga

SEQ ID NO: 59615 - DNA, 201 bp, Homo sapiens
acaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgtttttttttttttttaaattaaggatgctgta

SEQ ID NO: 59616 - DNA, 201 bp, Homo sapiens; identical to SEQ ID NO: 54858

SEQ ID NO: 59617 - DNA, 201 bp, Homo sapiens; identical to SEQ ID NO: 54859

SEQ ID NO: 59618 - DNA, 201 bp, Homo sapiens
aactctctcattgccttcagagagttggtgattttggggggggcaccagtgtgagtcctttgatccttgaatgacaatttggatttgtctcaaggtcctgmtaaatgggaactggaggaactggcctactatggtattacaggctagcacatggtttgcattctgagggagctcagaataggcaaggtagaagacataggt

SEQ ID NO: 59619 - DNA, 201 bp, Homo sapiens
agccaagggatggctcagaagggtgaaggaactcacccgaattgcacagctggtgagctcagagtcaggctccttgcttggtccatctggcttccaaactscaagtctgtctgctccaccccatggcccatctttttaccatgtttagtatcaatgttcatactttgcagattttgctttcaaactctctagctgcggttt

SEQ ID NO: 59620 - DNA, 201 bp, Homo sapiens
tatatttcctgtggctgagctgagccgcacttggagatttgatccattttaactctctcattgccttcagagagttggtgattttggggggggcaccagtktgagtcctttgatccttgaatgacaatttggatttgtctcaaggtcctgataaatgggaactggaggaactggcctactatggtattacaggctagcaca

SEQ ID NO: 59621 - DNA, 201 bp, Homo sapiens
gattttttttttcataaaaccagtctaaaaaagccatgggttattttgtcatggcacgttttgatatgaatatttccacccccattatttgcataacaaaktacagattatccagaacaggtgggctgtacataaacaggctggtgggctggatttgtcctgtggactgtagtttgctgacatccaggctagatccttaat

SEQ ID NO: 59622 - DNA, 201 bp, Homo sapiens
acgaggtcaggagatcgagaccatcccggctaaaacggtgaaaccccgtctctactaaaaatacaaaaaattagccgggcgtagtggcgggcacctgtagkcccagctacttgggaggctgaggcaggagaatggcgtgaacccgggaggcggagcttgcagtgagccgagagcccgccactgcactccagcctgggcgac

SEQ ID NO: 59623 - DNA, 201 bp, Homo sapiens
attcatatatttaggtatagttagaaaaagcaaaatggtaacaatagaatcttgatgggattgatctcctgcagcaaggagcaacagaaaaaaaaaaaaakggaatcaagaacccaggtgctttttataggttaattgtgcagggttatcatgtatctctttaaaatcaccatcttgattctgagctttggttctacacat

SEQ ID NO: 59624 - DNA, 201 bp, Homo sapiens
caaatcagacaccaacataaactgtagagttaacattctttttccaccctcacactttttttagctccgatctgtgttcaatttctgcctgagagagtgawatattcatatatttaggtatagttagaaaaagcaaaatggtaacaatagaatcttgatgggattgatctcctgcagcaaggagcaacagaaaaaaaaaaa

SEQ ID NO: 59625 - DNA, 201 bp, Homo sapiens
tcttacacgttttacgggctatcagtagatgcatctaataatcctaacactgtcatccttatacttgaggtcttattgtccacttctaccttagctatgtwaacagatgagtaacctactctggatttacccagatagtgctgttaggcaccacacacgatgagattggaggcacctgggtgtcagcctcttgggctggct

SEQ ID NO: 59626 - DNA, 201 bp, Homo sapiens
ctggagtgacagagtgtgtcaagcctgcagctcgtcccgtgtctaatggaacagaaacaagcaccctgctgcccttgttttccagtggctcaccggggctytgcgaggtttattaatcttagcgtataatggaaaatgtgttgccatgtgaaatctagagcctctgttcactactccgcgaattgaaggcggcaggagtct

SEQ ID NO: 59627 - DNA, 201 bp, Homo sapiens
ctgtgtgtcaccttctctctgagctcaccctctctaggaagccttccttgctggaatgcccattccctgatataaggattccacccaccacgccccttgcrgttccttgccggtgtcctgtcctgggcagacataagccctgtgggttccagtttctcattaggaacctggatgatggagcagggatcatgctcattaagt

SEQ ID NO: 59628 - DNA, 201 bp, Homo sapiens
ccagccagggtggtctcgaggaggcccattaccggctggagtgacagagtgtgtcaagcctgcagctcgtcccgtgtctaatggaacagaaacaagcaccytgctgcccttgttttccagtggctcaccggggctctgcgaggtttattaatcttagcgtataatggaaaatgtgttgccatgtgaaatctagagcctctg

SEQ ID NO: 59629 - DNA, 201 bp, Homo sapiens
attagcatcaccctgctgtgcctcagtgtttccatctataaactgggtataataatcattcctaccccataggttgctgtgaagattggctcacatcagtmatgtacttggaatggatcctggcataaaaagagcccttggaaaatgatagcgttcatccttggtatgacctccaagttctttgaacctcaaagagccaag

SEQ ID NO: 59630 - DNA, 201 bp, Homo sapiens
acacaggctggagtgcaatggtgcaatctcagctcactgcaatgtctgcctcccagattcaagcaattttcctgcctcaggctcccaagtagctgggattrcaggcacccaccaccacacccaactaatttttgtgtttttagtagagacagggtttcaccatattggccagactgctcttgaattcctaacttcaggtga

SEQ ID NO: 59631 - DNA, 201 bp, Homo sapiens
agtgggagaacatggtatcagaaccaggagagggtcctctggctttctgagttctgccaaaaaccaagttttgctgccttgggcctgtggcttctcctccytgattgtcgctggccttgctgtaaattgtgaggcatccatgtgaggcacaggatggttccaaggaccaactgaggctgtctgtgctgaggctgggagggt

SEQ ID NO: 59632 - DNA, 201 bp, Homo sapiens
ttcagtgacatgccatcagatttgttccatgtagaaggacgacactatcagttagatgcttattttgttggcaaatttctatggcacttctgcttggccayttcaaaccaaccatggaagaatagataccccaatgcgatgtttcatccctattcataaagaaactgtactttgagcaatgtaggtatcccaggcagcatc

SEQ ID NO: 59633 - DNA, 201 bp, Homo sapiens
atttcagtgacatgccatcagatttgttccatgtagaaggacgacactatcagttagatgcttattttgttggcaaatttctatggcacttctgcttggcyacttcaaaccaaccatggaagaatagataccccaatgcgatgtttcatccctattcataaagaaactgtactttgagcaatgtaggtatcccaggcagca

SEQ ID NO: 59634 - DNA, 201 bp, Homo sapiens
taaaaatgtaaaatgtttcaaataaacacacactaaatatcttcttttatatcttataaacacccagcagtcctttagcacgggcatcaaggtggcccagytggaaaatttcagtgacatgccatcagatttgttccatgtagaaggacgacactatcagttagatgcttattttgttggcaaatttctatggcacttctg

SEQ ID NO: 59635 - DNA, 201 bp, Homo sapiens
gcatagaatgtttatatggtggccaaaaaagcagattggtatcatgctttatgtgtgttcattctagtcctgcacgtgtagaaatgtaagattttaatgtrtggtaaggtagatagatagatacatacatacatacatacatacatacatacatacatataaaattaggtaagaggatacttttaatgtatggtaagctat

SEQ ID NO: 59636 - DNA, 201 bp, Homo sapiens
ggtgcccgccaccaggcctggctaattttttttgtattattagtagagatggggtttcaccgtgttagccaggatggtcttgatctcctgtccttgtggtycgtctgcctcggcctcccaaagtgctaagattacaggcacgagtctccgcacccggccctgtttttgcatttttagtagagacgggttttcaccaggttg

SEQ ID NO: 59637 - DNA, 201 bp, Homo sapiens
caaaaaagcagattggtatcatgctttatgtgtgttcattctagtcctgcacgtgtagaaatgtaagattttaatgtatggtaaggtagatagatagatasatacatacatacatacatacatacatacatacatataaaattaggtaagaggatacttttaatgtatggtaagctatgattgcaccactgcattctagcc

SEQ ID NO: 59638 - DNA, 201 bp, Homo sapiens
gtatagtagtgggagaacatggtatcagaaccaggagagggtcctctggctttctgagttctgccaaaaaccaagttttgctgccttgggcctgtggcttytcctccctgattgtcgctggccttgctgtaaattgtgaggcatccatgtgaggcacaggatggttccaaggaccaactgaggctgtctgtgctgaggctg

SEQ ID NO: 59639 - DNA, 201 bp, Homo sapiens
gtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctgg

SEQ ID NO: 59640 - DNA, 201 bp, Homo sapiens
agtgattcagaaaatagcaagtatagtagtgggagaacatggtatcagaaccaggagagggtcctctggctttctgagttctgccaaaaaccaagttttgytgccttgggcctgtggcttctcctccctgattgtcgctggccttgctgtaaattgtgaggcatccatgtgaggcacaggatggttccaaggaccaactga

SEQ ID NO: 59641 - DNA, 201 bp, Homo sapiens
ctgatgtactcttgctggcggtccatctgagagttcacataagtgtgagtgactattttttgacaacactacctttgggagaagatggtttcaaagaactwactgtatcaaatggaaagacaatgtgttttcccaacatgggagtatgtttctaagttgggatcagttcacgattcagagaaatgctctgccttcttgtct

SEQ ID NO: 59642 - DNA, 201 bp, Homo sapiens
tgggggaaaaaaccaatagaataatgttttattacatgtaaaaattgtatgaaattcaaatttcagtgttcataactaaattttaaaaacttttattgaarttccagagagatctgaagtagttttattggaacacagccctacacaccttcatttataagctatctgtggctacttttgcactatgccagcaaagttgag

SEQ ID NO: 59643 - DNA, 201 bp, Homo sapiens
caaacatgtaataccaccctggtcttcaagtccactctcaaaaaaaaaaaaaaatttggcctttggcctcgtgaccaccaaatctgatttccatccaagargcaacattgtttgtgcttagaaggaattcctggctgggcatgatggttcacgcctgtaatcccagcgctttgggaggccgaggcaggcggatcacctaag

SEQ ID NO: 59644 - DNA, 201 bp, Homo sapiens
gtagttttattggaacacagccctacacaccttcatttataagctatctgtggctacttttgcactatgccagcaaagttgagtagttgggatggagactrtatggcccataaagcctaaaatactctctgctcctttccagaaagcttggcaacccctactatcatctccacgtctgcctttgttcttcttatttgtccc

SEQ ID NO: 59645 - DNA, 201 bp, Homo sapiens
taggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccc

SEQ ID NO: 59646 - DNA, 201 bp, Homo sapiens
agaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcat

SEQ ID NO: 59647 - DNA, 201 bp, Homo sapiens
tcccaattagtttcttcatgccataaggacaaaatccacatctcatactttttcaggatctgctctcacttccccaaacatgtaataccaccctggtcttmaagtccactctcaaaaaaaaaaaaaaatttggcctttggcctcgtgaccaccaaatctgatttccatccaagaggcaacattgtttgtgcttagaaggaa

SEQ ID NO: 59648 - DNA, 201 bp, Homo sapiens
tgtggagtatgcatttaattcacatttacaaattggtttctgtttttaactaaaggtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaag

SEQ ID NO: 59649 - DNA, 201 bp, Homo sapiens
ggcaggagaatccctatggtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagc

SEQ ID NO: 59650 - DNA, 201 bp, Homo sapiens
tttctaaaactttaagtttcagggtacatgtgtaagatgtgcaagtttgttacataggtaatcatctgccacggtggtttgctgcagagatcaacttatcrcctggatatgaagcccagcgtccattagctgttgttgctgatgctcttcccaccacctgcaagccccagtgtgtgttatccgcctccaccgtgtgtccat

SEQ ID NO: 59651 - DNA, 201 bp, Homo sapiens
atgcctttgtgtgtcctctcatggcagagagaggaaggggtctggaacctttctcttataaggatactaatcccatcgtaccccgtcccccatgatctcawttgaaattagtcacctcccaaagccccacctccaagtactgtcacactggggcatagggcttcagcatatgaatttgggggagctggggagaggaacaca

SEQ ID NO: 59652 - DNA, 201 bp, Homo sapiens
catagactgggcaggttaaacagcagacctctattcctcacagtctagaggctgggaagtccaaggtgaagccatgggcacattctgtgcctgcctgaggstctctttctggttcccagatggatgcctttgtgtgtcctctcatggcagagagaggaaggggtctggaacctttctcttataaggatactaatcccatcg

SEQ ID NO: 59653 - DNA, 201 bp, Homo sapiens
gcattacctggggctccctctggaaagaaaatggtggagaggttactggcctgatgacccagggacccaggcagtccttacagggacccagaatttcacawgcaaatgtgacctccaattaaagctggacttgattaaccccatttcccctcaaaagatgatacttgtaatgccgttccgatgaggccgtctcactccgta

SEQ ID NO: 59654 - DNA, 201 bp, Homo sapiens
tgtggaaaagggacatggcccagggaaccagagtggtttgggaaagcactttgtcaagaggcttggggaccccagggtggaagctgccatgcgcatgaggytgtgttagcagaggcagtggcagaagaagacattgcaaacctgcaaaagcaacctctgaggatgggtagacatatacttcattgcaggcagctgctgctg

SEQ ID NO: 59655 - DNA, 201 bp, Homo sapiens
catcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgttt

SEQ ID NO: 59656 - DNA, 201 bp, Homo sapiens
taaaacgtggatgttccaatttatgtatagccgcataatacattaccccaaaacttagaggcttaaaacaacaaccattttgttttatcttgtgatttctstaagttagggctcagtggagtgactcttctgccccttgtggtgttgactggggtcagtcagtggtgctatgctggaggatgaattggactggcacttcag

SEQ ID NO: 59657 - DNA, 201 bp, Homo sapiens
tggatgttccaatttatgtatagccgcataatacattaccccaaaacttagaggcttaaaacaacaaccattttgttttatcttgtgatttctctaagttrgggctcagtggagtgactcttctgccccttgtggtgttgactggggtcagtcagtggtgctatgctggaggatgaattggactggcacttcagctggtcc

SEQ ID NO: 59658 - DNA, 201 bp, Homo sapiens
atgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagta

SEQ ID NO: 59659 - DNA, 201 bp, Homo sapiens
gtgtagctccaattgccttcatccttagaagacctttaatgatatcctatgccaaacttcctagcctccacctgtaccctgaattggccctagcctagttktccaaactttatccccaggtggttgaactttctaagtttccccaagctgatcagtgttttggggtggtatggaactcagaatagatcactttttttattg

SEQ ID NO: 59660 - DNA, 201 bp, Homo sapiens
cttctctttgcgtcaccagagaggaagatcccctaagacaaagcattccctgtagtttttagcataactagtactggctcagtaagtatccactggggttsggaatacaactgccctgcctcttgagcagccatgcctgcttccgaggtggtgctgcatgctattcaggaggacagaccatggatgggaatcctgagccac

SEQ ID NO: 59661 - DNA, 201 bp, Homo sapiens
tggaccctctgatgttgacaacatgatgtcaaagatggtgtttgctgttgtttcaaatgtcttatttcaaattcccaattagtttcttcatgccataaggrcaaaatccacatctcatactttttcaggatctgctctcacttccccaaacatgtaataccaccctggtcttcaagtccactctcaaaaaaaaaaaaaaat

SEQ ID NO: 59662 - DNA, 201 bp, Homo sapiens
gcactttttctgtttttgatgggatttatcacttgaaaatgcatattatagtaatttctgaattcatcctgattctcctactggtttctaaactcttcagkttagaattcctgttggatatccctctggcccgaaattcctgaatgagttaagcaggacacctagaactatgcagaggtaataccttccttgacctgtccc

SEQ ID NO: 59663 - DNA, 201 bp, Homo sapiens
ggtttagaaataggtatgtgacccagttctgaccaatggatatggagggtgcttatgaggaaggtttcctactcctaaaagagatacacaggaagagagamcttctgcttcctctggacactggcgcagcctggactagcagttgccagcttgggtttggacaacctccgaccttagttgaaaatgaccctgtgtaggaca

SEQ ID NO: 59664 - DNA, 201 bp, Homo sapiens
gggcaaggagctcatctttcacggtcatagacctcagttgcaacatctggaaaaagagctggttgggcatgccgggcaggcttttgtgacaatgtaagagsaagtgaagattgcatctcagtatgagacaccgtaagagcttgataaatggtggaccctctgatgttgacaacatgatgtcaaagatggtgtttgctgttg

SEQ ID NO: 59665 - DNA, 201 bp, Homo sapiens
tgatgggatttatcacttgaaaatgcatattatagtaatttctgaattcatcctgattctcctactggtttctaaactcttcaggttagaattcctgttgratatccctctggcccgaaattcctgaatgagttaagcaggacacctagaactatgcagaggtaataccttccttgacctgtcccttttctgggtcagttt

SEQ ID NO: 59666 - DNA, 201 bp, Homo sapiens
tttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagcggcgcgatctcggctcactgcaacctccgcctcccgggttcacgccattct

SEQ ID NO: 59667 - DNA, 201 bp, Homo sapiens
catgtaaatgaattgtattttatgtaaccattccctagtgttggatagctaggccatttataatttggacactattttaaaaaataactcaggcttatttwactatttatttttgccttacactttttgtaaaagtaatcagagcagtaataatagatgactccccaaaatccttttgcctctaatgattagtctaagccc

SEQ ID NO: 59668 - DNA, 201 bp, Homo sapiens
aggtcttgtgtacccaccgatcgcaattgagcatatagtacatgctgtcctgtgtacccactgatccctggtcctgcccctggtatgagggtattaacatyttgcattagtgtggcacatttgctacaattaataaaccaatatcgatacattattaactagtctatagtttacatgaggggctgctgcttgtgttgtaca

SEQ ID NO: 59669 - DNA, 201 bp, Homo sapiens
cttgaaaatgcatattatagtaatttctgaattcatcctgattctcctactggtttctaaactcttcaggttagaattcctgttggatatccctctggccygaaattcctgaatgagttaagcaggacacctagaactatgcagaggtaataccttccttgacctgtcccttttctgggtcagtttgcccttcatgatttc

SEQ ID NO: 59670 - DNA, 201 bp, Homo sapiens
ctgtaatcccagctactcgggagcctgaggcaggagaatcacttgaacccgggaggtggaggttgcagcgagtcaaggtcacgccagtgtactccagcctsggtgacagagcgagactccgtctcaaaaaaaaaaaaaaaaagaaaaagaaaaagaaaaaggtgtttggaagccatgtcccatgaattccaaatacaattg

SEQ ID NO: 59671 - DNA, 201 bp, Homo sapiens
cctgacaatgttagtgaagttgcttgcttgaaatttaccaggccaggcttatggctgtaatcccagaaactcaagaagctgaggcaggagaatccctatgrtctcttgagtccaggagtttgagaccagcctgggcaagatagcaaaatactatctctacaaaaaaatgaaaaaaaaaaaaaaaaaaaagcctgtcatagt

SEQ ID NO: 59672 - DNA, 201 bp, Homo sapiens
agacatagaaattcttgggctttattccacacataatgaatcagaagcttatggggtggggcctgcagtctgacgtttattttttctaaaactttaagttycagggtacatgtgtaagatgtgcaagtttgttacataggtaatcatctgccacggtggtttgctgcagagatcaacttatcacctggatatgaagcccag

SEQ ID NO: 59673 - DNA, 201 bp, Homo sapiens
tctggctctgcagctgaaattgggatcgcatggagaaaatagaaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttaatgtctgaaagtt

SEQ ID NO: 59674 - DNA, 201 bp, Homo sapiens
tgtgtttttagtagagacggggtttcaccgtgttagccaggatggtctcgatctcctgacctcgtgatcctcccgcctcggcctctcaaagtgctgggatyacaggcgtgagctaccgctcccggccttttttttttttttttttttttttttaaagacagggtctcgctccgtcgcccaaactggagtgccgtggtgcga

SEQ ID NO: 59675 - DNA, 201 bp, Homo sapiens
aagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctc

SEQ ID NO: 59676 - DNA, 201 bp, Homo sapiens
agtagctggtactacaggtgcctgccaccacgcccggctaattttttatatttttagtagagacagggtttcaccatgttagccactttggtctcaatctmctgacctcgtgattcaactgcctcgccctcccaaagtgctgggattacaggcgtgagccaccgcacccagccgaaaagttataattttaatggtctaaat

SEQ ID NO: 59677 - DNA, 201 bp, Homo sapiens
tcctgacctcgtgatcctcccgcctcggcctctcaaagtgctgggattacaggcgtgagctaccgctcccggcctttttttttttttttttttttttttttaagacagggtctcgctccgtcgcccaaactggagtgccgtggtgcgatctcggctcactgcaacctctgcatgccgagttcaagcgattctcgtgtctca

SEQ ID NO: 59678 - DNA, 201 bp, Homo sapiens
tcttgagcagccatgcctgcttccgaggtggtgctgcatgctattcaggaggacagaccatggatgggaatcctgagccacaactccttagcctcatgacrttgggcagatgactgagcttgtctgagttacaataaataaaaataccatgctgaatgatggcctagcatgacattgggaagtacagactttgcaggcagg

SEQ ID NO: 59679 - DNA, 201 bp, Homo sapiens
actttgaacactttaaatgggtgaattgtatggtatatgaatcatatctcaacaaagctgttaaaaaattgtatgaaaactgtgatgggattcaagtagtstaacgctcaaatttcccaagtgccctcatttaagtctggaccacgacaggaacccagatgtggcctgagtagcacatcgtggaatgggcctgtcacctct

SEQ ID NO: 59680 - DNA, 201 bp, Homo sapiens
tgaacactttaaatgggtgaattgtatggtatatgaatcatatctcaacaaagctgttaaaaaattgtatgaaaactgtgatgggattcaagtagtctaaygctcaaatttcccaagtgccctcatttaagtctggaccacgacaggaacccagatgtggcctgagtagcacatcgtggaatgggcctgtcacctctaccc

SEQ ID NO: 59681 - DNA, 201 bp, Homo sapiens
cggtgttggctctcagttagagactcagatttatccctgcccgaatcattttctttgattctctgcccttccccactacagtgtaaactccatttggactytctctagttcactgtgaatggtttttgaataacatcaattagcataacctcatgcccagcatcgtccttattgttgagagcacagcagtgacaaaggtgc

SEQ ID NO: 59682 - DNA, 201 bp, Homo sapiens
caaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattccca

SEQ ID NO: 59683 - DNA, 201 bp, Homo sapiens
taaagacagtgcctccttccaggacaacggtttggcagatttgcttgataaaggttggggtttgtaagcttggggctcctcagccatgactgaaacgtacyatgagcacggcatctaccgggctgttccacatcctccctgtgggactaggggccagggcaatgggaatcagtgcagaaataaagctcatgctgtttgctc

SEQ ID NO: 59684 - DNA, 201 bp, Homo sapiens
agatctcactcactatggtgaagacagcgccaagccatgagggctccgccccagtgattcaaatacctcccattacggacatgtttcaacatgagatttgrgcggggacaaatatccaaactatatcaggatcccagcagactgggtgggtggaggttcagggatatctgggaaggactaagaatagctttttcttttagt

SEQ ID NO: 59685 - DNA, 201 bp, Homo sapiens
tctcactcactatggtgaagacagcgccaagccatgagggctccgccccagtgattcaaatacctcccattacggacatgtttcaacatgagatttgagcrgggacaaatatccaaactatatcaggatcccagcagactgggtgggtggaggttcagggatatctgggaaggactaagaatagctttttcttttagtaga

SEQ ID NO: 59686 - DNA, 201 bp, Homo sapiens
tagggttcctttttttcaagttaaagcattgagtcatgtctctgataaatcgcccccccaccccgatccccaccctctgccgccccggccttctttttgtrctgttgggttccaaactttacctgaggattttcacatgcacatctgttaaatgccatttaaagagaacactaacaagagaaagctagttcatttttcttc

SEQ ID NO: 59687 - DNA, 201 bp, Homo sapiens
atgaattttccgagactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccagtgtctttaatttgttaatgc

SEQ ID NO: 59688 - DNA, 201 bp, Homo sapiens
tgcaagagtcagcaaagtttctctgtgatgggatatttaataaatattttggggccttgtagtgtttgttgccaactactcaactctgccctcatagtgcraaaacaggcataaacgatatgtaaaggagcaggcatggctgcgagaaactttatttatggatactggaatttgaatttcatatacattttcatgtgtcac

SEQ ID NO: 59689 - DNA, 201 bp, Homo sapiens
tttgtgctgttgggttccaaactttacctgaggattttcacatgcacatctgttaaatgccatttaaagagaacactaacaagagaaagctagttcatttytcttcctgggacctcagtttcctcatcagcagaatcgggatattagtgcagaccttgcaggctctttatgaggatccatcgggagcctcaggcgcacact

SEQ ID NO: 59690 - DNA, 201 bp, Homo sapiens
tttgtgaaaaaggatgaattttccgagactctgttatgacagaaactcaccagttctctgttgttaatcaacaaatagattgtgaatgcttgactcttctctttttttttttttaaaggagtttcaagggtaagatctgctgtcttgtgaatgtcaaagaagtttctcattcgcccctttcttctctctcccagtgtcttt

SEQ ID NO: 59691 - DNA, 201 bp, Homo sapiens
ttctctgtgatgggatatttaataaatattttggggccttgtagtgtttgttgccaactactcaactctgccctcatagtgcaaaaacaggcataaacgayatgtaaaggagcaggcatggctgcgagaaactttatttatggatactggaatttgaatttcatatacattttcatgtgtcacaaaatattattctttccc

SEQ ID NO: 59692 - DNA, 201 bp, Homo sapiens
tgtttgtaacattgaatacttaagacatctgctcagagtctcgcattataaatgaatggaaaggatccaggagggctttattggatgggagccgtgaagtsagcgccgtgtatttcaaagcaggatcttaatcagacattatttatatctataatattttacaaattaaaagcagtagaaatagtcactggaaggaagtca

SEQ ID NO: 59693 - DNA, 201 bp, Homo sapiens
atccactggggttcggaatacaactgccctgcctcttgagcagccatgcctgcttccgaggtggtgctgcatgctattcaggaggacagaccatggatggraatcctgagccacaactccttagcctcatgacgttgggcagatgactgagcttgtctgagttacaataaataaaaataccatgctgaatgatggcctagc

SEQ ID NO: 59694 - DNA, 201 bp, Homo sapiens
acagccgtgtttggcccagcggttatagtttgccaacccctgcttagagtctagctttattcagagcttaaatatgtcatcgaggtcccctctttatttawtcccttagttttgatgatcttttatgggttatattcttcaaagggaaaattctctccgaatggggctgccactggcagacgagcactgtcccatcttggc

SEQ ID NO: 59695 - DNA, 201 bp, Homo sapiens
aacattgaatacttaagacatctgctcagagtctcgcattataaatgaatggaaaggatccaggagggctttattggatgggagccgtgaagtgagcgccrtgtatttcaaagcaggatcttaatcagacattatttatatctataatattttacaaattaaaagcagtagaaatagtcactggaaggaagtcagcaagca

SEQ ID NO: 59696 - DNA, 201 bp, Homo sapiens
gtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatg

SEQ ID NO: 59697 - DNA, 201 bp, Homo sapiens
tagagaaaaggtggcttggctgtttggtttatgtcctaaaaccttatcgtaatgtgattctccttaacagagggattcgtaagcttaggactgatagagawttggcttttctgctgttggattgatagctccttgactgctgaagccattgcccatctgttcaactgttgtattcacgaggaggttagacccctgacccaa

SEQ ID NO: 59698 - DNA, 201 bp, Homo sapiens
ggcctcttgttcttcttcagctgttcctcagacatgccaggtgtgttcctgtctcagacgctttgcctttgctgctccttctgcctggagtattcttccaygtagcaccatgagctgttcttctccaaaaggctttgctcaactgacactttctcagtgaagctgtttctcaccactcactataaaatggcagcctgcctc

SEQ ID NO: 59699 - DNA, 201 bp, Homo sapiens
attcagagcttaaatatgtcatcgaggtcccctctttatttattcccttagttttgatgatcttttatgggttatattcttcaaagggaaaattctctccraatggggctgccactggcagacgagcactgtcccatcttggcttgttcccccagtgacaagaagctgttttccccactacccttggcccaaaagccacag

SEQ ID NO: 59700 - DNA, 201 bp, Homo sapiens
ctattcatgtgttcttgaattaaattttcatggcaagcctaagaggccatgactgtccacattttgcctctgagagacgcaaggcttggaggcaggaaatsactcactgaaggccacagcacaaagtggggacttgagtcccgatctcactgattctaaagtccttgctctccaacctctgtccatctgaaatggaaaagc

SEQ ID NO: 59701 - DNA, 201 bp, Homo sapiens
tcgaggtcccctctttatttattcccttagttttgatgatcttttatgggttatattcttcaaagggaaaattctctccgaatggggctgccactggcagrcgagcactgtcccatcttggcttgttcccccagtgacaagaagctgttttccccactacccttggcccaaaagccacagggagaaccaggattggcctag

SEQ ID NO: 59702 - DNA, 201 bp, Homo sapiens
tttaggcagacacctatccctgaatcagtcatgtccccggatgatgcggttctctgcagcctgggcagtcaaggctggagataattctctgcttctccacrgagtctgagaggccccgttccctaatggaaaaatgaggtccaattttgcaaaaggaggcacctggggaaacattctggacacacaaatctatagcttcta

SEQ ID NO: 59703 - DNA, 201 bp, Homo sapiens
catgtccccggatgatgcggttctctgcagcctgggcagtcaaggctggagataattctctgcttctccacagagtctgagaggccccgttccctaatggwaaaatgaggtccaattttgcaaaaggaggcacctggggaaacattctggacacacaaatctatagcttctaccgtcaatctgctatgatccttttatggt

SEQ ID NO: 59704 - DNA, 201 bp, Homo sapiens
aattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcagaaaggagcctgttggatggtctcttactagtggtcagcaa

SEQ ID NO: 59705 - DNA, 201 bp, Homo sapiens
ctttgccactcagccccagaggtgcttctgcttccctgcaggcttgccctggagcctggcgctagggccctggggctcccttgctcctgcgtgccccctgygcctgccttcctgctgcctggcctttctcccatctgctttcttcctgagtggcccctggccaggggactcgggtgcatacatggtttccaaacgcctttc

SEQ ID NO: 59706 - DNA, 201 bp, Homo sapiens
cccctgcgcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgttttttttttttttttttttttaatttaatttaacttt

SEQ ID NO: 59707 - DNA, 201 bp, Homo sapiens
tgacagtccacttcattaagtggaggacagtgttttgattgctatttaatctgtttttccttctgtctgttcttggctatatggaattcactttgcctctsttcccgactcttcatatcccttatctcaaggtgagtatcgtcagaatcccggtacatttcaccagccaccttttatagaagcttagaaagatggaggcaa

SEQ ID NO: 59708 - DNA, 201 bp, Homo sapiens
ttaaagcgatagtcctattttctaagtaaaagtccaggcatgtgacttaaaaaagaaaaaaaaaaatgttttctggtcaagtcacatgcctctgaggtttktttttttctttctttcttttctttttttttctttttcccagactcctcatacccctcctaggagacagtgattccctggcttcaccaggcaggctcttgg

SEQ ID NO: 59709 - DNA, 201 bp, Homo sapiens
ctttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccg

SEQ ID NO: 59710 - DNA, 201 bp, Homo sapiens
gactcgggtgcatacatggtttccaaacgcctttcctccagccctcccgactagtgtcttaaatctcaagctggcctctctggctccgctgtttttttttkttttttttttttaatttaatttaactttaaattccgggatacatgtgcaggatgtgcaggtttgttacataagtaaacctgtgccatggtgacttgctgc

SEQ ID NO: 59711 - DNA, 201 bp, Homo sapiens
ttgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaac

SEQ ID NO: 59712 - DNA, 201 bp, Homo sapiens
taatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggaagggtgaagagtagcaaatttaccgtcatcagcaggtgtgtaaatgtt

SEQ ID NO: 59713 - DNA, 201 bp, Homo sapiens
aaaaaaaataaaagaacctgaagccgccaagagaggctcactgaccatctctgggggaggaagggtgaagagtagcaaatttaccgtcatcagcaggtgtstaaatgttccatttacattgaatggcacatgtcataaagtacataccgctgcacatcccaccctctgtttctgtttcaactgcagagcctatttttcttt

SEQ ID NO: 59714 - DNA, 201 bp, Homo sapiens
cctgaagccgccaagagaggctcactgaccatctctgggggaggaagggtgaagagtagcaaatttaccgtcatcagcaggtgtgtaaatgttccatttamattgaatggcacatgtcataaagtacataccgctgcacatcccaccctctgtttctgtttcaactgcagagcctatttttctttcccttccagctcagct

SEQ ID NO: 59715 - DNA, 201 bp, Homo sapiens
ataaagtacataccgctgcacatcccaccctctgtttctgtttcaactgcagagcctatttttctttcccttccagctcagctgccttctcctccctgacytcaggtcacccaagactcccactttatgatttccttttacttttagttcattattctctgtgattcagtggaaacataaaaaatggtttttaattttaat

SEQ ID NO: 59716 - DNA, 201 bp, Homo sapiens
cgtctccccgccttgtaagggctgcctgtcattttattagcgctggagcctcccgaccgaagggctgagtaattgacaaaaactgcaggtaaggcaagagrcccgtaattgattcataagatcccttcctccgatcgcattgaagagttaattatttttcctgcagttgggactcagctgttgtttccactgggattaaac

SEQ ID NO: 59717 - DNA, 201 bp, Homo sapiens
ctccccgccttgtaagggctgcctgtcattttattagcgctggagcctcccgaccgaagggctgagtaattgacaaaaactgcaggtaaggcaagagaccygtaattgattcataagatcccttcctccgatcgcattgaagagttaattatttttcctgcagttgggactcagctgttgtttccactgggattaaacagc

SEQ ID NO: 59718 - DNA, 201 bp, Homo sapiens
agaccctgtctctgaaaaataaaaataaaaaaaaaaattaagttagaagggagggattacgaccctcatgtgtatcaagaaacaagctccatgaagccccrtaggatggctcagcaccagaacgaggtctgactgttaagcaaagtcaagtgcatgatggctgaacattgctgggggaagattttgcaattatgcattgtt

SEQ ID NO: 59719 - DNA, 201 bp, Homo sapiens
ttgtttgctttgctttgccttgtctggtttttcaaagtgctcttttaacaaatgaaagtttaaagcttgagttcaatttgagtaatttgttcccagagaaraagtaaatgaaaagtatttctgggtatttttaatgacacaagtttctgtgctgatatgcgggcaggggttcgggagtgggggcaccagggctcatgagcc

SEQ ID NO: 59720 - DNA, 201 bp, Homo sapiens
gcacacacacacttttaagcatttttgatttatatatccctctgcatattttgtgccttgtgatgtgtttaacgaatgacagtgtctttagtgcattgctrcttggggtttctacactggaagtgtaatccgaggccttggaattggtcaaacaaaactcacttggcaacatttacttagagagcactctgcgagcactct

SEQ ID NO: 59721 - DNA, 201 bp, Homo sapiens
tcaatttgagtaatttgttcccagagaaaaagtaaatgaaaagtatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaatt

SEQ ID NO: 59722 - DNA, 201 bp, Homo sapiens
cacacataattcaaaggtaatgtaacttgccgtgtcggactttagtccattccgttaaatggagaaaaatgactgacgtgaagaatgacttattgattctyggtgggaaaatgacttctgtaatatgggaagtatggtaaaaggaatagcttaattatttagggagcacttttcaaaatgtgcttttacagcagtacaaat

SEQ ID NO: 59723 - DNA, 201 bp, Homo sapiens
cactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaac

SEQ ID NO: 59724 - DNA, 201 bp, Homo sapiens
caccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgca

SEQ ID NO: 59725 - DNA, 201 bp, Homo sapiens
tttacattatacttaggctggtgttaggatgccgtggctgccaagtttacacaatgcactttctctctctctttcttcttttggtttatgatgtttttcartagtgtcatggaactcacttaatctgatttcatcaagtaaatatatgggaagttgagatgacatatttttatctgacatttgaagaaatattcataaaat

SEQ ID NO: 59726 - DNA, 201 bp, Homo sapiens
tctcaccagactgatggtgccatgagggcaggggcaactcctatcctaaggcgtggcccatagtaaggggtattggttagaagaatgaaagattgaatacrtcaaagtgatgagtacagagctgtctgtcattttcttatctttggcctaacaactgaacacattttatgaaatttgcaaatctgtttccaaacatgtttg

SEQ ID NO: 59727 - DNA, 201 bp, Homo sapiens
actttacattttgagtttcgatttttttttttcacctgggctagtaatacgtggtaggatactctctcacaatgctaggccacagcagcgagctgcagctyccagtgatcacaagggcaaagaatcgatattctaccaggcacggtgttgcctgataaccttgcccagctgtaggctaatgtaagtgttcttttttatatt

SEQ ID NO: 59728 - DNA, 201 bp, Homo sapiens
tgctaaataaggcaggaaattccattaagtttaaatgtgctgcccttaccctaaagtgtttggagggcttcgtagaagagccaaatagattcacacagatyttatttgtagagctgaatgtgcacttcattaaaatactttgtaaggtattcaaggatgggctaggagggtgaggattccaaatcagaatcttcaagccag

SEQ ID NO: 59729 - DNA, 201 bp, Homo sapiens
caaatgaatgaatgtatgagtgggtcaagaacaagattcggccccaaggagatacgcgactttctactttgttttctatttggatttcacacaaaggctckaaggtctcctggtaggccatgctcagaagtctgggttgtcccctgcccaggacaggctcaccctggcctgtgtcctaggtattgtggggccgctgtagga

SEQ ID NO: 59730 - DNA, 201 bp, Homo sapiens
gcagtcagaggcctcaatggtgcctgtgtccacagggctggctgtcctcaccgtgaagtctagatctccctgctaacttacactgtgctcaaaacacacacacacacacacacacacacacacacacacacacacacactggctgtcctcactgtcaactctagatctccctgctaacttacactgtgctcaaaaaacaca

SEQ ID NO: 59731 - DNA, 201 bp, Homo sapiens
tgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaa

SEQ ID NO: 59732 - DNA, 201 bp, Homo sapiens
ttgcccgttgacctccatataagtatctgcatttgctgcatcattcatgacatgtgaggcctttgacaaaccctcctatggtgcagcttcctccgagcagstcctaaggaagtgccagagtcagggctttcctctgcctgaattatcggagctcttggcttaatgtgggagaagagatgaatgatctgtccttctatgaaa

SEQ ID NO: 59733 - DNA, 201 bp, Homo sapiens
atctgatgggtgtatcaggagtttccgcttttgcttcttcctcattttctcttgccactgccatgtaagaagtgccttttgcctaccaccatgtttctgargcctccccagccatgtggaactgtaagtccagttaaacctctttttcttcccagtctcaggtatgtctttatcagcagcgtgaaaacggactaatacagt

SEQ ID NO: 59734 - DNA, 201 bp, Homo sapiens
ttcctacattcaacattgtactctaatatccagtaaagtgaaacaaacaaacaaataaatacacttttttcaagaaaaaataaatatctgtgatctcatcrtttgaccgtcagtattttcatttttgcatgtgccactttaatttccctaggcaacactagctagtggcccacaataagacgtagaaaacaagaccacgta

SEQ ID NO: 59735 - DNA, 201 bp, Homo sapiens
ttcagtgttggatgttcaccgcttctttagggttctaccactcccagtaaatcaagtaataggtttctgttaaaaaccccagtgtgctgatctcagtggcrgccatcttgctttgtaagccttctctagctttatgatgctcccagtatataagacatttccagtgtctagtccaaattagtatttctctaattctcgagt

SEQ ID NO: 59736 - DNA, 201 bp, Homo sapiens
gcctgggtgatagagcgagaccctgtctctgaagatacaagaaggccacatgtggtggttcacccctgtaatcccagcagtctgtgagactgaggcagaargattgcttgagaagtttgagattggcctgggaaatatagcaagatcccaaccctattaaaaaattaaaaatgaaaataaaattttaaagaaaggtatttc

SEQ ID NO: 59737 - DNA, 201 bp, Homo sapiens
acccacagaacactggctcctcatcacctccccaagcccagcccctggcaaccaccattctcccctactttgtctatgaattcgactactcttggtacctyatataagtggaatcacacagtgtgtgatgtgttcttttgtggctgacttatttatgatactggattctcagcatcatgggagttaggactgtctgtcgca

SEQ ID NO: 59738 - DNA, 201 bp, Homo sapiens
ctcccagtatataagacatttccagtgtctagtccaaattagtatttctctaattctcgagtgtctgatctgcctggctagaatgattaaaacaaaaaaayagcaaatcagtttgacagtccacttcattaagtggaggacagtgttttgattgctatttaatctgtttttccttctgtctgttcttggctatatggaatt

SEQ ID NO: 59739 - DNA, 201 bp, Homo sapiens
ttttaaatagttaatccatttaagaagtttcatttaaggtactgttaaaaagaaaaaacacagaacaacacagtgagagcagaaaaggtatcatctcctcyccctcttcttctcttttagaaaccttgctgcgtgatccactgatggtaaatatttcatgtactttgcatatcagcctgagttccttttgtgaagtcaggt

SEQ ID NO: 59740 - DNA, 201 bp, Homo sapiens
taagtgatggctgcttatggccatgccctttcttctgcactttgggtgttttgtctggaattttctctcctttccttttgtgaaaaaggatgaattttccragactctgttatgacagaaactcaccagttctctgttgttaatcaacaaatagattgtgaatgcttgactcttctttttttttttttttaaaggagtttc

SEQ ID NO: 59741 - DNA, 201 bp, Homo sapiens
cccagattgatcttttctggatattgggtcaaccataagatggtacctttccctgtgtaacaaagtcagattctgtgaaacacctgttttttgtatggctyatgagatgaggatgatttttacctttttttttttttttttcccttgagacagtgtcattctattgtccaggctggagtgcagtggtgcaatctcagctca

SEQ ID NO: 59742 - DNA, 201 bp, Homo sapiens
agagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttatttta

SEQ ID NO: 59743 - DNA, 201 bp, Homo sapiens
tcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggagaattttgtgtgtcacatcaataaaca

SEQ ID NO: 59744 - DNA, 201 bp, Homo sapiens
tgcagggaattattgcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagacccacacttggtctctggtgttgggtccgccagctctcca

SEQ ID NO: 59745 - DNA, 201 bp, Homo sapiens
aatgtcacccgatgcaactgtctgtcctgaagaggaggacagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagc

SEQ ID NO: 59746 - DNA, 201 bp, Homo sapiens
ggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtgga

SEQ ID NO: 59747 - DNA, 201 bp, Homo sapiens
ccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacga

SEQ ID NO: 59748 - DNA, 201 bp, Homo sapiens
aagaacggcttggcagccagtccggctaagtggagctcagagcggatgggcacacacacccgccctgtgtgtgtcccctcacgcaagtgccagggctgggycccttccaaatgtccctccaacacagatccgcaagagtaaaggaaataagagcattcacaacagagtgaaaaatcttaagtaccaatgggaagcagggaa

SEQ ID NO: 59749 - DNA, 201 bp, Homo sapiens
cagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcgtgt

SEQ ID NO: 59750 - DNA, 201 bp, Homo sapiens
acatggcaaccaaataagagtagctggagcagagactttctcttcttcagattattaagatttgagcaattcattttttttggatggtgtttattaaagtmaagaaatcttttgcttatttgctaatgattctctcccctttctcttcttatatttttgaaggctgaattggtaaaattatctggcccaataaaaatatgt

SEQ ID NO: 59751 - DNA, 201 bp, Homo sapiens
tggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccgtaaggacccttgccatt

SEQ ID NO: 59752 - DNA, 201 bp, Homo sapiens
atctggcccaataaaaatatgtcctgggttggaaaagagcacaagtttctttttctagccctggagtgaggtggctctctggcctctgggttcgtttggtrtcctggggagtcattgacacccacacactcctagtcacaagacctttccctcccatccagattgtgtttattttacggctctcgcacggagcatgcagct

SEQ ID NO: 59753 - DNA, 201 bp, Homo sapiens
tgggcaagcggaggtcaagatggaattcagcctttcagacaattctgccaggcccttggagggtgggaggaaacaggcaagacctctggctcctagaaccrtaaggacccttgccattaggaccaaacctcttccagctttctcagcagccacatgtcaccccctcttccaccctttgccctgccaccctccatcccctga

SEQ ID NO: 59754 - DNA, 201 bp, Homo sapiens
ctttcctttataaaccacccagtcttgggtatttcttcttagcagcatgagaagggactaatacaggggtgatcacaaacagcctgcagactgggccatckttcttaggcaggatctcgagctaggagatgagaagagctctataggcaaaaagaatgacttggaaggccacatatggcagagtagctaagactttggggt

SEQ ID NO: 59755 - DNA, 201 bp, Homo sapiens
gaattcagcctttcagacaattctgccaggcccttggagggtgggaggaaacaggcaagacctctggctcctagaaccgtaaggacccttgccattaggascaaacctcttccagctttctcagcagccacatgtcaccccctcttccaccctttgccctgccaccctccatcccctgataccctcctgccttttagttgc

SEQ ID NO: 59756 - DNA, 201 bp, Homo sapiens
ttttgtcagttcatctatctgtccatctctttgtccatccatccaactacccacttacccatccatccatacatttatccatccatctacccacccatccrtccatccatccatccatgcatccatccatccatccatcatccatccatgcatgtaagttgcagacatcaacaaactttacccttaaggactttggctggc

SEQ ID NO: 59757 - DNA, 201 bp, Homo sapiens
ccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaac

SEQ ID NO: 59758 - DNA, 201 bp, Homo sapiens
gccactgtgcccggccttagatgaggtttgtagatgtgtttttcatattcccaaagccatgaaatttgacaggtaaatatatcagttataaaagttttagsattaattatcaactaactcccagaagttgcctcagcctctctttttcagccttgtcttgccccagcccagagacaagccacagctataggttttatttct

SEQ ID NO: 59759 - DNA, 201 bp, Homo sapiens
ctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgc

SEQ ID NO: 59760 - DNA, 201 bp, Homo sapiens
tcttattggaacagctggttttccctttaaaacagggagtccagcagcttctaggatgcttagaatcagaattgttgctcactttttaaggtatagagtakttgtcttattcttaactacattttatatctttgcccttttttcccctactttaaataaaatctatctctaatttatgttacttaagcaatgacaaattct

SEQ ID NO: 59761 - DNA, 201 bp, Homo sapiens
ttctttccttccctttttccttttctttccttctttccttgccatttaaaacatactgataacttggcagcacagggcagtgattaaactcaggcactcaycccaccctacctgggaatctgaattctgtcttttctgctgctgtggattctcagtccccaagttgtgtaaatcaaagcttctcctgccacactagtgtgt

SEQ ID NO: 59762 - DNA, 201 bp, Homo sapiens
aggaagaactcttccaaatgatggcagggatatttggaatctttccccctgagttccctctggaagttaaagcccagatcccgtgaactgattaaaaagcyccagaccattcccgttccagtcatcttgaaactgagcaagaccgtgtcatccatggagcttgaacataggagcactttaaaaaaaaaaagaatgaaaagc

SEQ ID NO: 59763 - DNA, 201 bp, Homo sapiens
tcttagaatcttctgaaataatatgcagcattatattccatttgtacctgggaagagggtacttgtctttcatcagagagtcaccaatggaccactggtcyctgctgatttagtgtcacagctcaaaaccatcagtagtcctcgtgatctttcggcattgtggctccctttgtgagaagggcctaagagtgaatctcccaa

SEQ ID NO: 59764 - DNA, 201 bp, Homo sapiens
ggaagaactcttccaaatgatggcagggatatttggaatctttccccctgagttccctctggaagttaaagcccagatcccgtgaactgattaaaaagccscagaccattcccgttccagtcatcttgaaactgagcaagaccgtgtcatccatggagcttgaacataggagcactttaaaaaaaaaaagaatgaaaagcc

SEQ ID NO: 59765 - DNA, 201 bp, Homo sapiens
caaagttacacaacggctgtaaaaaataaataaaaaaaaagcaaaattagcactttatcaagtttggggcatatttccaaggccaccagggagcagggaargtcaccaaaagaccgctccttgaaaccaggcaagaagccatctttgcagtgagctgagaggtctgatggccgccagctgagggagggaattccccttttg

SEQ ID NO: 59766 - DNA, 201 bp, Homo sapiens
caagggtaagatctgctgtcttgtgaatgtcaaagaagtttctcattcgcccctttcttctctctcccagtgtctttaatttgttaatgctttcgacttaytttgctttggataattttcaaagtactgctttctctagagatctctaaaaggcagaagttctggctattaaagatttgccattctcagaacagcccagtt

SEQ ID NO: 59767 - DNA, 201 bp, Homo sapiens
acccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcc

SEQ ID NO: 59768 - DNA, 201 bp, Homo sapiens
gacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgt

SEQ ID NO: 59769 - DNA, 201 bp, Homo sapiens
tccctggagaagcaccagcaattctctttcttttactgttatagaatagcctgaggtcccctcgtcccatccagctaccaccacggccaccactgcagccrggggctggccttctcctacttagggaagaaaaagcaagtgttcactgctccttgctgcattgatccaggagataattgtttcattcatcctgaccaagac

SEQ ID NO: 59770 - DNA, 201 bp, Homo sapiens
agcacaggaaagacttgccctcatgattcagttacgttccaccggggccctcccacaacacatgggaattgtgggagcgacagttcaagatgagatttggrtagggacacagccaaaccatatcacagggtcacctgtaggttaccgtaaataagagaaacagaccaagtagagactcagcatagctggagggggggcccc

SEQ ID NO: 59771 - DNA, 201 bp, Homo sapiens
cctgaggcataaatgggttttaagctccatacagtaaaacctagcatatgaaaacagttctggctgatgggttggtagaagtgatagatatagatacatayatacacatatatgcacagtaatagatataggtaaagaccttgatatatgtacatatattgtatgatacatatccatgcatatacgtgggtgtacacacac

SEQ ID NO: 59772 - DNA, 201 bp, Homo sapiens
ctgcctcctaggctcatgccattctcctccctcagcctcctgagtagctgggactgcaggcgccagccaccacgcccggctaattttttatatttttagtmgagacggggtttcaccatgctaaccaggatggtctcgatctcctgacctcgtgatccaccagccttggcctcccaaagtgctgggattacaggcattagc

SEQ ID NO: 59773 - DNA, 201 bp, Homo sapiens
ctgtttgttttgaaccacttattttggcaagacttcttcagacaggagagccctgagagctcttcaaaggctgggcctgatggtgtttgtcagagaggttygagctcttaaatttaaatggcctcccacagggaagcagaagtccttttggatcctccagaggactgagatcctccagatgctgttcatttgccttattcg

SEQ ID NO: 59774 - DNA, 201 bp, Homo sapiens
aaagtctgtaccaattaagcagctactacccattcctcttccctaccattctaccttctgtctcagtaggtttgcctatttgggatattttatttaagtgsgatcatacaatagcatcatgtgttcaaggttgacccacattgtggcatgtatcagtacttcattcccttttatcactgaatagtattccactgtatattg

SEQ ID NO: 59775 - DNA, 201 bp, Homo sapiens
tgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatcgccagagcaggagcaacagagagcgactggggaggcgctacacacttttcaaccac

SEQ ID NO: 59776 - DNA, 201 bp, Homo sapiens
atgaagggttcatcctcatgactcagtcacctcccaccaggccccacctccaacactggggattacaattcaacatgagatttcggcggggacacagatcyaaaccttatcaccagcgcttgttatttcctcaggtacattttgatgtccctccccactttactctcccctacaccttgaagcaggtgcaatcattttagg

SEQ ID NO: 59777 - DNA, 201 bp, Homo sapiens
agttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaa

SEQ ID NO: 59778 - DNA, 201 bp, Homo sapiens
tcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatgg

SEQ ID NO: 59779 - DNA, 201 bp, Homo sapiens
cttcccacaattcccagtgagcccaactccttaccacaattcccaccccatgccttccccaaattcctgatgagccctatgccttcccacaattccctgtraattttgctccttcccacaaccccagtgagccccactctgtcccataattccctgtaaatctcactccttcccacaatccccactgagtcccattccttc

SEQ ID NO: 59780 - DNA, 201 bp, Homo sapiens
gaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggtt

SEQ ID NO: 59781 - DNA, 201 bp, Homo sapiens
ccactccttcccacaattcccagtgaaccccacttgtgtagtgtgtctgtgagtagtctgcccactctccttatgacaggtttccagtattatctgtttcmtaacccatttccaaccttctgggttttttccttcaacgttttcctgtgacagttctccattatatctttgttagataatagttagcaacccattaataac

SEQ ID NO: 59782 - DNA, 201 bp, Homo sapiens
ctttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatt

SEQ ID NO: 59783 - DNA, 201 bp, Homo sapiens
tgttagaaaaggtattttttttatgaagtaagtagggaactaactacctgttcactgctgcccgttcattgctagcacaatgccaagtgtcaaataaatgyttcttgaacaagtgaatagagtacgcttctaggcttctggaaacggtgaatgttgctttatgtggcaaaaagggactttggagatgtgatcaagttcagg

SEQ ID NO: 59784 - DNA, 201 bp, Homo sapiens
ctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacagg

SEQ ID NO: 59785 - DNA, 201 bp, Homo sapiens
tatgtagtcatatatatatatgtgtgtgtgtgtgtgtgtatgtatatatatgtgtgtgtatgtatatatatgtatgtatctgtatatgtataatggctgtmcatgatataattttgagttggaaaaagcaaattgaagaataatacatgtattatcatgtctttaaaaaaaaactatacacatagctgaatgtttttgtgt

SEQ ID NO: 59786 - DNA, 201 bp, Homo sapiens
tgaccatccatctccagaatgattttcatcgtgcaaaactgaaacgctgtacccacagaacactggctcctcatcacctccccaagcccagcccctggcarccaccattctcccctactttgtctatgaattcgactactcttggtacctcatataagtggaatcacacagtgtgtgatgtgttcttttgtggctgactta

SEQ ID NO: 59787 - DNA, 201 bp, Homo sapiens
ttattttaagttcaggggtccatgtgcaggtttgttatataggtaaactggcgtgatgggggtttgttgtacagatgatttcatcacccaggtattaagcmtagtgcccattagttatttttcctgctcttctccctcctgccaccctccaccctttggtaggccccagtgtcttttgttcccctctttgtgtctatgtgc

SEQ ID NO: 59788 - DNA, 201 bp, Homo sapiens
atcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatt

SEQ ID NO: 59789 - DNA, 201 bp, Homo sapiens
gggaagagatcacttcacagtttcctgaaccactagaaaaaaaaaatgttcataaatttatagccgctgacattgaagttggagaaaagagcatatctagyacctatgctatgtggagaacactctccatgtctttgaaaaataagcacaatacaaattatatttgaggatgacctgccaaagggttgattatcctggaaa

SEQ ID NO: 59790 - DNA, 201 bp, Homo sapiens
atatgtagtcatatatatatatgtgtgtgtgtgtgtgtgtatgtatatatatgtgtgtgtatgtatatatatgtatgtatctgtatatgtataatggctgkacatgatataattttgagttggaaaaagcaaattgaagaataatacatgtattatcatgtctttaaaaaaaaactatacacatagctgaatgtttttgtg

SEQ ID NO: 59791 - DNA, 201 bp, Homo sapiens
ttctttagtggcgatttatcagatttcagtgtacccatctgagcagcatatgctgtacccaatatgtagtcatatatatatatgtgtgtgtgtgtgtgtggatgtatatatatgtgtgtgtatgtatatatatgtatgtatctgtatatgtataatggctgtacatgatataattttgagttggaaaaagcaaattgaaga

SEQ ID NO: 59792 - DNA, 201 bp, Homo sapiens
caggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccac

SEQ ID NO: 59793 - DNA, 201 bp, Homo sapiens
ccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctgg

SEQ ID NO: 59794 - DNA, 201 bp, Homo sapiens
gccaggagggtttctctgaggagatcccatttcaacagatctagaaatgtaatggagccagtcctagggaaacaggactaccaggaatcctcaccagcccsgcaaagacgagggagcagcaagttccaaagcccgtggcatgtcaagggtcgatgaattcaccaactgcaaggggctttggtgaccccagtgaacagatga

SEQ ID NO: 59795 - DNA, 201 bp, Homo sapiens
gatggctttctttccagtataataaagacagtgcctccttccaggacaacggtttggcagatttgcttgataaaggttggggtttgtaagcttggggctcytcagccatgactgaaacgtactatgagcacggcatctaccgggctgttccacatcctccctgtgggactaggggccagggcaatgggaatcagtgcagaa

SEQ ID NO: 59796 - DNA, 201 bp, Homo sapiens
tacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccat

SEQ ID NO: 59797 - DNA, 201 bp, Homo sapiens
tccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaa

SEQ ID NO: 59798 - DNA, 201 bp, Homo sapiens
aggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaa

SEQ ID NO: 59799 - DNA, 201 bp, Homo sapiens
ccccaatcgatcagtggagaaacgagctctggtgggcagtcaggcaaagcagatacacgtgcttcttttcagctttgttggaaggtttcattttgcttcasgaactaggcaggagaattcctgagttcctgtacaacctgagttctctgttaaaacaaggaggaagtaatcatcctgagttcgatgattcagagtaagcca

SEQ ID NO: 59800 - DNA, 201 bp, Homo sapiens
tcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccagctttcctcttcgggtg

SEQ ID NO: 59801 - DNA, 201 bp, Homo sapiens
aaacttctttccacaagagtaggtttataatttattttctttacattatctggataattacatttggtttgcttacatagatggaggcgaatggttttccratcttcaaaccaacctatatcacaaaagcattctgaaaactgggaagagatcacttcacagtttcctgaaccactagaaaaaaaaaatgttcataaattt

SEQ ID NO: 59802 - DNA, 201 bp, Homo sapiens
acagatctagaaatgtaatggagccagtcctagggaaacaggactaccaggaatcctcaccagccccgcaaagacgagggagcagcaagttccaaagcccrtggcatgtcaagggtcgatgaattcaccaactgcaaggggctttggtgaccccagtgaacagatgagaaaggggaggaggctgggatcagtgcacagctt

SEQ ID NO: 59803 - DNA, 201 bp, Homo sapiens
cggggtttcaccgtgttacccaggatggtctcgatctcctgacctcatgatccacctgccttggcctcccaaagtgctgggattacaggcgtgagccaccrcgcccgactgctttattttcctttgtgttcctaatacctggcccagtgtctggcaaatggaaagttcccctggatgtagttgggtgacactatgagtgta

SEQ ID NO: 59804 - DNA, 201 bp, Homo sapiens
agccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtc

SEQ ID NO: 59805 - DNA, 201 bp, Homo sapiens
tccccgttctggagagcctttgattataacatcagcctgtcatttggacctctgacctgaattatatgaatctgaaaaatctcttcctttcctatcgtgarttcggtcattgttataagccaagctttgcaaaggtggaacaccttggagatacttatctcctccttactctacccaagtaatgactcatccttttataca

SEQ ID NO: 59806 - DNA, 201 bp, Homo sapiens
agaatttggggagattctgctctaaagggaaaagctttgtaaaggagaattaccagtagagtgaccttataatttaccatccaatggattttgaatacttytgagagagaaatgagatactgataataattataccaagacaacagacataaattgggattggcctagacgagcaaagatgaatggtcattctgtctgtta

SEQ ID NO: 59807 - DNA, 201 bp, Homo sapiens
ggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagac

SEQ ID NO: 59808 - DNA, 201 bp, Homo sapiens
gcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctc

SEQ ID NO: 59809 - DNA, 201 bp, Homo sapiens
agggatggttctgtggtgtcccacactcaaataaacatcctttaaatacctctagatgcttataattcctgttgcagccttagtcagtgggagccactgasctgcattcgtgtaggaactgagcaaggttcatctagtctcggtagctagctaccccgagagctggctgattttttttttcttaaatttaattcaagactt

SEQ ID NO: 59810 - DNA, 201 bp, Homo sapiens
tcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgac

SEQ ID NO: 59811 - DNA, 201 bp, Homo sapiens
ctctagatgcttataattcctgttgcagccttagtcagtgggagccactgacctgcattcgtgtaggaactgagcaaggttcatctagtctcggtagctasctaccccgagagctggctgattttttttttcttaaatttaattcaagacttcatgaagtcaacaaaatggtctgttggaaattattcctaacccccaacc

SEQ ID NO: 59812 - DNA, 201 bp, Homo sapiens
ttagtcagtgggagccactgacctgcattcgtgtaggaactgagcaaggttcatctagtctcggtagctagctaccccgagagctggctgatttttttttycttaaatttaattcaagacttcatgaagtcaacaaaatggtctgttggaaattattcctaacccccaaccactgtcactgccacaatcaaacatattttc

SEQ ID NO: 59813 - DNA, 201 bp, Homo sapiens
aagaaagtacacaaatggagagagggggaattggacatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcc

SEQ ID NO: 59814 - DNA, 201 bp, Homo sapiens
cgcctgccttggccttccaaagtgctgggatatacattttttttttttttttgagagatggagtgtcactctgttgccgaggctggagtgtagtggcgcartctcggctcactgcaacctcctcctccggggttcaagcgattctcctgcctcagcctccccagtagctgggattacagtcgtgtgccaccacgcctggtt

SEQ ID NO: 59815 - DNA, 201 bp, Homo sapiens
tctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttga

SEQ ID NO: 59816 - DNA, 201 bp, Homo sapiens
agcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaa

SEQ ID NO: 59817 - DNA, 201 bp, Homo sapiens
gtgttctgcgaatcccggtctctactaaaaatacgaaaaaaattagccaggtgtggtggtgggtgcctgcaatcccagctactctggaggctgaggcaggrgaattgcttgaacccgggaggcagaggttgcagtgaacccagattgcgcctctgcactccagcctgggcaaaagagtgacactctatctcaaaaaaacaa

SEQ ID NO: 59818 - DNA, 201 bp, Homo sapiens
agagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgattcgtaccagctccccatcccttcccacgatcccatcttaatgtctg

SEQ ID NO: 59819 - DNA, 201 bp, Homo sapiens
aatactcccttctggacactggaagggcaaatgaggtgcaagccttttttttttctttcttttcttcttcttcttcttcttttttttttttttttttttgkttttcctcccagcctctctcctttcccattatgcacaatgcgctgagaaaggattcccagtccccctggtaaaaagtctgaaggatgccgaggagttcac

SEQ ID NO: 59820 - DNA, 201 bp, Homo sapiens
aaaatcacttttaaaaaatgtatggtgtccatctgggttagcaaacacatgctcacacgtctgtgcttgctggatttttaagaacttaccagcatttaagrttttcttatgaaactgattttactcaccagggatagagtctcaaagttggaggtattttatgttgttttaaataatatcgtcatcacatgtcattttaga

SEQ ID NO: 59821 - DNA, 201 bp, Homo sapiens
taaaactctgcctttctaaagaaacagggacacggtgcagaaaagttcatctggagttaggcttgtgtcttgctgtctctttaacggagagttcatgggcwgggtacagtctgtgagaaggaatgaaaaccccagggtagatgctaacaaaaatcacttttaaaaaatgtatggtgtccatctgggttagcaaacacatgc

SEQ ID NO: 59822 - DNA, 201 bp, Homo sapiens
caagtgattctcctgcctcaccctcccgagtagctgggataataggtgcctatcaccacgccgagctaatgtttttggatttttagtagagatgggttttmgccatgttgtgcaggctggtctcaaattcctggtcccaggcgatctgcctgtcttggcctcccaaaatgctgggattacaggcatgagtccccatgccca

SEQ ID NO: 59823 - DNA, 201 bp, Homo sapiens
aataaatatctgctagtttttaaagtttgagaaaaacccgtattgtggaatgaaaatgatactgacaagggaatacatctagatcagaaatactgatatcstaagtgagatcttgttttttaaaacaaaaaaaagtttaagaaattgtcatataggctgggcgtggtggctcacacacataatcttagcactttgggaagt

SEQ ID NO: 59824 - DNA, 201 bp, Homo sapiens
gcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagtcaaaaatccactggaggccaggtgcgttagctcatgcctgtaa

SEQ ID NO: 59825 - DNA, 201 bp, Homo sapiens
ctgatgtctcagcttgaagtcaggcatagagaggcaattctttctcactcagccttttattttattcaggccttcaacagattgtatgaagccacccacaytgggaagggcagtctgctttactcatagtactaatcgaaacgttaatgtcctccagaaacgccttcatggacacactagagataatgtttaacataatat

SEQ ID NO: 59826 - DNA, 201 bp, Homo sapiens
tgagatcttgttttttaaaacaaaaaaaagtttaagaaattgtcatataggctgggcgtggtggctcacacacataatcttagcactttgggaagttgagkcaggagggccacttgaggccaggagtttgaaaccagactgggcaacacagtgagaccccacctctacaaaatattttaaaattagccaggcgtggtggtg

SEQ ID NO: 59827 - DNA, 201 bp, Homo sapiens
gcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgc

SEQ ID NO: 59828 - DNA, 201 bp, Homo sapiens
gtgtctgtctgtatctttacacacctatgggtgtgtctgtctgtatctatacacacctatgggtgtgtctgtctgtacctatacacacctatgggtgtgtstttctgtatctatacacacctatgggtgtgtctttctatatctatacattatatgtactaaataatatatataaacactatagtatatagagtatacata

SEQ ID NO: 59829 - DNA, 201 bp, Homo sapiens
gatcaagcagagggcaagtggtagattctagaatttgcatccaggcagttgagtctagaattgtctttgtgtattttgctccatggtctagcacaggatcmccattggtagatcatcacttagaatgccatcactaccttctaacagcaatcagtccccttaagtggctttcttctcttttttttcttttatctttttgtt

SEQ ID NO: 59830 - DNA, 201 bp, Homo sapiens
cacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagt

SEQ ID NO: 59831 - DNA, 201 bp, Homo sapiens
tatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctaatttttatatttttttgtagagacggtgttttgcc

SEQ ID NO: 59832 - DNA, 201 bp, Homo sapiens
ctcttctttttttttttttttaaaggagtttcaagggtaagatctgctgtcttgtgaatgtcaaagaagtttctcattcgcccctttcttctctctcccastgtctttaatttgttaatgctttcgacttattttgctttggataattttcaaagtactgctttctctagagatctctaaaaggcagaagttctggctatt

SEQ ID NO: 59833 - DNA, 201 bp, Homo sapiens
tgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcact

SEQ ID NO: 59834 - DNA, 201 bp, Homo sapiens
tgttaatttagtcagacgaggaaggaaacgagaaaagttattcctatttcatccatctaagactttatatcccatttcaggctgattaaaaggcaaaatcktcacagtaggacaccaaaccctctgtatgccctgcctgcctccccccctctgacccgcctgcctcccccctgtgagctttttccacctactggcctcttg

SEQ ID NO: 59835 - DNA, 201 bp, Homo sapiens
gattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttg

SEQ ID NO: 59836 - DNA, 201 bp, Homo sapiens
agtcacgtagaaagcagttattgtttccaagttccctgcccttgttaaatgtcagctttgagtgaaaatgttcctaattttactcagagtgcaaagaacayccaggtcaggtacctgacctgcttgattcatgtcttggaaacactcctttgtctttcagagaaagtaaagagtgatggagacagagagagaaagtgtgac

SEQ ID NO: 59837 - DNA, 201 bp, Homo sapiens
taatctttcccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatg

SEQ ID NO: 59838 - DNA, 201 bp, Homo sapiens
ttcagagaaagtaaagagtgatggagacagagagagaaagtgtgacctactttttattatcagcaccatttcatctgcaaaacacgacttttctcttcttrttacgctgagcatgaaaataaaatgttttccaaaagacctggctttggctgttgtgaggaaggccagggacttgttcaaaactctgatgagctcgatgag

SEQ ID NO: 59839 - DNA, 201 bp, Homo sapiens
agggctggctgtcctcaccgtgaagtctagatctccctgctaacttacactgtgctcaaaacacacacacacacacacacacacacacacacacacacacmcacactggctgtcctcactgtcaactctagatctccctgctaacttacactgtgctcaaaaaacacacgcacgcacgcacgcatgcacgcacatacacac

SEQ ID NO: 59840 - DNA, 201 bp, Homo sapiens
gccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggccccttccaaatgtccctccaac

SEQ ID NO: 59841 - DNA, 201 bp, Homo sapiens
tttcatagataccactgacactatttttcacctcccatgttatcagtttgtgtaatagtagcttgctggtaatgtagttacagtaacaagttcaaatgacwtgtgtgttttttgagcaaacctggtgaacttttggtgcaaaactgatattgagagcaaataggccaaagcttgcttgagagaagtctcccaggccaccat

SEQ ID NO: 59842 - DNA, 201 bp, Homo sapiens
acgaaactcacatcttctttaaataaaatctccatttagaaatttttgaagacttgtggatagaagaagtaaccttgaaaagggcagagctgagccagacmccttttcagctgggtgctccctggaagatggatcttgccttgtggatgtttttctaccgtgacagaagatagaaaggatgaaatagaaagagtgtgagtg

SEQ ID NO: 59843 - DNA, 201 bp, Homo sapiens
cgaaactcacatcttctttaaataaaatctccatttagaaatttttgaagacttgtggatagaagaagtaaccttgaaaagggcagagctgagccagaccmcttttcagctgggtgctccctggaagatggatcttgccttgtggatgtttttctaccgtgacagaagatagaaaggatgaaatagaaagagtgtgagtga

SEQ ID NO: 59844 - DNA, 201 bp, Homo sapiens
tattcagttgcccagctcttttcattccctgtcctttccccctctggctgggtctgcctttccaaccgctaccaccttccaccaccattttttttttgttkcctctgcaagcaacatctgaaaggcccagacccagcttgttggccttgggctctgataagatctgtctgcactccttttgtctggcctgtacctgccttt

SEQ ID NO: 59845 - DNA, 201 bp, Homo sapiens
tgcctcagcctcccgagtagctgggattacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaaca

SEQ ID NO: 59846 - DNA, 201 bp, Homo sapiens
tgttgcaaatttccagtggctagttcagggacagtgccggggcttgaacccctgtctctgtgtctcccagctcataaggtgtgctaccaagtcacccatgwgtagcaattaggcgacttctaacatgtccagctttaaacctgtgacctcaaggcaaatgacttccacatctcattagcactccccagagccttccagccc

SEQ ID NO: 59847 - DNA, 201 bp, Homo sapiens
cagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtc

SEQ ID NO: 59848 - DNA, 201 bp, Homo sapiens
gattcctccccattctataaaataacagctaccatttcctgagggcatactgagtgctgacaggcacatcaacatcagaccatcaccttcttatacctcaraatagtctgcagggtgactcagaagctcctggctggtaagtggcagatccagagatgaaacccagatctaactggacccaagacagaaatttctagaaca

SEQ ID NO: 59849 - DNA, 201 bp, Homo sapiens
gcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattt

SEQ ID NO: 59850 - DNA, 201 bp, Homo sapiens
cttggcctgatgttaccagctttaaagagggaggaagcgtccaggagccaaggaattcaggcagcgtctagaagccagaagaggcaaggaaagagattctstcccagaacttccagaaaggcacgaagccctgctgacctttgattttagcacagtgatacccattgtggccttctgaccttcagaaaataaatttgtttt

SEQ ID NO: 59851 - DNA, 201 bp, Homo sapiens
aagagggaggaagcgtccaggagccaaggaattcaggcagcgtctagaagccagaagaggcaaggaaagagattctctcccagaacttccagaaaggcacraagccctgctgacctttgattttagcacagtgatacccattgtggccttctgaccttcagaaaataaatttgttttaagccactaatttgggggtaattt

SEQ ID NO: 59852 - DNA, 201 bp, Homo sapiens
gaccttaggtgatctgcctacctcggcctcccaaagtgctgggataacaggcgtgagccactgcgcctgtctacattttctgtctttactggtattatggygggaacccataaaccactgcgaggcagataccattttaagcaggaaaccttatttttttccgaagcacatttaaaaatattttccagtttatctattaaa

SEQ ID NO: 59853 - DNA, 201 bp, Homo sapiens
gcgatttaatttgctgctgaatgcacttttgaataaagggcctagaagatgcagtctcgaggaaccgaggccggttagagacaggctggcagctttgcctyctctcccaagacaaaggcctccccgcccccctaaatccagcacacaatcagctgctctccctccccctattctcagcaggagagtcaggatgcatatttc

SEQ ID NO: 59854 - DNA, 201 bp, Homo sapiens
tcgctgcaggctacttggttgtacttgagtaatttactcaagattctcttcagcccagtttccttatctgtaaaatccttccactgttgttaggaggatargaaagccagtattggtaaaaacatatatcagagtccttttgactgtttagaaagtgttaatttactccacgattatccattcaacatttattagttggct

SEQ ID NO: 59855 - DNA, 201 bp, Homo sapiens
tgcagcctctacttcctgggctcaagtgatcctcccacctcagcttcctaagtagctgggagcacaggcaccagcaatgacacctgcctaattttgtattktctgtagagatggggttttggcatgtttcccaggctggttttaaactcttgagctcaagccatccacccgccttggcctcccaaattgctggaattatag

SEQ ID NO: 59856 - DNA, 201 bp, Homo sapiens
ctctgaaagatttatctctttcgattcatctgtaaagtaaaaataaccgtcgtcgtcatttctcaagcgtgacgatactgttacacgtttactgcatattstgcataccaagcacatatccgtcacacgcagtgtggccaacttccgagaggccggcattcagccaaacagcctgaagaaccaggagaaatgcctgagttt

SEQ ID NO: 59857 - DNA, 201 bp, Homo sapiens
ttcagccaaacagcctgaagaaccaggagaaatgcctgagtttccaaatggcttatggtaagttgttgctgccactatgagtagcctacttgcatttctayttaatggcttttccccatatttgatggtatgttaaacagtcaatcattcattttctaaattaaagcctgtcctgaaaacgtgctcagtgctattgactgt

SEQ ID NO: 59858 - DNA, 201 bp, Homo sapiens
ctgcatgctgcagccagctcaggaaagatttcaggaagagcgtttaggaaggcagctttgaaaagaaaatggaaagatgaggttgcagagggtcagtccawggtgaccagaatctgacctggggcaatgccataaatccaagaaagactgggtttcaggtgcaggaaatgcgattgtgcacggacccttgcctttttaccc

SEQ ID NO: 59859 - DNA, 201 bp, Homo sapiens
aaaataatattaccggagaaacaatgagtaacatgtataggattttttttttttttttttgacggagtcttgctctgttgcccaggctccagtgcagtggygtgatgttggctcactgcaactccgcatcctggtttcaagtggttcttctgcctcagccttccaattagcggggactaccagcgcatgtcaccatgcctg

SEQ ID NO: 59860 - DNA, 201 bp, Homo sapiens
caggtgggaacagggttacagagcaaagtaattagatgccctttagatgctcttagttaaagaccatgcaaaaaggatgaaatcttttgatcatgttcttyacaatattagaggtaaaacatgaactcaacgcttttaggaagaaacaactggattgcgttttctattttattgacagaaactagatggggaggccagggt

SEQ ID NO: 59861 - DNA, 201 bp, Homo sapiens
aggtgaccagaatctgacctggggcaatgccataaatccaagaaagactgggtttcaggtgcaggaaatgcgattgtgcacggacccttgcctttttaccmagtatctagcccatccttctttcttagaagcagaattttctaagaggtacacggtagttcaggataaaaattccctgtgctaactgcccttgcagctagc

SEQ ID NO: 59862 - DNA, 201 bp, Homo sapiens
tggtctttgctttcataggttatttctcctcttccatagcaacacatgtcaaggcaaggaccatatcttattcagttcctagtcatcttttctttcttttsctttttcttttttaaattgttaagatctgccataaaaatgtctgtcagagtaggcatgattgcatattctttagatggatgggtggatggatggatggat

SEQ ID NO: 59863 - DNA, 201 bp, Homo sapiens
tgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataa

SEQ ID NO: 59864 - DNA, 201 bp, Homo sapiens
ttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgac

SEQ ID NO: 59865 - DNA, 201 bp, Homo sapiens
caggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcacccggcccctgcctttttattttgctaaacctgatgacccttgccatag

SEQ ID NO: 59866 - DNA, 201 bp, Homo sapiens
tttgacatgttgccaggctgctctcgaactcctgacctcaggtgattcacctgccttggcctcccaaagtgctgggattacaggtgtgagccaccgcaccyggcccctgcctttttattttgctaaacctgatgacccttgccatagcagaactaaagtgatgatgatgattacagcagatcagttattttgagctctgac

SEQ ID NO: 59867 - DNA, 201 bp, Homo sapiens
gtgtgagccaccgcacccggcccctgcctttttattttgctaaacctgatgacccttgccatagcagaactaaagtgatgatgatgattacagcagatcarttattttgagctctgactttgcatgaggccctttattaagtgcttcacttgtgtgatctgatttaatcttcacaagcaaactgggacagagggactgtgc

SEQ ID NO: 59868 - DNA, 201 bp, Homo sapiens
cggcccctgcctttttattttgctaaacctgatgacccttgccatagcagaactaaagtgatgatgatgattacagcagatcagttattttgagctctgastttgcatgaggccctttattaagtgcttcacttgtgtgatctgatttaatcttcacaagcaaactgggacagagggactgtgcctattcccatttcacag

SEQ ID NO: 59869 - DNA, 201 bp, Homo sapiens
aggagcagaggacaggatggctttctttccagtataataaagacagtgcctccttccaggacaacggtttggcagatttgcttgataaaggttggggtttstaagcttggggctcctcagccatgactgaaacgtactatgagcacggcatctaccgggctgttccacatcctccctgtgggactaggggccagggcaatg

SEQ ID NO: 59870 - DNA, 201 bp, Homo sapiens
ttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaat

SEQ ID NO: 59871 - DNA, 201 bp, Homo sapiens
gttccctgtactctgcaatgctgagtacttctcatccttcaggtctactgcaagtgtcacctggccaacacaccatgccttcccagtctctggtgttactstctgcatactgtagaccatcatcttgtttgcatacttgtctgttatctctttatcatccgtctacccacatcaggcaattccaagagagaagaccactgg

SEQ ID NO: 59872 - DNA, 201 bp, Homo sapiens
agtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggc

SEQ ID NO: 59873 - DNA, 201 bp, Homo sapiens
tttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgca

SEQ ID NO: 59874 - DNA, 201 bp, Homo sapiens
gaaggcaatactattatgctcattcataattaaggcaattgaagcccagacccttccagtagctttcctgaagtcaagttgccagtgcattggacatactrggctgtagttccagggcagcctggctctggtgtctttgctgcaatgacaatatctccccatttctctgtttaaataccacacactccccatatggtttct

SEQ ID NO: 59875 - DNA, 201 bp, Homo sapiens
taaagaaatattcgtaatcaataagaacacaaaatatggaatatattaactgagttataaaaatgtttgtagtatagcacagaatgaaaaacacagcaagktatgtacggtttaaagtgtaatcaattttgaggttgtatacaaggatatacatgataaatacaagtagtagcatttttagtaaaggctgttacaaaatac

SEQ ID NO: 59876 - DNA, 201 bp, Homo sapiens
cctcccttcctgatttcccatcttcttcctccctcttctctcccctctcccccttctcctttccgtccttcctccttcagttccctctttcctctttttcrcccttttatttaacattataaatacgatgggattgtgtctgcgcttttgttggtaattaaataaattatttatacatttaacacaatcttgaattaccag

SEQ ID NO: 59877 - DNA, 201 bp, Homo sapiens
tgttctatttatttatttgttattattatgttttttgagacagagtctcgttctgtcactcaggctggagtgcggtggcatgattgtagctcactccagtsttgagctcctggactcaagagatcctcctgcctcagtttcctgagtagctgagaccacaggcacgggacaccatgccagtctaatttttaaattttttgt

SEQ ID NO: 59878 - DNA, 201 bp, Homo sapiens
ctcagtttcctgagtagctgagaccacaggcacgggacaccatgccagtctaatttttaaattttttgtagggacagggcctcactgtgttgcccaggctyatctcaaactcctggcttcaagtgatccttctgcattgtcccccacaaagtattgggaatgtattctttcctgatcaggaaactccgcagagagaaagtg

SEQ ID NO: 59879 - DNA, 201 bp, Homo sapiens
ttttttttttttttttttgagactcactctgtcacccaggctggagtgcagtggcatgatcatggctcactgcagcctcccgggctcaagctttccacccmcctcagcctcctgagttgctgggaccacaagtatgcaccaacatgcctggttaatttttgtggttttttttttttttttttttttcctgctgagatgggg

SEQ ID NO: 59880 - DNA, 201 bp, Homo sapiens
ggggatttcaccatgttctccaggctggtttcaaactcctgagtccaggtgatccacccatcttggcctcccagagtgctgggattacaggtgtgagccaytatgcccaataccccctatgtagacttttaaagaaatacaggaaacagccaagactggtgtcattcagatttagcttgggagagtctagtgggtgttagg

SEQ ID NO: 59881 - DNA, 201 bp, Homo sapiens
taaaaccaggggagactcgacccaaggcattgtgtttgagctaggctttgaacaatgtatagaccctcaccaagtatggaagtggaagagtaagacattcmaggtagaaggaacagtatgaggaaagtcagagagctaacaaagattatagtgtaatgccagaatcatgagaaatttgctgagaattcatttgaggccata

SEQ ID NO: 59882 - DNA, 201 bp, Homo sapiens
gccatctctgcctctgtcttctcaccaccatcttccttgtccatgtctctctatgtcttcaatgttcttcttataaggacaccagtccttggatttagagyccaccctaattcactgtaatcacatcttacctaagtccatctgcaaagaccctatttccaaataaggtcacattctgaggccctgggtggacatgcattt

SEQ ID NO: 59883 - DNA, 201 bp, Homo sapiens
tttaaggacctttgtgatagttttgcacccactggatgacccagaatcatcttcctcttttaagatcagctgattagcaacgtcagttccacccacaatcytcatttccctttgttgcgtaacctaacatattcacaggttctggtgagtgggatgggggtatctctaggggaccattatccagccttccacaggcacttt

SEQ ID NO: 59884 - DNA, 201 bp, Homo sapiens
gatagttttgcacccactggatgacccagaatcatcttcctcttttaagatcagctgattagcaacgtcagttccacccacaatcttcatttccctttgtygcgtaacctaacatattcacaggttctggtgagtgggatgggggtatctctaggggaccattatccagccttccacaggcactttgtcacaggccaggcg

SEQ ID NO: 59885 - DNA, 201 bp, Homo sapiens
ttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttactaacagaattcattttcttgtaactgtaggactgaggtgctt

SEQ ID NO: 59886 - DNA, 201 bp, Homo sapiens
ggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatatttcaggctttgcaggccctatgacgt

SEQ ID NO: 59887 - DNA, 201 bp, Homo sapiens
taaagtttagacctattttaataaggctgacttgggttgaagataactagagccatgactttcatcttgatggacaatgagtactcactctacttttttaktttatatttttattttagttcatttcatttaagacagcgtctgttacccaggctggagtgcagtgacatgatctcggctcactgcaacctacaccttctg

SEQ ID NO: 59888 - DNA, 201 bp, Homo sapiens
tgcagggagatttggggatgttggatgctaaggcccaagccgtctattgtatgccttttgctttggcataaaacaacagatgaccttctgttaggtgtatstctgctcatgcttgagagtggtggtgtttggaaagactcaatagcatatgcacatgaggaagttgaccaaatgattccacagcgcatactcattttttgc

SEQ ID NO: 59889 - DNA, 201 bp, Homo sapiens
tctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtg

SEQ ID NO: 59890 - DNA, 201 bp, Homo sapiens
cctatctgtgatgacctgtaaatggaatttaagggaggaatcacacgtgttagcacggggttggcattgcgtggctgttttcaattaacttgaccactatsataacatcaaaggtgtgtgtaccattctatgaccattgaatctccatggacatgttttgggaaatggatttgtcccattacactgctttctttagtgcat

SEQ ID NO: 59891 - DNA, 201 bp, Homo sapiens
gggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccggga

SEQ ID NO: 59892 - DNA, 201 bp, Homo sapiens
gaagagcataagaaaaaggaagggtactgggtggaccaaatctattgttacaatatcccttatattccttagggttcctttttttcaagttaaagcattgrgtcatgtctctgataaatcgcccccccaccccgatccccaccctctgccgccccggccttctttttgtgctgttgggttccaaactttacctgaggattt

SEQ ID NO: 59893 - DNA, 201 bp, Homo sapiens
atcccttatattccttagggttcctttttttcaagttaaagcattgagtcatgtctctgataaatcgcccccccaccccgatccccaccctctgccgcccyggccttctttttgtgctgttgggttccaaactttacctgaggattttcacatgcacatctgttaaatgccatttaaagagaacactaacaagagaaagct

SEQ ID NO: 59894 - DNA, 201 bp, Homo sapiens
cctacttttaaaaaattgaggtgaaattcacataatataagattaaccatttcaaagtagacagttcaatagcagtacattcacaatggtgtgtaaatacygcatctatctatttccaaaatatttgtatctccccacaataaaagtctgtaccaattaagcagctactacccattcctcttccctaccattctaccttct

SEQ ID NO: 59895 - DNA, 201 bp, Homo sapiens
aaggcagactttagtctggtttataatgctttaatatttttttgaaggaagaaaaatgttcattacttaacgtaataattatttttaaaaagcagcctggsgggggggtattcatttttctgtggctgccataacaaagttcttcaaacttagtgtcttgagacaagacatttattttcttaaagttctggaggtcagagg

SEQ ID NO: 59896 - DNA, 201 bp, Homo sapiens
tggctgcctgcaagggaggctgggaaatatagtttgctgtgtgctgggtgggtgggagggagcgtccacattagtgaacagccaggcagtcgctgcctcamatttctttagggttatcctttcattccagcaattgaatttgatttgcactgtttcacttctctacaagggtgtaaaaagtagaggttcctcttgaaagaa

SEQ ID NO: 59897 - DNA, 201 bp, Homo sapiens
tgttttaaacccatctgtttttgtttctggtaactgtatccaaaagtaatacagaattttccgtaagaacatttattgtgtttccttctacccacgaattktcttatgctacacacacaacccactgaaatttcacctctattgtatgtggcttttctagaaacgtgtgcttctgggctttgtctcacacctcctggccag

SEQ ID NO: 59898 - DNA, 201 bp, Homo sapiens
ttatgtcattggctacaactcagtcacatgaccatggctgcctgcaagggaggctgggaaatatagtttgctgtgtgctgggtgggtgggagggagcgtcmacattagtgaacagccaggcagtcgctgcctcaaatttctttagggttatcctttcattccagcaattgaatttgatttgcactgtttcacttctctaca

SEQ ID NO: 59899 - DNA, 201 bp, Homo sapiens
tcagcttgttttgctcctgcatctttgcatcagctgggctttctgccctaggctggacatgggtggggcactttagctggggtggttctcctccacatgtstctcatcttcctgggaccagcagggctagaccagacatgactttcttatggcaagggcagaaatgcaagacagcaactcaaaacacataaggactttcaa

SEQ ID NO: 59900 - DNA, 201 bp, Homo sapiens
agcatgtagaaagatcactgcagatgtccttgtcgtgttgaccttattggagaatttcctatctgtgatgacctgtaaatggaatttaagggaggaatcamacgtgttagcacggggttggcattgcgtggctgttttcaattaacttgaccactatcataacatcaaaggtgtgtgtaccattctatgaccattgaatct

SEQ ID NO: 59901 - DNA, 201 bp, Homo sapiens
aaacaaacagatctcaggagaactctttcacaagacagcactagggggatggtgattagaaagcacctcatgatcccgtctacttcctgcagagaacagaytagccccctatgcagcacacacctttgtgaggtccctcctccaacacagggattacaattcaacctgagacgtgggtggggacacagagccaaaccacac

SEQ ID NO: 59902 - DNA, 201 bp, Homo sapiens
ggaccaagttttattccctgtttaaccttggcctgacaacctaataggtgctcagtgaacagttcttgaatttaattctctccctttccccacactgatgkgtatttaagctccagtggtactcgatgtgttgttttctttgttcttttttttgagacagggttttgctgtcacccaggctggagtgcagtggcagagtct

SEQ ID NO: 59903 - DNA, 201 bp, Homo sapiens
ttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcc

SEQ ID NO: 59904 - DNA, 201 bp, Homo sapiens
agaatataaaattttgttctattttattttaaagctctggttacatatggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcat

SEQ ID NO: 59905 - DNA, 201 bp, Homo sapiens
ggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgc

SEQ ID NO: 59906 - DNA, 201 bp, Homo sapiens
tggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcag

SEQ ID NO: 59907 - DNA, 201 bp, Homo sapiens
ataaatatttattgagtagtaagcacatgcaaggcattgagggtggggagggaaaaagacacaaattgtccttaccctcatggattcaccatctatttaamggccacaaatacttgtgtgagaagcaagtcttaatagtctgaagtattttcttagattcccttgagccgcaatgctgaaaagcttatggtggttttgcta

SEQ ID NO: 59908 - DNA, 201 bp, Homo sapiens
agctcaccggggagtgtttctcccagttcctccccagtacacagaaaaacaaagctttctgtctcaccaggaggactccacggtgagcatagcttggctcmgcccagcaggagattttgaaccgactctggtagattcttcctgcagccattcagctcccacctctttctctcaaaaagaaatccagggctgggtgtgtgt

SEQ ID NO: 59909 - DNA, 201 bp, Homo sapiens
gttgcccctaggatcatttttttcaaagctaatgtctgccacaaatgggagttttaataggttataattcatatgacttagtgttaaacctctacgttggkattcttaaatttaacatggataaactgaacttgatttcctgcattaaaaaaaattaaagaaatgaaagttctgactgttttattgtagctggggaattct

SEQ ID NO: 59910 - DNA, 201 bp, Homo sapiens
gttgtaaaagaatacaagtaagtagtcaagtgacaccttagcattctgatgaaaagagctttgacctcacagagcttctggaagggtctcagagacatccstgagggtcccttgactgcactttgacaaccacaggtctacatgatctgtatagccttttccagttttcacatcctatgattccaagagggaaaacaatct

SEQ ID NO: 59911 - DNA, 201 bp, Homo sapiens
ccacacccggcctcttctcgatagatcttatttggctgacaacgaaagctgttgtgctggtagcatcatccctttgcatgcaaaagataaactgaaatctraagtagccatatccttccggccaggtttttcaagtggttactctgttctgatcattgtcatgacaggaatagtgaaaataacaataaatcatttttcttt

SEQ ID NO: 59912 - DNA, 201 bp, Homo sapiens
gctcctacaccatgagtgcttttgtatggtgactgtctggttacaaggtcatcttttcccctggatgagacgccccttggggaaaggaccaagttttattycctgtttaaccttggcctgacaacctaataggtgctcagtgaacagttcttgaatttaattctctccctttccccacactgatgtgtatttaagctccag

SEQ ID NO: 59913 - DNA, 201 bp, Homo sapiens
ttttggaggacttgaaaggttcctgctacctttggctggggatggagggaacatggaagatgggtctttgtttagaggaagctctttatcctggtacgctrgaagttggcatagtcttagcagttagtccagatgtgaatttcaggattattctgtgagtcttccaagtcctgtctcagcagtgaaataggctcagtgtag

SEQ ID NO: 59914 - DNA, 201 bp, Homo sapiens
tggttcagggtgttgaggcttcgtgctgttaatattggaaggtgggtcatttgtactgggcatctgtcctgtatcttggagatgtttagtaacatccctgrcctctagccattagataccatctctcccagtagggataataaaaacatgtctccagatgttggcaaatgtctggccttctggggagtaaaatggcccctg

SEQ ID NO: 59915 - DNA, 201 bp, Homo sapiens
gatagtaggtaaattaatggaggaagggagtcaactaaacaatttatttgagcaattaatggaggaagggagtcaactaaacaatttattagggctttatktaaagccctagggttagttggttggttggttttgttttgttttgttcctttttttttttgccaggggatgctgtggttgaatttccctctgtggtgagag

SEQ ID NO: 59916 - DNA, 201 bp, Homo sapiens
gtttatgccactgcaacattttagaatcacctgggaagcttttgaaaactcccagcatcatgaagcatggtctcttgccttggggtcagtgtctgtcaacrtggcttttgctaaagagccttcccctatgagaagtgaggcaggagaaggcggagtgaccacaagatgccctgatggtgccaagctattattataaatgaa

SEQ ID NO: 59917 - DNA, 201 bp, Homo sapiens
agtttatgccactgcaacattttagaatcacctgggaagcttttgaaaactcccagcatcatgaagcatggtctcttgccttggggtcagtgtctgtcaaygtggcttttgctaaagagccttcccctatgagaagtgaggcaggagaaggcggagtgaccacaagatgccctgatggtgccaagctattattataaatga

SEQ ID NO: 59918 - DNA, 201 bp, Homo sapiens
tcttctttatattataagtttatgccactgcaacattttagaatcacctgggaagcttttgaaaactcccagcatcatgaagcatggtctcttgccttggrgtcagtgtctgtcaacgtggcttttgctaaagagccttcccctatgagaagtgaggcaggagaaggcggagtgaccacaagatgccctgatggtgccaag

SEQ ID NO: 59919 - DNA, 201 bp, Homo sapiens
gtatagtgatgggtctctcatggctcacgtattaactgtatttgttgttactgcttctcaggcactctgttaagaatgcagggctcttcctcagactcagsgcggggcctgggctttacagcaatggttttcagtttgtaatctctctcaaggaagggagaggagcacaaagctgccttgactgccagcaccatcagaaaa

SEQ ID NO: 59920 - DNA, 201 bp, Homo sapiens
acaaaaggccaaccccattagacagtggccaagggaggtgaactaaagttggtgctgtgaacagggctaatggtttgtgatttacccataagtggaaggtrtactccggctgctcctttaatattttatgattagcagtagaggtgtgtctgggggaaagagtcagcttattttatttatttattaattttttgagatgga

SEQ ID NO: 59921 - DNA, 201 bp, Homo sapiens
tccagaatcattggccctggctctactcctggaaacccagtccatctctaatccctttgatttccaatgggaggcaaatccaggggagttctagactgtckagaatattgtaccaagaacaaaaggccaaccccattagacagtggccaagggaggtgaactaaagttggtgctgtgaacagggctaatggtttgtgattt

SEQ ID NO: 59922 - DNA, 201 bp, Homo sapiens
cctggcttggtgtgttttgtggcatttggcaggcaaacgttttgaaaagaaatctcctttcaaaaatcacagcactggttgaagcaggagcatctctcccyttaaatgcaaaaggagttaatatgccagtgactacagtgtgcctggaaaggtcactggaggcatttttgtctggggcagcccctggagtcttggcttttg

SEQ ID NO: 59923 - DNA, 201 bp, Homo sapiens
agcccctgggcattatttccccaattccgtatcccatctactaatacaaactaatgagatctattaaggatgagtccacaagtttgaagggagtctcttaytaatgttccgtctttgcatggtgttacaacagcgggaccattttacactgagggtttgcgagaggcatggctcccctgttatgtatttgggacttactgc

SEQ ID NO: 59924 - DNA, 201 bp, Homo sapiens
ttttttcccttttctttttttttctccccatcttgaacatgttgctgtagacaggtgctaggtttccctgaatgactaaagcagagatttggttattttcytcccagaaaaagtagatgcatcagcagagttgagcccctgggcattatttccccaattccgtatcccatctactaatacaaactaatgagatctattaag

SEQ ID NO: 59925 - DNA, 201 bp, Homo sapiens
actaggggaaacaaaccctgttttgtagtatttgctgattactgtggtgtaaatactcacaccttggctgatttcaagttgcagcttggaacttggagttrgaaagagatgtgtagtcccataccattttatgtatgtaaagtatttgcactatgccgactaatagacataaataacctcatgagcatagataatagtcac

SEQ ID NO: 59926 - DNA, 201 bp, Homo sapiens
aatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtga

SEQ ID NO: 59927 - DNA, 201 bp, Homo sapiens
gtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgttta

SEQ ID NO: 59928 - DNA, 201 bp, Homo sapiens
tggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgt

SEQ ID NO: 59929 - DNA, 201 bp, Homo sapiens
cctgccgtgctcaaagcacttgcttacttggaatgccataaattacatgaaggaattattcattgtatcacgaaacataccttccagtctcccgagtagtstattaggctaagtatggtcttttaaattattactttaaaaataaaagataatggaattatagcattaaatacattttgcaaatgatcttctagtaggatt

SEQ ID NO: 59930 - DNA, 201 bp, Homo sapiens
ctgttaggacattgtaattattttgtattacttaggaaaacttttatgattctactcttttaatttttttaataattactttatgacttcttcattagggwttctctcctccagtgcgtacgcagatcttctgaaaaggaatctgacaaatttagttgctgcatttttctaaattgctttcaagactacccagcacttcag

SEQ ID NO: 59931 - DNA, 201 bp, Homo sapiens
tacctctggaggccccaggctgggactttgggtacagatgcacaggagacctttgccccaccccgtcacggctgggcctactcagttccacgtctttgagktttcacgcggaaactggatgtttcttacatcctcagctgcaggcatggggaagagacgcacatcagccattaagaaaaaggtatgcagtctacatgcctc

SEQ ID NO: 59932 - DNA, 201 bp, Homo sapiens
ttgaaggaaagttttggctacccagttgttagctgctgaagtttaactgtgcattctaagcacaccagtattttattacatcatacctgggcagcagatarttttagtaaaaccttgaaaagatatgactattgggaagaaatttgggattctatcctttttctctccattcttctctcctgcaccaagtttctaagctcg

SEQ ID NO: 59933 - DNA, 201 bp, Homo sapiens
tacctttgtctcagtcaatatttacctctgaggtcaatacgtgtggatattcacctcagctgcagtcaatatccatttcgtattacaatatatgatgtgcrtatgtgaaaataaagaacagcatggtacaaaaaaggtctgctaggcaaagaagctttttgcaaagcggatgtgtttttgttttattttttgtttgtttgt

SEQ ID NO: 59934 - DNA, 201 bp, Homo sapiens
ccactgaccactctctgtacagatgcgctcaagcgaccataaccaccagtgttcctaacaatgcgcctattgacttcttatttcaatagatatccagattkattatccctcaaggtaagcatcgattttacctttgtctcagtcaatatttacctctgaggtcaatacgtgtggatattcacctcagctgcagtcaatatc

SEQ ID NO: 59935 - DNA, 201 bp, Homo sapiens
cctgattgagtaactgctctctgaaggtggaggctggactgcttcactggacagggtggcctggggttattctagtgcagtggtagctggtgacaaaactsaaagaagatgtaactagagaaaaggtactcagtgcagcctctgtgagctaccaccactgcctctagttttccagaaaaccaccactgaccactctctgta

SEQ ID NO: 59936 - DNA, 201 bp, Homo sapiens
ggcttcatatattattgagagcaaacctactttccaccgccactcctggatgcacttattttgcgagccttattcagaatgtcagcatggatcacttggcracaaaggcctaaagggcaagccaggaagcttccatggatacgttatttatggtgtttaattattattgtacagatttattaaatgactctgttacctagg

SEQ ID NO: 59937 - DNA, 201 bp, Homo sapiens
tgaaactacatgttcattgaaaatgatcttttgggtggttgatgttcgattttggctctgtgttgggcctgcccagtgaggtccttttgactccctaaggraccctgttttgggtttcttttgaggttgaagatatttcagactctttccccctcaacttccataggaaccaaactctctttcttcctcccgtttggttgg

SEQ ID NO: 59938 - DNA, 201 bp, Homo sapiens
cccggactcgaatcccagctctgatccatctcagctctgccatattgccaagttccgctgagactccatttactcacctgttgtatcatctgaattatttycatatccataatgtgcaaggatatccttccatgttattagaaatacagatacaccatcattatcagtggccaaatcattcaaatcgctgtttgcttcttc

SEQ ID NO: 59939 - DNA, 201 bp, Homo sapiens
ataaagtttatttttacagtaattttaagttcacagcaaaactgagtgggaagtgtagagtttcatatactccctgtcctcacacatgcacagcctcctcyagctatgcacattttcaatgaaactacatgttcattgaaaatgatcttttgggtggttgatgttcgattttggctctgtgttgggcctgcccagtgaggt

SEQ ID NO: 59940 - DNA, 201 bp, Homo sapiens
tggaggttgcagtgagccgagatcaggccactgcactccaatctgggtgacagagcaagactctgtctcaaaaataatagtaataataataataataatartaataataataataataataagaatctgactaaggttattaaccattaaggtatgctgtgctaaggagcagggggccccttccatccgtagagggcagaa

SEQ ID NO: 59941 - DNA, 201 bp, Homo sapiens
ggaagaatgaggatttggggaaggaaaattttgagagccattttacagcatttcaagattcagtgatctcagaacctcttttggttaaacaagcatgggargatggatgattggatggatggatgaatggataggtaggtgggaagataaatggatagacatataggtaggaaggaatgagggatatatggaaggctagca

SEQ ID NO: 59942 - DNA, 201 bp, Homo sapiens
tctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtc

SEQ ID NO: 59943 - DNA, 201 bp, Homo sapiens
acaaaaagcagctttcgtttgcttaaaatttttgttctctgcctttatttttcaaaaatattttcactaggtatagaattctaagatgaaagttttatttkttttcagctgtggcttccatcattttcctgagaggtataactatcagtcttgtagctactggtctctaactacttctaaaactatctgcagtttttagca

SEQ ID NO: 59944 - DNA, 201 bp, Homo sapiens
ctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttattttttttcagctgtggcttccatcattttcctgagaggtataactatcagtcttgtag

SEQ ID NO: 59945 - DNA, 201 bp, Homo sapiens
ttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatccttta

SEQ ID NO: 59946 - DNA, 201 bp, Homo sapiens
atgacacaggagacagggaaagagttttgttatcctgatacacacattcttaaatgcctctagctgtgtagacattggtttgtccatattaatagtatttyacgaagtgccagttgtgtgcctgctttgtggcatatgcattggcattcattgctttatttaattcttccaacaacgtgtcagatgtctgttcaaattatt

SEQ ID NO: 59947 - DNA, 201 bp, Homo sapiens
ctcccattttacaccctgtttattgatactaagaagagcctccaactgaataagaactaatgacttctgcctgccatcattttggaatgtccaattccccrttctggagagcctttgattataacatcagcctgtcatttggacctctgacctgaattatatgaatctgaaaaatctcttcctttcctatcgtgaattcgg

SEQ ID NO: 59948 - DNA, 201 bp, Homo sapiens
ttgctgaatactgagtaaataaagaaaagttaacacagtggagtccaggtacagtggctcatgcctgtaatcccagcactttgggaggtcaaggcaggagratcacgtgagcccagcagttcaagaccagccttggcaacatggtgagaccccatctctacaaaaaataaaataattagctgggcatggtggtacatgcct

SEQ ID NO: 59949 - DNA, 201 bp, Homo sapiens
ggctgggacaacatgcccactctcaactaatttttgtagccatggagatttggaagtctggcaagtcttgggtcacatgatctaccttacagctgttactrcagacctcccaaagctcacgaactgagagtcaggaggcgtggttcccctaactcaaatcagaatttcgttatcaaaagaagagagggatggttctgtggt

SEQ ID NO: 59950 - DNA, 201 bp, Homo sapiens
gatggagtctccctctgtcgcctaggctgcagtgcagtggcgcgatctcagctcactgcaacctccgcctcccgggttcacaccattttcctgcctcagcstcccaagtagctgggagtacaggcgactgccaccacgcccggctaatttttttttttttttttttggtatttttaatagagacggggtttcaccatgtta

SEQ ID NO: 59951 - DNA, 201 bp, Homo sapiens
gaaaaggaacaacaaaaaagtatatctgtgaacttattaaatgactttaatcatatgaaaatcagccatcagccttattagagtggttgattttttttttratctaagagctttcttggttattttctgttcttaatcattgttgtatatccttaatgcgcaggacatgacaccgtataacaagtgttttaaaaatattta

SEQ ID NO: 59952 - DNA, 201 bp, Homo sapiens
ccagaatgagtgtgttttctagctgtcactgcctgatgtttactgctcaaagcttaggacttggattagagcccaggacttggcagccaagataaaccagstgcaattacgctgaacatctcagcccagctcctgtccatccctgaacaggacacttagggtagaggatgttctcagcagtgccatttgcatcccccttca

SEQ ID NO: 59953 - DNA, 201 bp, Homo sapiens
ctaaagtcagttacataaccaagcccagcttcagaagggaaattgtatgccttacaaggaggtgagaggatggaaaatgaatatttgctgaacagactttytgtccagtttgttgtatttggtggtggtgcagggcaaatatatgtttaaaaccttgttcagatttttagctttcttcagaacagagcttttaaaactgag

SEQ ID NO: 59954 - DNA, 201 bp, Homo sapiens
atcatacccattcccaagatttcagtcatcaaatccattccaatatgactcctgtatccatatgtccagttccaagtatctgtccatggtgttggtcccakgttattcgcacctcatatgtctttggcacagcactcttgacagctcataaagtcacgctgttacccccacaatgtccccccacatatcattgctatccct

SEQ ID NO: 59955 - DNA, 201 bp, Homo sapiens
cgatgagattggaggcacctgggtgtcagcctcttgggctggctcattacaggccactctgtctgaggaacactcaggtttgcaaaccgtttcttaaaatwacaggatacctagggacctgttggggtgggagggaagaaccctatgggcagaaatgtgactttctgtagcaaagatgtactgtttcccactgagaagaat

SEQ ID NO: 59956 - DNA, 201 bp, Homo sapiens
tacaggattttacatggcttagagaaatactgtggtggtgaaaatatgcataaaaaagcgagagattttacttttgaaatgctgccaaagtgaaatctctyttggataggcagatgacagtttagtacttgcaggtctttcgattctgacaactgtcagaagtgaatttaagtgctggtgactaggctgccagagaaacac

SEQ ID NO: 59957 - DNA, 201 bp, Homo sapiens
gtctttggcacagcactcttgacagctcataaagtcacgctgttacccccacaatgtccccccacatatcattgctatccctcctcgacacccacacctcytgcatgttcctgagcttcttaggcgtgttgcatcttcctgaccttcccagtccgaagcccaaggagatacttgataaatattcgtctaataaataaatga

SEQ ID NO: 59958 - DNA, 201 bp, Homo sapiens
aaactggctgactgagttaaatgaatgccaaagtcacagagctgctgagtggcagagttgtaattcccatgcagaactgtgtggcatcaaagccatttttwaactcattgcaatgcacagtgggttaaaatgagatgattgaaaatgagatgtggctgggcatggtggctcacacctctaattccagcactttgagaggat

SEQ ID NO: 59959 - DNA, 201 bp, Homo sapiens
tgaactttctgtcaccggtataatttaaagaaattatacttaagctttgtctcacttagaagataatatagaacagtggtgtttttttaattaaaaaaaargttaaaataacggttttgtatccttgctttacttcttaaacatatgggaggaaaaaaaatctttaacaagtttatttattttcattttctgctaaattac

SEQ ID NO: 59960 - DNA, 201 bp, Homo sapiens
gttacatcaaggctgggaggaggtctttccactggttttccgggctgtttgtgtactacacagcctgtgtacctggcaaggcacgctctgctctgccctgmcttctgatgagctgactaacaccttatagatgaggttcccttagaaccaaagatgccccatgaaactccctaggatgaatgttggaagtccttccaactg

SEQ ID NO: 59961 - DNA, 201 bp, Homo sapiens
ctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttctttt

SEQ ID NO: 59962 - DNA, 201 bp, Homo sapiens
gcaatgggaacagagctgaggctcctaaggtctagagtcaacatgaaaatacctttgcttctgggccatagctgtgtttcttcttaacaaggcagaagccyagaagagacttcatgtactgtgactgtaataaagagggttgtaagtagagaagctggaatttgaaaggttacgtacaagtcaagctgcctctgtaatgtc

SEQ ID NO: 59963 - DNA, 201 bp, Homo sapiens
ttattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcat

SEQ ID NO: 59964 - DNA, 201 bp, Homo sapiens
tgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagtt

SEQ ID NO: 59965 - DNA, 201 bp, Homo sapiens
cttagggttcataggatctgtagtccttttctttatttttcatttttaaaaacaactttattgaggtatgattgacgtacaaaaagcctcacgtatttgaygtatagaacttgataagtttggagataagtatatacctgtgaaaccattatattttataagtacatgatacaatatgagcacagtactatatggtagatc

SEQ ID NO: 59966 - DNA, 201 bp, Homo sapiens
cttaagatcttcttagggttcataggatctgtagtccttttctttatttttcatttttaaaaacaactttattgaggtatgattgacgtacaaaaagcctyacgtatttgacgtatagaacttgataagtttggagataagtatatacctgtgaaaccattatattttataagtacatgatacaatatgagcacagtacta

SEQ ID NO: 59967 - DNA, 201 bp, Homo sapiens
gttgttcaccatatcttaagatcttcttagggttcataggatctgtagtccttttctttatttttcatttttaaaaacaactttattgaggtatgattgaygtacaaaaagcctcacgtatttgacgtatagaacttgataagtttggagataagtatatacctgtgaaaccattatattttataagtacatgatacaata

SEQ ID NO: 59968 - DNA, 201 bp, Homo sapiens
gtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctattta

SEQ ID NO: 59969 - DNA, 201 bp, Homo sapiens
aacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtcc

SEQ ID NO: 59970 - DNA, 201 bp, Homo sapiens
tgtcagatgtgccctttctggtaataaaaagtcctttgccgtgggttattttgtcaagtgagatagcaggacttaacaggtttgtttgggaaaataaaatytgatagaaaaacggcatgcttttcccccacagatttcttggtagcatcattcaaaactacagtgagcagtatctttgcaggattttaatatttattcatt

SEQ ID NO: 59971 - DNA, 201 bp, Homo sapiens
aagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcc

SEQ ID NO: 59972 - DNA, 201 bp, Homo sapiens
ctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaa

SEQ ID NO: 59973 - DNA, 201 bp, Homo sapiens
gtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaa

SEQ ID NO: 59974 - DNA, 201 bp, Homo sapiens
agccctatgcctttgggaaggagaggaaggactaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctg

SEQ ID NO: 59975 - DNA, 201 bp, Homo sapiens
cttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaa

SEQ ID NO: 59976 - DNA, 201 bp, Homo sapiens
gcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcaaaccaaagagcacaccg

SEQ ID NO: 59977 - DNA, 201 bp, Homo sapiens
tgtcaccggtataatttaaagaaattatacttaagctttgtctcacttagaagataatatagaacagtggtgtttttttaattaaaaaaaaagttaaaatracggttttgtatccttgctttacttcttaaacatatgggaggaaaaaaaatctttaacaagtttatttattttcattttctgctaaattactttcagaac

SEQ ID NO: 59978 - DNA, 201 bp, Homo sapiens
tatgactatttcatgagtgcttactatataccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgctt

SEQ ID NO: 59979 - DNA, 201 bp, Homo sapiens
aatttgtaggagctgctcttaatgattattactgcataggctggaatagaagcaaaatttgcagtaatacttttgtacctttctctttaggccttggcatrtattaaagtactatacatttgtcttaaaaattgaaattgtagattattttcatctaagacccttttgttcacagatttttttttccaagtatacctattc

SEQ ID NO: 59980 - DNA, 201 bp, Homo sapiens
aagaccaacgtgtaaattacatattaatctttctttttctccctagctcggttttaagaataatgttttagccaacatatctgcattactcttggctcaayatgagaaatccatttttggtttgcctaacagaagatcatgttgctttgcttctctacacagtatgaaaacccaaagaaaagaaaaacagaggcagttttt

SEQ ID NO: 59981 - DNA, 201 bp, Homo sapiens
ttgtggtcaacagtggggcttagggggcaggttttgtggctgtgacagaacacgtggcccctagtgtgtctgttgaaagatgggcccctttcaggaaaatkgcttaccttactttttagacataatttttgttttctgttaaagggtcagttatagataagtatgctcccttgcaatgaaatgaacccactttatcaattt

SEQ ID NO: 59982 - DNA, 201 bp, Homo sapiens
atgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatactt

SEQ ID NO: 59983 - DNA, 201 bp, Homo sapiens
aggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatt

SEQ ID NO: 59984 - DNA, 201 bp, Homo sapiens
ctgtttgaagcactgtattgagcataccatatgctgaaagacttggaatgcaaaaacctaaggccaagggcacttctcaatattaaaccctcagttgtaakggaggcatcaagactataagatccaagaccttaacttttgtgctccttgtcttgtggagggaacatccatcctcaaaacagaaacctgtgagatcccttg

SEQ ID NO: 59985 - DNA, 201 bp, Homo sapiens
gaagagattctcgtccgctcagttaaggtactcagactattttccaaccaatcaagagggtgctgcttcatggagttcgtttaagctgaagcggcagctgktgactgtcatttgcatcatctttatacatttactgtgaatgtcactgtccatttccactttctttctacttgtcttcaaattgatgcttatcaagtagac

SEQ ID NO: 59986 - DNA, 201 bp, Homo sapiens
tggccaaattctgtttgaagcactgtattgagcataccatatgctgaaagacttggaatgcaaaaacctaaggccaagggcacttctcaatattaaacccycagttgtaatggaggcatcaagactataagatccaagaccttaacttttgtgctccttgtcttgtggagggaacatccatcctcaaaacagaaacctgtg

SEQ ID NO: 59987 - DNA, 201 bp, Homo sapiens
tcaagtgatcctcctgccttgagctcccgaagcgctgggaccaatagagatttctctgagaattaggtcccccactattaataaggtcattgtcagctgarttggggaggtggcgtgggtagatacaattaatttagattttttaaaaggcttttgagaatattcggagaacctaatatattttgagacctgacatttatt

SEQ ID NO: 59988 - DNA, 201 bp, Homo sapiens
ggagatgttctttgagattcggtgattgagttgtgaacatatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaa

SEQ ID NO: 59989 - DNA, 201 bp, Homo sapiens
agtctcacacttgacatagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctggataatgtgcactgagcatcaagtgcctgcagtggcctg

SEQ ID NO: 59990 - DNA, 201 bp, Homo sapiens
tgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacatatggactgagggtgt

SEQ ID NO: 59991 - DNA, 201 bp, Homo sapiens
aaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccagcctaccagtgagtctcatggtgtgcggctgcctgctcc

SEQ ID NO: 59992 - DNA, 201 bp, Homo sapiens
ttaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtcccca

SEQ ID NO: 59993 - DNA, 201 bp, Homo sapiens
tattgatctagactgcctgctactttcatttaccatgttactgctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaa

SEQ ID NO: 59994 - DNA, 201 bp, Homo sapiens
ctactaaaaatacaaaaaattagccgggtgtggtggcgggcgcctgtagtcccagctactcgggaggctgaggcaggagagtggcgtgaacccgggaggcrgagcttgaagtgagccgagatcgcgccactgcactccagcctgggcgacagagcgagactccgtctcaagagaaaaaaaaaaaaaattataacatggaaa

SEQ ID NO: 59995 - DNA, 201 bp, Homo sapiens
tgcctaccaccatgtttctgaggcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcctaaggttttattaatat

SEQ ID NO: 59996 - DNA, 201 bp, Homo sapiens
tttaggagctctgtgccaggaacctggatgaagacccagtatgtatttcttattatatcacaatatcacaaatccacagtcacatggtgattgtggtagtktggggggcctgatggtggggtacacctgcttgaagtcaggctaccatgcccattggggtcctcccccttttttgccctctgatcttgtgagttccttaac

SEQ ID NO: 59997 - DNA, 201 bp, Homo sapiens
accccatgcctggccaatttcaaggattttaggagctctgtgccaggaacctggatgaagacccagtatgtatttcttattatatcacaatatcacaaatscacagtcacatggtgattgtggtagtgtggggggcctgatggtggggtacacctgcttgaagtcaggctaccatgcccattggggtcctccccctttttt

SEQ ID NO: 59998 - DNA, 201 bp, Homo sapiens
tcagcttcccaatgtgctaggattacaggcatgagaccccatgcctggccaatttcaaggattttaggagctctgtgccaggaacctggatgaagacccartatgtatttcttattatatcacaatatcacaaatccacagtcacatggtgattgtggtagtgtggggggcctgatggtggggtacacctgcttgaagtca

SEQ ID NO: 59999 - DNA, 201 bp, Homo sapiens
gtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtccatccatccatccatcctgcctccctcc

SEQ ID NO: 60000 - DNA, 201 bp, Homo sapiens
cccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactc

SEQ ID NO: 60001 - DNA, 201 bp, Homo sapiens
gggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacatta

SEQ ID NO: 60002 - DNA, 201 bp, Homo sapiens
ctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtat

SEQ ID NO: 60003 - DNA, 201 bp, Homo sapiens
ctttgagggtcctcaaaatagaaggtcagagagtagacttttaaaagtcttgcactgtttacaagtcagatgctttttggcagagtgactctcagctcccyccaacaatcccttcttgtcgttcagtagtagatagactctatcagggaaaaataggagaaataaaataagacagcatatggaaggcattgctgaaagtct

SEQ ID NO: 60004 - DNA, 201 bp, Homo sapiens
cctctgcagttatttttcatgcacactcggattacactgctcggtgatattacatctgcatgcgtcttgccctctgacacggcaaacacagatgctgcccraatccttgtaaagccatatatcttaagtaggaaggagcatctttgcaggggaggtgaattgatttgcaaagcagcctgacacatggtctcttatttctcc

SEQ ID NO: 60005 - DNA, 201 bp, Homo sapiens
aaattttcatagacatccaccccctcactgccacaccccctcatagatttcttcttttcctcctccttctcctcctccctcttcctcctctttttcccccmccttcaaatagttccaagaccagagttgagggtgggtgggtagagggctagtttacagataaaatggttggtgtagatcatctagtttggaaaaagcaca

SEQ ID NO: 60006 - DNA, 201 bp, Homo sapiens
tacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatg

SEQ ID NO: 60007 - DNA, 201 bp, Homo sapiens
tagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatc

SEQ ID NO: 60008 - DNA, 201 bp, Homo sapiens
atttgaaaaaaaaaaaaagtcaccaagttgtttccaattgtttttgtaaatttgcttagtcattttcagagacaaaaatttgggaaaaggattgtagaatsactggcttcccaaaaccacttggtgtttacaaagttatcaaaaacgggctgggaccactgatggtaataacaaaacctggggccctgaatcgtgtattct

SEQ ID NO: 60009 - DNA, 201 bp, Homo sapiens
gggaattcctggggtaaagtatcacttttctggggctgggctaggcataggtctctttgctttctggtggtggcctgtttgaaagtaaaaacctggttggygtgtaggttccgtatctccctggagaagcaccagcaattctctttcttttactgttatagaatagcctgaggtcccctcgtcccatccagctaccaccac

SEQ ID NO: 60010 - DNA, 201 bp, Homo sapiens
catgtagattgtacatcgtttgtcgataaatcagtgtacaaatactaggggtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccac

SEQ ID NO: 60011 - DNA, 201 bp, Homo sapiens
agtgtgctgaatcatgttttaaacataattatatccggaatgcacttacccatttgaaaaaaaaaaaaagtcaccaagttgtttccaattgtttttgtaartttgcttagtcattttcagagacaaaaatttgggaaaaggattgtagaatgactggcttcccaaaaccacttggtgtttacaaagttatcaaaaacgggc

SEQ ID NO: 60012 - DNA, 201 bp, Homo sapiens
taccaccacgcctggctaattttttgtatttttagtagagacgggatttcaccatgttggccatattggtcttgaactcctgacctcaagtgatcctcccrcctcagctgcccagggtgctgggatcacaggcgtgagccaccgtgcgcgacctcagggtcccttctaacctgtgctgttgtcataaaccctggaggagaa

SEQ ID NO: 60013 - DNA, 201 bp, Homo sapiens
aggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttg

SEQ ID NO: 60014 - DNA, 201 bp, Homo sapiens
aagcagggaattcctggggtaaagtatcacttttctggggctgggctaggcataggtctctttgctttctggtggtggcctgtttgaaagtaaaaacctgsttggcgtgtaggttccgtatctccctggagaagcaccagcaattctctttcttttactgttatagaatagcctgaggtcccctcgtcccatccagctacc

SEQ ID NO: 60015 - DNA, 201 bp, Homo sapiens
aagtgtgctgaatcatgttttaaacataattatatccggaatgcacttacccatttgaaaaaaaaaaaaagtcaccaagttgtttccaattgtttttgtaratttgcttagtcattttcagagacaaaaatttgggaaaaggattgtagaatgactggcttcccaaaaccacttggtgtttacaaagttatcaaaaacggg

SEQ ID NO: 60016 - DNA, 201 bp, Homo sapiens
cctacccaaggtctggtcattgctatacttgagttcttttcaggctcaagatctctacctttttgtgttttttttttttttgtacagagtcttgctctgtygtccaggctgtagtgcagtggaacaatctctgtatgctccctgcaacctctggctccaggtttaagtgattctcctgcctcagcctcccaagtagctgga

SEQ ID NO: 60017 - DNA, 201 bp, Homo sapiens
ctgtcaaacaacacagtccccatctgtactttgggagggaaggacttcttaattccagctgcctgttgccatgggggaacatagacccagaactgccatcytttctaatttttttaaaaattaaaaggctaaaagttttggcttataaaaatggtatttcctgagtttttacaattatagtattaagatattcctaggttt

SEQ ID NO: 60018 - DNA, 201 bp, Homo sapiens
gtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggata

SEQ ID NO: 60019 - DNA, 201 bp, Homo sapiens
cccacctcagcctgagtagatgggactacaggcatgtgtcaccatgccaggctaatgtttaaaaatttttcttagaggtagagcctcactttgctgcctargctgatctagaactcctggcttcaagtgatcctcctgccttgagctcccgaagcgctgggaccaatagagatttctctgagaattaggtcccccactatt

SEQ ID NO: 60020 - DNA, 201 bp, Homo sapiens
tgctgggaatgcgttcattttctttatcttgccattactgtacctctattgggaaatttactctctcttcatagataggatccgattcagtacatatttakaaaaccacacttacatttaaatacaggcctttcccatttcacagtgtttctagctcccctttccaatacatctctctctctctttctctctctctctctc

SEQ ID NO: 60021 - DNA, 201 bp, Homo sapiens
gttttcgagacgaagtttcgctctcatttcccaggatggagtgcagtggtgcaatctcctccgcctcccagtttaagccattctcctgcctcagcctcctragtagctgggattacaggcgcccgccaccatgcccggctaattttttgtattttttagtacagacggggtttcagcatgttggccaggctggtctcaaac

SEQ ID NO: 60022 - DNA, 201 bp, Homo sapiens
accaactccattgttactagatatcctgacactgaagaagctaaaaccaaacaacaatgacaacaacaaacccaagtctgccttatggcacattcttcacrtcgtaacaccttccttgggaccctatttctcagtatggacctgactctcccagggatcctagaatgcaagcatagtgattgcaaaccagaccatttgagg

SEQ ID NO: 60023 - DNA, 201 bp, Homo sapiens
tggtggggaaggatgttgcggtggggttggggtggcaatgaaaggtgaaaaccactgtggtcccacctgcccatcgtcagatttcggttcctctcagagtyaacgtagaaggtttctgggggcatggacctgagtcttatcccctttgcaaaagtaagaattgtatcgtagcctgactcagggttttagccaacttctctg

SEQ ID NO: 60024 - DNA, 201 bp, Homo sapiens
caatggacggagaactaccatcccatttgggccaacctcttttttttttttctttttgtttcgagatggagtctcgctctgtcaccaggctggagtgcagyggtgcaatctcagctcactgcaacctctgcctcccgagttcaagctattcttctgtctcagcctcctgagtagctgtgattacaggtgcgtgacaccaca

SEQ ID NO: 60025 - DNA, 201 bp, Homo sapiens
cgcccagagtcgtatcacttgactgcatttgaccattcagttttcagaccaactccattgttactagatatcctgacactgaagaagctaaaaccaaacarcaatgacaacaacaaacccaagtctgccttatggcacattcttcacgtcgtaacaccttccttgggaccctatttctcagtatggacctgactctcccag

SEQ ID NO: 60026 - DNA, 201 bp, Homo sapiens
aggatcgcttgcatccaggaggttgaggctgcagtgagccatgactgtggcactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgt

SEQ ID NO: 60027 - DNA, 201 bp, Homo sapiens
aggaataataattcagtgaaaggaaatttggatgacatgaactcatttccattagacttgagccacacaaatcaatgggaaaagaaacagctgaatccagsataatatctggctatttggagtgggcatgataatggagggagattggggaggtaacaaaccagctactattaagttcaagtcatgtcagttattcaaatt

SEQ ID NO: 60028 - DNA, 201 bp, Homo sapiens
tagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaaagcagtatagtcagtaagaaagaaaacaaactaacagtcaatattgtgg

SEQ ID NO: 60029 - DNA, 201 bp, Homo sapiens
cagggttattaggaataataattcagtgaaaggaaatttggatgacatgaactcatttccattagacttgagccacacaaatcaatgggaaaagaaacagytgaatccaggataatatctggctatttggagtgggcatgataatggagggagattggggaggtaacaaaccagctactattaagttcaagtcatgtcagt

SEQ ID NO: 60030 - DNA, 201 bp, Homo sapiens
ctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggatttta

SEQ ID NO: 60031 - DNA, 201 bp, Homo sapiens
ggggttgtacttggaatgactggcctagaaaaccctacaggtaccatttaagctccatagttcttctgtgtgtgtttcggatcccaggttccaaacctgctctaaaacttgttgctgcatctcacctaatcgtgtagtgagccaggtgagctcatctgtgaaatgcagacctttctggacgtaccacctcgtggggtgaag

SEQ ID NO: 60032 - DNA, 201 bp, Homo sapiens
agagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcg

SEQ ID NO: 60033 - DNA, 201 bp, Homo sapiens
ttctcctgcctcaaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcag

SEQ ID NO: 60034 - DNA, 201 bp, Homo sapiens
tttttttgaggtggaatctcctctgtctcccaggctggaatgcagtggcattttctcggctcactgcagcctccgcctcccaagttcaagccattctccartctcagcctcctcagtggctgggattacaggcatgtgctactacccccggcaaacttttatatttttagtagagacagagttttgccatgttcaccaggc

SEQ ID NO: 60035 - DNA, 201 bp, Homo sapiens
agaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacaaatgtgtggagt

SEQ ID NO: 60036 - DNA, 201 bp, Homo sapiens
ctcctctgtctcccaggctggaatgcagtggcattttctcggctcactgcagcctccgcctcccaagttcaagccattctccagtctcagcctcctcagtrgctgggattacaggcatgtgctactacccccggcaaacttttatatttttagtagagacagagttttgccatgttcaccaggctggacatgaacttctga

SEQ ID NO: 60037 - DNA, 201 bp, Homo sapiens
tatttggaccacttctccctctttccggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggt

SEQ ID NO: 60038 - DNA, 201 bp, Homo sapiens
tggcattttctcggctcactgcagcctccgcctcccaagttcaagccattctccagtctcagcctcctcagtggctgggattacaggcatgtgctactacmcccggcaaacttttatatttttagtagagacagagttttgccatgttcaccaggctggacatgaacttctgacctcaagggatccacctaccttggcctc

SEQ ID NO: 60039 - DNA, 201 bp, Homo sapiens
gaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcgtaatatccacagagaatagatggca

SEQ ID NO: 60040 - DNA, 201 bp, Homo sapiens
ttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaa

SEQ ID NO: 60041 - DNA, 201 bp, Homo sapiens
cgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattaga

SEQ ID NO: 60042 - DNA, 201 bp, Homo sapiens
ctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaac

SEQ ID NO: 60043 - DNA, 201 bp, Homo sapiens
agagccaaggtcaatctgaatttttctttttctttcttcctttttttttttttttttttttttaaaaaaaaaaaggtgcttgaattagaaaggtagcacaytgtccacatggacagtgcaggatggggctggctttttcatttctgagagctggcaatggaatgaaggtcttttttttttttcttaatttttcttttttaa

SEQ ID NO: 60044 - DNA, 201 bp, Homo sapiens
aaagtaatataccacttttcgcttttttaatggtgagagccaaggtcaatctgaatttttctttttctttcttcctttttttttttttttttttttttaawaaaaaaaaggtgcttgaattagaaaggtagcacattgtccacatggacagtgcaggatggggctggctttttcatttctgagagctggcaatggaatgaa

SEQ ID NO: 60045 - DNA, 201 bp, Homo sapiens
ttatctcaacccatttaaatgtcttttccttgcaatgttttgtaatattacatgtagattgtacatcgtttgtcgataaatcagtgtacaaatactagggrtgagtgtgctcaaaacttatttttactgataatagtccatgatcaaggcagtttggagaccactcaggacagggaaaacgcagactcatgtgacccatca

SEQ ID NO: 60046 - DNA, 201 bp, Homo sapiens
ttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactaggggtgagtgtgctcaaaacttattttt

SEQ ID NO: 60047 - DNA, 201 bp, Homo sapiens
tgttaaagtaaattttaattttagataaacaatggataattttttagcaaaaggatgttccacatttaactggacattatctctgtctctctccctccttmcctgcctcctatcctctcttcccaccccctacgatgtctatgtatagtttcaacctggcaaccctgtgacctcagcactaggatatggatagaaaacata

SEQ ID NO: 60048 - DNA, 201 bp, Homo sapiens
aatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaa

SEQ ID NO: 60049 - DNA, 201 bp, Homo sapiens
aaaagtgtagtggtttgtagggtcatccccctaaagatatcccgccccaccaaagatatccctaaagacatcctgctggtttcagtggctcatgcctgcawtcccagcactttgggaggctgaggcaggcggatcacttgagctcaggaattcgagaccagcctggccaacatggtgaaaccttatccgtaaaaaaaataa

SEQ ID NO: 60050 - DNA, 201 bp, Homo sapiens
ggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagat

SEQ ID NO: 60051 - DNA, 201 bp, Homo sapiens
tgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatc

SEQ ID NO: 60052 - DNA, 201 bp, Homo sapiens
ctgtagttcatgaaacattcccttcgattctttgaactctctcatacctttcccttaaattcttctttttcccttatgtcaagcttctttcagtaacaacwgaaaggctaatagtagtgctgtgtggggaggactttggacttggggattggactccatgggagaggtcagctccttgtctccctggtggtgagacaggga

SEQ ID NO: 60053 - DNA, 201 bp, Homo sapiens
tccagtccgtgggggccctggtgctactgctgtagttcatgaaacattcccttcgattctttgaactctctcatacctttcccttaaattcttctttttcscttatgtcaagcttctttcagtaacaactgaaaggctaatagtagtgctgtgtggggaggactttggacttggggattggactccatgggagaggtcagc

SEQ ID NO: 60054 - DNA, 201 bp, Homo sapiens
tagggaggctgaggcaggagaatcacttcaacccggaaggcggaggtttcagtgagctgagatccagcctgggtgacagagcaagactccatctcaaagcraaacaaaacaaatgagggtcctcatcagcgtgcctttgacactgtcctctggtcctggtgatctgaatacatcaccacagaactgccagggtacgtgttt

SEQ ID NO: 60055 - DNA, 201 bp, Homo sapiens
tgcaggcttaaggctggaagaaaccccaagcatttggccaggaagaggcaactagttccagctggcccacatactacactttaaaaattacccagatgatstgattctgtagagagagagtgggtggagaggactccagggccatggaggaagattcggcctttctctccctaatcatgagcaatgtgatttggagagaga

SEQ ID NO: 60056 - DNA, 201 bp, Homo sapiens
ttgaaggtgacagagactgagaaagggctgcacacctttggcctaaagggtaatgagcaacacacaaggattgggagatgttcatggcaagaaaaattcasaagggacattgttgtttcactaattctgtaaaggagagcagcggcatttacttaggccgattccccattctctctttctgtttttaaacagagacagatc

SEQ ID NO: 60057 - DNA, 201 bp, Homo sapiens
cttcaaagatacaaagctagaaactacaaaactaggcatggttaataaataactgaaataccaggtgtatagaaatgcatctgtggaaaaatgaaatcatrtattctctaggatatattaggaaatggctctttggcaagtctagagggtaaagtatccctgaagggggaaaaggtttaaaaacagtaaactaaagaagat

SEQ ID NO: 60058 - DNA, 201 bp, Homo sapiens
tctttccccctcaacttccataggaaccaaactctctttcttcctcccgtttggttggaaagttattttgcctcactgcgtgatttttctactgcaccaaytcccctttcaaacgttattccacaacatactaaattaatgtatactgtgttctttgggtaatggggaggggagcctgtctcacagcacgcatttgttcag

SEQ ID NO: 60059 - DNA, 201 bp, Homo sapiens
tagttcaaataatacatatgctgaaattcctatatcccccccatactccagatcttcagtgtggaatttaaatataattccttattgtaaaaaaaaaaaawttttttttgatcaaggtgattttgataaactaaatgcatctttaattttactcacagcaaagcgattctttattttctctctaaaagcataattgatgtg

SEQ ID NO: 60060 - DNA, 201 bp, Homo sapiens
actaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatctt

SEQ ID NO: 60061 - DNA, 201 bp, Homo sapiens
ccttttgactccctaaggaaccctgttttgggtttcttttgaggttgaagatatttcagactctttccccctcaacttccataggaaccaaactctctttmttcctcccgtttggttggaaagttattttgcctcactgcgtgatttttctactgcaccaactcccctttcaaacgttattccacaacatactaaattaat

SEQ ID NO: 60062 - DNA, 201 bp, Homo sapiens
atcatacaatgagtggcttaaatatttattcttacagttctagaggctggaagtccgagacgagggtgccaaccttgttgagttcttagtgaggtccctcyttctggtttttaagtagcctgtttcttgctgtgtcctcatatggtggagagctgagaggaattgagagagagagagagagaggtcgcactgtctcatgtg

SEQ ID NO: 60063 - DNA, 201 bp, Homo sapiens
gtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctg

SEQ ID NO: 60064 - DNA, 201 bp, Homo sapiens
aacagtcagagtgtccaagtaatctgagctagaaagttccttctttcagagaaaagttataaaaagtatatttgccggatccaaaaaaaatactgtgtatsaactactgagacctgcataatgttttcttagtattctcactctttaaaagaaaaaagaaaacctgtaaaatttgggaacttaaactttttttgatatttt

SEQ ID NO: 60065 - DNA, 201 bp, Homo sapiens
gcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatc

SEQ ID NO: 60066 - DNA, 201 bp, Homo sapiens
ttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtg

SEQ ID NO: 60067 - DNA, 201 bp, Homo sapiens
gaaaatccttggggagccgccatcattccttccacgaaggaatgaaattataacgtaatgtattgttggagcccttagttcaacactgtcttttttcaggycatattaatgcaatggttagcatatcaacttccttctgtttttagtgactctaatacattatattcaccttgttctctgcatgttctttctttaagtcat

SEQ ID NO: 60068 - DNA, 201 bp, Homo sapiens
gggagccgccatcattccttccacgaaggaatgaaattataacgtaatgtattgttggagcccttagttcaacactgtcttttttcaggtcatattaatgsaatggttagcatatcaacttccttctgtttttagtgactctaatacattatattcaccttgttctctgcatgttctttctttaagtcatgttagatccct

SEQ ID NO: 60069 - DNA, 201 bp, Homo sapiens
ttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctct

SEQ ID NO: 60070 - DNA, 201 bp, Homo sapiens
atgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacatt

SEQ ID NO: 60071 - DNA, 201 bp, Homo sapiens
caaagtaatataccacttttcgcttttttaatggtgagagccaaggtcaatctgaatttttctttttctttcttcctttttttttttttttttttttttawaaaaaaaaaggtgcttgaattagaaaggtagcacattgtccacatggacagtgcaggatggggctggctttttcatttctgagagctggcaatggaatga

SEQ ID NO: 60072 - DNA, 201 bp, Homo sapiens
tgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagattttttcaatttttttttactgtcatatgatt

SEQ ID NO: 60073 - DNA, 201 bp, Homo sapiens
gcaaagtaatataccacttttcgcttttttaatggtgagagccaaggtcaatctgaatttttctttttctttcttcctttttttttttttttttttttttwaaaaaaaaaaggtgcttgaattagaaaggtagcacattgtccacatggacagtgcaggatggggctggctttttcatttctgagagctggcaatggaatg

SEQ ID NO: 60074 - DNA, 201 bp, Homo sapiens
acatttgggaaatttgtaaagccttactttgaatgtctttttcttcactctatctgtattgtttggtgctttctatataaatttataaattggatgtacckccacagatgtcggttttctggtaataatacttttttacattaaaaaaaactcctgaaatgaaaatgtaacttagtcttattattgtaatctccccttgcc

SEQ ID NO: 60075 - DNA, 201 bp, Homo sapiens
ttagtcttttcaagaggcaaagtaatataccacttttcgcttttttaatggtgagagccaaggtcaatctgaatttttctttttctttcttcctttttttgtttttttttttttttaaaaaaaaaaaggtgcttgaattagaaaggtagcacattgtccacatggacagtgcaggatggggctggctttttcatttctgag

SEQ ID NO: 60076 - DNA, 201 bp, Homo sapiens
cattatggtacataaaagagctttctatcgcttttttacattatagtagttattcgttattattattattattattattattattattattattattatttctgagacaccgttttactctctctttgcccaggctggagtgaaatggcacgatcgcagctcactgcgacctccacctcttgggttcaagtggttcttctg

SEQ ID NO: 60077 - DNA, 201 bp, Homo sapiens
aatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctc

SEQ ID NO: 60078 - DNA, 201 bp, Homo sapiens
acagtcgtgatttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatc

SEQ ID NO: 60079 - DNA, 201 bp, Homo sapiens
atctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaat

SEQ ID NO: 60080 - DNA, 201 bp, Homo sapiens
tacaggcacgagctgccacgcctcacctcttgttttcaataccattgataagttgtggtcttcagggacttgtgggcattttcaagttaaatatccaacaktcgtgatttagggcatgaagagctcactcatcaagatgtatgtaattcagattttctgagtgtttaattcggcgtctttggtcacaaggaacagagtttt

SEQ ID NO: 60081 - DNA, 201 bp, Homo sapiens
aagtctcgctttgttgcctaggctggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacagtcgtgatttagggcatg

SEQ ID NO: 60082 - DNA, 201 bp, Homo sapiens
aagaaaactcacagaagcagaaacttagggcttgctttaaatgttatcagtgtgaattgagatggtgtcagcattatttttttaaagaccaaaacaacaakagtaacaaacacacacaagccactgttagattttacaaaactttaaaaagtaattatcttaaagatatctaagatagtgatctggttacatagattatca

SEQ ID NO: 60083 - DNA, 201 bp, Homo sapiens
tcgcaatgattcggtgtgttttgttccgtgcatcctggcatgtgaaagaagtgaggtaaagagtataatttacttccttgttttaaagctagcattgcccrtgccttccacgcgggactgttgtggatatttgaccactgcaagaaaactcacagaagcagaaacttagggcttgctttaaatgttatcagtgtgaattga

SEQ ID NO: 60084 - DNA, 201 bp, Homo sapiens
aatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccgtgccttccacgcgggactgttgtggatatttgaccactgcaagaaaactcacagaagcagaaact

SEQ ID NO: 60085 - DNA, 201 bp, Homo sapiens
gtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaa

SEQ ID NO: 60086 - DNA, 201 bp, Homo sapiens
gtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtca

SEQ ID NO: 60087 - DNA, 201 bp, Homo sapiens
ttttaagctaccacacagatgcaggaaactaatataccctttaatgattttctccatggcctttctgataatcctttcatccttcatctcccctgtcgccsttttctttgctttgcttgcttgcttgttttttttttttttttgagacggagttttgctcttgtcgcctaggctggagtgcaacggcacaatcttggttca

SEQ ID NO: 60088 - DNA, 201 bp, Homo sapiens
acacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccata

SEQ ID NO: 60089 - DNA, 201 bp, Homo sapiens
attgttttaagctaccacacagatgcaggaaactaatataccctttaatgattttctccatggcctttctgataatcctttcatccttcatctcccctgtygccgttttctttgctttgcttgcttgcttgttttttttttttttttgagacggagttttgctcttgtcgcctaggctggagtgcaacggcacaatcttgg

SEQ ID NO: 60090 - DNA, 201 bp, Homo sapiens
accatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcga

SEQ ID NO: 60091 - DNA, 201 bp, Homo sapiens
ggggtttcaccatgttagccaggatggtcttcatctcctgacctcgcgatctgcccacctcggcctcccaaagtgctgggattacaggcatgagccaccaygcctggccctgatttttaaatttttcatggagacagggtctcaccttgttttccaagctgatctcaaaatcctggcctcaagcaatcctctcctctgcct

SEQ ID NO: 60092 - DNA, 201 bp, Homo sapiens
gaataaaggcatggatgtgactgaggaggtaaaggtgaagaattggggaggggtggatggggctgactcatgacctaaagaacatggcatctggggctctyttgaaataatctgcactaaccactcattcacatttttttgagtctgtaagatcccaggcactcttggtagcaggggggttaggtgggtgaagggacaagt

SEQ ID NO: 60093 - DNA, 201 bp, Homo sapiens
agacatgaataaaggcatggatgtgactgaggaggtaaaggtgaagaattggggaggggtggatggggctgactcatgacctaaagaacatggcatctggrgctctcttgaaataatctgcactaaccactcattcacatttttttgagtctgtaagatcccaggcactcttggtagcaggggggttaggtgggtgaaggg

SEQ ID NO: 60094 - DNA, 201 bp, Homo sapiens
gttccaatgtttctgaaggatgtttttttaaaagaagtattcatttaggtgacacatatttattgagacactaatatatgccaggaattattctattggtkcctttggaggagacatgaataaaggcatggatgtgactgaggaggtaaaggtgaagaattggggaggggtggatggggctgactcatgacctaaagaaca

SEQ ID NO: 60095 - DNA, 201 bp, Homo sapiens
tgatcacaccacagcactccagcctggccaacatagtgagacactacctagatagcttaggagagttccaatgtttctgaaggatgtttttttaaaagaartattcatttaggtgacacatatttattgagacactaatatatgccaggaattattctattggttcctttggaggagacatgaataaaggcatggatgtga

SEQ ID NO: 60096 - DNA, 201 bp, Homo sapiens
gtgcaggttagaggctatgtcagaagcaagtcaggatttgaaggcagatctgtctgcttttgcccctctgtaaatccagagctgctgcctcatttcttacrttgcccccacccgtgcagcaattcttcctgggaggcctcattgttcatattcataaagggccccattcagtctcctttttggagaaatggccactgcaac

SEQ ID NO: 60097 - DNA, 201 bp, Homo sapiens
tggccaggagactaggcattcatagtggggcgtcctttaaggtctgaagaggacagtgaccatccaccacaggcaaacatgtgtgtgttaaaaaggaatgrcgttttggtctgtgctacaactgggatgaacctcaaacattacgctggacgtggtggcttacacctgtaatcccagcactttgggaggctgaggcaggta

SEQ ID NO: 60098 - DNA, 201 bp, Homo sapiens
ccaagttgtgtaaatcaaagcttctcctgccacactagtgtgtattaggccaggacttcatagtgtgattcaaatcaccaactgaatttttttttcctttycttcccctttctgggggactacgtttttcatggagaccggggccctccagctgctgtgatgatcctcccttgccagggaggtgctgttaatagcaaatgc

SEQ ID NO: 60099 - DNA, 201 bp, Homo sapiens
agatacaagaaggccacatgtggtggttcacccctgtaatcccagcagtctgtgagactgaggcagaaggattgcttgagaagtttgagattggcctgggmaatatagcaagatcccaaccctattaaaaaattaaaaatgaaaataaaattttaaagaaaggtatttctccccttcacggtaatttggagccagtacttc

SEQ ID NO: 60100 - DNA, 201 bp, Homo sapiens
tggtatccccaaacaaaatgttatcaaatgaagaactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgca

SEQ ID NO: 60101 - DNA, 201 bp, Homo sapiens
tggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcgtaaaaagtgatggagaatttcttttaccaatt

SEQ ID NO: 60102 - DNA, 201 bp, Homo sapiens
tactctaggaaggagaatctctgttgggatcttttggggagtacttgcctcccaagtgcttaggctcccgctgctgacaagaccctctgcctggcaagccstgcaggttggaatcctctgttagggttccaaagccttcaccaactcagagctctttctctctctgtttctcttttttgaatttaaattgatcctagtcac

SEQ ID NO: 60103 - DNA, 201 bp, Homo sapiens
gctgtttactctaggaaggagaatctctgttgggatcttttggggagtacttgcctcccaagtgcttaggctcccgctgctgacaagaccctctgcctggsaagccgtgcaggttggaatcctctgttagggttccaaagccttcaccaactcagagctctttctctctctgtttctcttttttgaatttaaattgatcct

SEQ ID NO: 60104 - DNA, 201 bp, Homo sapiens
ttaattatgaccataaaggccccatctccaaatgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaa

SEQ ID NO: 60105 - DNA, 201 bp, Homo sapiens
tgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcagtttagaaccgaatgttaaaaggatattgtctattcgaagggtcagattgtggca

SEQ ID NO: 60106 - DNA, 201 bp, Homo sapiens
ttcttcctaccttccatatgagagaatagggaaaattaaagaataaatgtctctgggtttaatgcaactttactaaggaatgaaagtccgataagaatccrtatcttttgaaagaagattttttaaattccttatttttccttcctgcatggtcataaaacacactggggacagcccaccctgagaagtcaccaggcatct

SEQ ID NO: 60107 - DNA, 201 bp, Homo sapiens
cttacctctttttagtttaattaaaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggag

SEQ ID NO: 60108 - DNA, 201 bp, Homo sapiens
ttgcaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaagg

SEQ ID NO: 60109 - DNA, 201 bp, Homo sapiens
ttaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgctatg

SEQ ID NO: 60110 - DNA, 201 bp, Homo sapiens
cccattaaagaacacagctcatggtcggtccattaactactaattatcaaaacagtgggtgaaaacgatgtttggaaatagctgcgactctcgcgtgatasgaaaatatctgtgatttcgattgcgacaaacacacagatgcttctcacacgatcgcagtgcattgcctaaatgacagtaatgctaaactccagtcagatg

SEQ ID NO: 60111 - DNA, 201 bp, Homo sapiens
gcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacct

SEQ ID NO: 60112 - DNA, 201 bp, Homo sapiens
ttagcgagatattgtctctactctcaagaaactcgctttctttgggaatcatcacctgtttttgtgtcacggaccccttgggcatttggtgccctttgcasaataatggttttgaatacataaaacgcacgggatcacagaggaaaccaatcatattaaaatacagttgtcaaaatattaactcatgggatctagtaacaa

SEQ ID NO: 60113 - DNA, 201 bp, Homo sapiens
attcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccag

SEQ ID NO: 60114 - DNA, 201 bp, Homo sapiens
ctctttctcgatccttgcagtttcccttttgacctgtgggtacacatggtactgacgcaattggcacctcagatggttcttcctgacagctacccttgcamctgactcaggatacaaactacctttttttttggagacagatctcactttatcacccagtctggagtgtaattgacgcaatcctggctggctgcagccttg

SEQ ID NO: 60115 - DNA, 201 bp, Homo sapiens
acattgaaaacttatccaggagaggaaaggctctttcagctgctctttctcgatccttgcagtttcccttttgacctgtgggtacacatggtactgacgcrattggcacctcagatggttcttcctgacagctacccttgcaactgactcaggatacaaactacctttttttttggagacagatctcactttatcacccag

SEQ ID NO: 60116 - DNA, 201 bp, Homo sapiens
gctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcaattggcacctcagatggttcttcctg

SEQ ID NO: 60117 - DNA, 201 bp, Homo sapiens
gcagagtaaacagacaacccgcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgc

SEQ ID NO: 60118 - DNA, 201 bp, Homo sapiens
ttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccac

SEQ ID NO: 60119 - DNA, 201 bp, Homo sapiens
ggtgctagggtaaggcacgcaggatgcaagattagcgagatattgtctctactctcaagaaactcgctttctttgggaatcatcacctgtttttgtgtcayggaccccttgggcatttggtgccctttgcagaataatggttttgaatacataaaacgcacgggatcacagaggaaaccaatcatattaaaatacagttgt

SEQ ID NO: 60120 - DNA, 201 bp, Homo sapiens
acatcttcccctttcttctcccccaggtttgtcccatttgtactgactctgacccaggttgtcatgacttgagactcactagaagtttcagaaagatgcasactgctttaaaaaaaaaaaaaaagggcaaggggaggtgtgagaagaaagtataattctttttcttctaactggagatataaaaatcatataagcatgatt

SEQ ID NO: 60121 - DNA, 201 bp, Homo sapiens
gcagtaaaatagtttttcagtcactttgccttcatttgtttgacattcttggaatatttgggctctacaaggtgctagggtaaggcacgcaggatgcaagrttagcgagatattgtctctactctcaagaaactcgctttctttgggaatcatcacctgtttttgtgtcacggaccccttgggcatttggtgccctttgca

SEQ ID NO: 60122 - DNA, 201 bp, Homo sapiens
agggccacatcttcccctttcttctcccccaggtttgtcccatttgtactgactctgacccaggttgtcatgacttgagactcactagaagtttcagaaaratgcagactgctttaaaaaaaaaaaaaaagggcaaggggaggtgtgagaagaaagtataattctttttcttctaactggagatataaaaatcatataagc

SEQ ID NO: 60123 - DNA, 201 bp, Homo sapiens
ccctctgataatcctgcaagagccagcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttataatgcttcaggagaactcagt

SEQ ID NO: 60124 - DNA, 201 bp, Homo sapiens
gacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgtgttagtccatgaggaatttccttacgtattgt

SEQ ID NO: 60125 - DNA, 201 bp, Homo sapiens
atgcctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttact

SEQ ID NO: 60126 - DNA, 201 bp, Homo sapiens
attactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcac

SEQ ID NO: 60127 - DNA, 201 bp, Homo sapiens
gcctgaaataatttcaaattaacccctgaggaacaaatgctcatgactttcaatgaatagaaaaatcagactgctagaacctccagactgcatgtcatgcrtagaagtagaatcctggggaagctagctcacaaaagcaagggagatacctgcaaggctgagctgagcttgcaagggaagaaaaatattagagagttgtca

SEQ ID NO: 60128 - DNA, 201 bp, Homo sapiens
agtggaatcacagacatgagccaccatgcctggcctgaaataatttcaaattaacccctgaggaacaaatgctcatgactttcaatgaatagaaaaatcaractgctagaacctccagactgcatgtcatgcgtagaagtagaatcctggggaagctagctcacaaaagcaagggagatacctgcaaggctgagctgagct

SEQ ID NO: 60129 - DNA, 201 bp, Homo sapiens
ggtccacctcctgggtaaaggagattctcctgcttcagcttcccaactagctgggacaacaggtgtgtgccaccacgtccagctaatttttgtatttttawtagagacggggtttcaccatgttggccaggctggtcttgaactcctaacctcaagtgatctgcccgccttggcctcccaaagtgctgggattacaggctc

SEQ ID NO: 60130 - DNA, 201 bp, Homo sapiens
caaattccaagcaaactttttacttcttattatgtaaaatggaagggttagccaaattaagatctcaccatcaaccttgagggagtgacttctacatgccrtgtattactggttataaagctagtcttgtttggattgaagaatttaatcatatttaacttttcaaaggatgctttttaaaaaaccttatccgcgtgttat

SEQ ID NO: 60131 - DNA, 201 bp, Homo sapiens
cattttattttgtgggcagatttcttttacagttctggctgggtttcttttagttggcttctttgctttgctcctgttacgacttagccctgtagctctgrgctcttcgattctcacgtgctgatggtgtagctgagctctgctaatgctggttattaatctgacaatctataccagggaggttttataattgccataatt

SEQ ID NO: 60132 - DNA, 201 bp, Homo sapiens
agctagtctgagtggcagccttacccattttattttgtgggcagatttcttttacagttctggctgggtttcttttagttggcttctttgctttgctcctrttacgacttagccctgtagctctgggctcttcgattctcacgtgctgatggtgtagctgagctctgctaatgctggttattaatctgacaatctatacca

SEQ ID NO: 60133 - DNA, 201 bp, Homo sapiens
ggtggttcacacctgtaatctccacactttgggaggctgaagtaggctgaagtgggaggatggttagagcctaggagttcgagaccagtctgggcaacaamgtgagatcctgtctctacaaaaaataaaaaaaattatctgggtatagtggtgtgcacctgaagtcccagctaactgggagtctgaggcaaggaaattgtt

SEQ ID NO: 60134 - DNA, 201 bp, Homo sapiens
gacaaaggtgacagaaaggaaatctcctaagttggcctacagggtgctttagaaaacatctggctgggcatggtggttcacacctgtaatctccacacttygggaggctgaagtaggctgaagtgggaggatggttagagcctaggagttcgagaccagtctgggcaacaacgtgagatcctgtctctacaaaaaataaaa

SEQ ID NO: 60135 - DNA, 201 bp, Homo sapiens
ctaagcagacatactcgatacatcttcactaatgagttctgacttcataaaatgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagcta

SEQ ID NO: 60136 - DNA, 201 bp, Homo sapiens
cagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccatt

SEQ ID NO: 60137 - DNA, 201 bp, Homo sapiens
tctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaa

SEQ ID NO: 60138 - DNA, 201 bp, Homo sapiens
atcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacat

SEQ ID NO: 60139 - DNA, 201 bp, Homo sapiens
gtgaatgggtttggagccaacagggataatagacaacgctatcaagaggggggccaaccacacatgtgcagccactgtatgacgtctggattttccttgasttatggtgatcactattgggaggtggtaagcaaacaggtgacataatttgaatcatggttttaaaagacgccatggttgccatgaggaggacaatgcgta

SEQ ID NO: 60140 - DNA, 201 bp, Homo sapiens
cctttctcagcattccacaagttacttcgtccttcctttgttctcctctgcctttgcctcttttttctttttttattttaattttttttttttaattatastttaagttttagggtacatgtgcacgttgtgcaggttagttacatatgtatacatgtgccatgctggtgcgctgcacccactaactcgtcatctagcatt

SEQ ID NO: 60141 - DNA, 201 bp, Homo sapiens
ggattacaggcgtgagccaccacgcccggccttgatttttcttaacctttatttccaattatgcatcttctgagtaactataaagaaaagcaaaatctacrgtaggtatggagtgagtgcagagtcaccatcagcttgaacaaatgtgtgtatctgtggtcaagtttaattgcttcttctgtaatttatattaatcacgct

SEQ ID NO: 60142 - DNA, 201 bp, Homo sapiens
tggctaatttcttttgtatttttaatagagatgaggtcttgctatgttgcccatgctggtcttgaactcgtgggctcaagcagtccacttgcctcagcctmccaaagtactgggattacaggtgtgagccaccacatctggcgaaactctgggtagtttctaattatttctgtatttctatttgtatttaaaagtacagga

SEQ ID NO: 60143 - DNA, 201 bp, Homo sapiens
gtgttgttatgcagtgtgtgactgtaccagcagcttgatctttgtgcttctagagaacatttaaattgattcgcttttgtgagacagggtcttgctctgtyacccaggcttcagtgcatcagcgtgatcatagctcactgtagcctctccctcctgggccaagtgatcctctcacctcagcctcctgagtagcttggacta

SEQ ID NO: 60144 - DNA, 201 bp, Homo sapiens
agtaggagatatatcttacttaaaaaaaaaaaaaacaaacaaacaaaaaaaaaaaactccttcttcatttgttatagttccaggatagagtgtgtacctgkatagagagagtcaggcagatataggtgtgccctccttccaagatgtgtgatggtgggcaactttctttgcatctctgagcctctattttctctatataaa

SEQ ID NO: 60145 - DNA, 201 bp, Homo sapiens
aggatgtacttacaaatcctacgtggtataacccattatacacagaggctgtatgggatagcctgttgcttccaggctgcaaacttgtatagcatggtacygaactgaatactataggcagtcataacacaatggtaagtatttgtgtatctaaacacagaagtggtacagtaaaaatacagtgttgtaatcttatgggac

SEQ ID NO: 60146 - DNA, 201 bp, Homo sapiens
ggaggtgattagatcatgagggtggagccctcataagtaagatttgtgccctgatgagaagaggatagaaaggtagctaactttccttaagctatgtgaakgtgagaacacagtgggaaggcagccatctgtaactagtaggagggccctccccaagaacgtgaccatgctgccaccttgaccttggactttaagcctcca

SEQ ID NO: 60147 - DNA, 201 bp, Homo sapiens
agaaggacgtgtttgcttcctctcctgccatgattgtaagtttcctgaggtctccccagccacgtggaactgtgagtcaattaaacctctttcctttatamatttcccagtcttcgatatgtccttatagcagcatgaaaacagactaatacaggggcctctgggaggtgattagatcatgagggtggagccctcataagt

SEQ ID NO: 60148 - DNA, 201 bp, Homo sapiens
ggacatggttgtgtccccactgaaatctcatcttgaactatagttcccatgatccccatgtcttgtgggagggacccggtgggagataattgaatcatgcygttctcacgataatgagtgagttctcatgagatctgatggttttataaggggctttcttcccttttgcttggcacttctcttactgctgtcatgtgaaga

SEQ ID NO: 60149 - DNA, 201 bp, Homo sapiens
tctttttttttttgtcagactacttgccagcatactaaaatcaggatattttacttaaatgtagatttatgacagttttgaaaaatcagaatgagtattgkagactaaatgtttatgtcttccccaaaaattcctatgttgaaaccctaatcttaaggtcatggtatttggacatggttgtgtccccactgaaatctcatc

SEQ ID NO: 60150 - DNA, 201 bp, Homo sapiens
agtgattgacttacccgagtgtacacatgtttgcatctcacttgtatgttccttacatgtttacttaattattgggaaggtgtattaatgtcctgttgctrctataatggaccaccacaaactcggtgcttctatgctgcaaacctaagattataggcagtcataacacagtgttaagtatttgtgtatctaaacatagaa

SEQ ID NO: 60151 - DNA, 201 bp, Homo sapiens
ttttgctgttacgagcatggatttagctcatttttaccatcttccctagttgtatcaccttcctcccattatgtttgtaacttcagattttgtatatttcrcatatgtcaatatgtaaacattttatatatatatatatgcatgcacacacatgcatacatatatgtaatggtatatatacatgtaagtttccatttttgc

SEQ ID NO: 60152 - DNA, 201 bp, Homo sapiens
tcagttttcgtgtctccctcccactggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgag

SEQ ID NO: 60153 - DNA, 201 bp, Homo sapiens
tatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattat

SEQ ID NO: 60154 - DNA, 201 bp, Homo sapiens
atggcctgggaggcaagtgtgatcattcaggtaatcaaagtaactacagaaacagaggtatggattagctagtcattgcagatgtggcattgagcatatargcgtggtgtacatcttagaacttcatctggaaatgcctgtgggggagttggatttcaagatcatcgtcaatgtcatgtcactgtaatttcatttacatta

SEQ ID NO: 60155 - DNA, 201 bp, Homo sapiens
taagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatataagcgtggtgtacatctt

SEQ ID NO: 60156 - DNA, 201 bp, Homo sapiens
gctttatgtggagaaaacagtattggaaattattactcagttcaagaaaacctcactgagcacctaccatgtaggtgctcatcccgataccactatcaggmcctttggaccagttgcaaggatgcaggatgaggaaggcaatgtgagaaaacagaaggagcaccaggcagtcgtgggcttgatttttattttactattttt

SEQ ID NO: 60157 - DNA, 201 bp, Homo sapiens
agatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtgagaatcgtaagattcctgatctgtttctct

SEQ ID NO: 60158 - DNA, 201 bp, Homo sapiens
acctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatc

SEQ ID NO: 60159 - DNA, 201 bp, Homo sapiens
gcttcagggaagggcagtgcaaattgtttctggactgatgccatcttttaataatagtagttaatagactgggtacaatggctgacgcccgtaatcccagygctttgagaggccgaggccggtgtatcgcctgagtccaggagttagagaccagcctgggcaaacagcctgaggcaaaacctcatctctacaaaaaataca

SEQ ID NO: 60160 - DNA, 201 bp, Homo sapiens
atgttaacctcctttggaaacacccgcacagacacacccaggaacagcaccttgcatccttcaatccaatcacattgacactcaatattaaccatctcagyaggcttcttcgtgttcacatagtctcctcaccgtgtgctgtgtccagatttccccttttcataaggacaccagtcctattggattagggctcccccatta

SEQ ID NO: 60161 - DNA, 201 bp, Homo sapiens
cccaggctcaactatcagccgccttctcatcccaagggctgtcaccaccagaaatttaacatgctgttagtgcatgcaaaaaaaagcccagtaattgtagsgctcatcagtacattgttaattgatcctcatttcctattattttacctcaaagcaaacacatcattcaccatagtgacaccagagttgtttatcttctct

SEQ ID NO: 60162 - DNA, 201 bp, Homo sapiens
ccgctgacttaaatgttaacctcctttggaaacacccgcacagacacacccaggaacagcaccttgcatccttcaatccaatcacattgacactcaatatyaaccatctcagtaggcttcttcgtgttcacatagtctcctcaccgtgtgctgtgtccagatttccccttttcataaggacaccagtcctattggattagg

SEQ ID NO: 60163 - DNA, 201 bp, Homo sapiens
ctcttacttaaacacacagcatgactctccttacacatttatttcagaagagcaaagtccgggtccccaggctcaactatcagccgccttctcatcccaasggctgtcaccaccagaaatttaacatgctgttagtgcatgcaaaaaaaagcccagtaattgtagggctcatcagtacattgttaattgatcctcatttcc

SEQ ID NO: 60164 - DNA, 201 bp, Homo sapiens
ccaccatacccagccaaaatattcttttcaaagtgattagaagtaggagaagcttgctctctttttattggcacttctgtcttacatgcactttttgattkaaattattctgtcttctatgaaatgacagtgattggaggtggtttatttttttttaagtctgcttactcggaaaaataaaacaaagttgacaacctgatt

SEQ ID NO: 60165 - DNA, 201 bp, Homo sapiens
cttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctg

SEQ ID NO: 60166 - DNA, 201 bp, Homo sapiens
actcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgatttaaattattctgtcttctatgaaatgacagtgattgga

SEQ ID NO: 60167 - DNA, 201 bp, Homo sapiens
accttcaccaccacccaatgtgtcctgctcatcactgaggtttgtcatttttactctgagtctgtccattgtcatcatctccaccatcaccccttttgttytcattgccacccttgcctggggtgagtgaagacgctcttctctggcttccacccttccaaatgcccttaacccacagatgggaagaaaatgaggtggggg

SEQ ID NO: 60168 - DNA, 201 bp, Homo sapiens
ttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttat

SEQ ID NO: 60169 - DNA, 201 bp, Homo sapiens
cacaattcacacaccaggctgccactttggcccctgcgtcaccttcaccaccacccaatgtgtcctgctcatcactgaggtttgtcatttttactctgagwctgtccattgtcatcatctccaccatcaccccttttgttttcattgccacccttgcctggggtgagtgaagacgctcttctctggcttccacccttccaa

SEQ ID NO: 60170 - DNA, 201 bp, Homo sapiens
agaataaaatatcatcaggagcagctcatgtgaccagaatgtgacaaagtctttgctctacaggtcaagttgggacttactgaggagaaatgaggggactkcaaagtccaggttgcaccatccactttatagatgaggaaagtaagaacccacagcatcttgcacgtagaattcaatatatgtcctgcttcttgaatcaca

SEQ ID NO: 60171 - DNA, 201 bp, Homo sapiens
gggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggacttcaaagtccaggttgcaccatccactttatagatgaggaaagta

SEQ ID NO: 60172 - DNA, 201 bp, Homo sapiens
tctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtga

SEQ ID NO: 60173 - DNA, 201 bp, Homo sapiens
aggccctggggtggaaacacactcgatgtgttcaagggagagtaagtggtgaatgggtttggagccaacagggataatagacaacgctatcaagagggggsccaaccacacatgtgcagccactgtatgacgtctggattttccttgacttatggtgatcactattgggaggtggtaagcaaacaggtgacataatttgaa

SEQ ID NO: 60174 - DNA, 201 bp, Homo sapiens
cctttgcttgttaccagaagagtcgcccagttgtggcagagatcatctagctcgcaaaactgtaaatatttactctttggcctttcccagaaaaaagtgcsgactgctatgttagatactccagttcattcaaagtgatatcaccctaacattctctaaattagccacagcttagatgaaatttaggcaaatggaacgccc

SEQ ID NO: 60175 - DNA, 201 bp, Homo sapiens
gtgccgactgctatgttagatactccagttcattcaaagtgatatcaccctaacattctctaaattagccacagcttagatgaaatttaggcaaatggaaygccccaggccccaggaagactgtggcagcacattgtatgtaactgttggggatgttgcctgaaaccccccccttttttttaggcagctgcaaggattaga

SEQ ID NO: 60176 - DNA, 201 bp, Homo sapiens
tgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctggatagagagagtcaggcagatataggtgtgccctccttccaagatgtgtgatggtg

SEQ ID NO: 60177 - DNA, 201 bp, Homo sapiens
agtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctattt

SEQ ID NO: 60178 - DNA, 201 bp, Homo sapiens
agactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaat

SEQ ID NO: 60179 - DNA, 201 bp, Homo sapiens
tgctttcaggtggagaaattgtaccattgctgaaaatagcttcgctgacagttagggcaagcttcattggtagcaagtttctatctggaaagatgtaggasaggaacactgactctggaagcagacgtgacctagttttgaaacctgggataaccacttcctatctgtatgacccgagcaagttactttccttctcagaac

SEQ ID NO: 60180 - DNA, 201 bp, Homo sapiens
aaatttgcctatctctgatgattagcaagattgataggcttttcttatgtcgggccatttgttttttaacgaattgccctttcatcttatatgcatgactrttggatatgtatcgattactaattgattgcttgcctcatgtgctataatttaattttcaaaatgtcccttagaagttaatttataaagtgtctattactt

SEQ ID NO: 60181 - DNA, 201 bp, Homo sapiens
ttgatgtgccttctcatttaatataagtaattattttaaaggttattgtgattaacatgtattccttatggaaaatttagaaagcgaagaaaaataaaaayaagaataaaagatttaaaaaaaccccaattcttaccagttagaagtatactattaatatttagcatgtatgattgtaagcatgttttcccttctttcgtg

SEQ ID NO: 60182 - DNA, 201 bp, Homo sapiens
agctcattcattttgttaatcctgagtttggaatcaaccaatttatttaaacccgtgaagcctcgctctgtgcccggtcaagtgctgggagtggcatctgyggggagggccaaggcagatgtcatttccagactgcattggatcctggattcagaagctgaagcttaggagtgggcatggtggttcacgcctgtaaaccca

SEQ ID NO: 60183 - DNA, 201 bp, Homo sapiens
gcacagaaactgaagttaaagctaatacaatgtttttcatttttacccttacctctacaatgtacttaattgttacagattcgtatttattgattatcatrttgtattacattgatagccgtttaaaatttatgaagattccgtacttgtcatatttaattctcagcaccgtgcttacagctgtcttgtgataatgtcgaa

SEQ ID NO: 60184 - DNA, 201 bp, Homo sapiens
tgctgggattacaggcatgagccatcacgcctggtgaatggtgtcattttgatgtactgagccatctcagtttttccagcaaccttccctcacctttgtgstcagctagaaggtcagttaacacatgggatgggaattcttgccaatgtccttcgtaaaagaagaacttctccttcactcacatgtcctgatacttcctca

SEQ ID NO: 60185 - DNA, 201 bp, Homo sapiens
gcggggaggaaacctatttcagtgtctctactatttctacctaggtggaggataactagccagatgaacggagctaagccttttgtatgaagtttatttcwtataaagaggaacaaaatcagaatcaaatttcttctgtagttgcacagaaactgaagttaaagctaatacaatgtttttcatttttacccttacctctac

SEQ ID NO: 60186 - DNA, 201 bp, Homo sapiens
ctgtgcttgatggttttactttttgtgatttttggagccttcatgttagaagccatagtcatatggtgctctctgaaagcaagacaaggtttcttcactasactctaagaggagatctgagacagagagatgggggcggggaggaaacctatttcagtgtctctactatttctacctaggtggaggataactagccagatg

SEQ ID NO: 60187 - DNA, 201 bp, Homo sapiens
ttattattattgttgatctcttactgtgcctaatttataaattaaaatttatcctaggtatgtatgtataggtgaaagcatagaatacatagggtttggtmctatccagttttcaggcatcactgtgggtcttggaacgcatctcccgaggataagggggggctactgtcagtgtgaacctgattagatctcaactgaaac

SEQ ID NO: 60188 - DNA, 201 bp, Homo sapiens
aacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataacag

SEQ ID NO: 60189 - DNA, 201 bp, Homo sapiens
tttaaaagcattatttatcatctaagcgggagttaaataaagaaaaagtaaatgaaaaaaatttaataatataaaaaatacaaaaacattattataaaagwtgctgaagctcattattaaaaatcagaaggcatggatgggtattaaagttcaaagtaaaagttttttcaaaaaaatttctttgcttaacccttagacaca

SEQ ID NO: 60190 - DNA, 201 bp, Homo sapiens
agacatggtttgagtagatttctgggcatgtgtatgcattgcttttttaaaaaaataatttctttttttttttttatgagcctatcatcacactcagtggycattcaaatgggttgctttttgatggagcagaagtttttctcaaacttctgttaaaatcattctgtgcttctgcaatagcatctccttagccagaggtga

SEQ ID NO: 60191 - DNA, 201 bp, Homo sapiens
ctaccatctggtagattttagaatttcatttcttcttgtaaatttattctactccaagtcctcaggtttaccactttatgttcttgacagttcttttaaartttgttttgaatctgagtattcaagatttatggttgttgattactaaaaatactgaataaaatatactaacttacacagttgtatacatacagttctacc

SEQ ID NO: 60192 - DNA, 201 bp, Homo sapiens
gttttggaggatgctctctggtactttttgtcttcaattttgtctgttgttttattaagaaaaaaatgctgatatcacctcaggaaatttatttcatcctycactgatagttcagaccgagtttgaaaacttagcttttgagaatttaagtttcattccaggctatgatggtgataattgtagaaatagctttcaaattat

SEQ ID NO: 60193 - DNA, 201 bp, Homo sapiens
acttgcctagtagaattaagattttgattattcttatttgtgggagttttgttttgttttattttaagcacttggagagtgaaaaagaaggagttattggktgcctggatcttatcttaaagtggcttaccctgaggttttttgacaccaatacaagcgtcctgatgaaagcactagaatatttaaaattgctcttcacct

SEQ ID NO: 60194 - DNA, 201 bp, Homo sapiens
tggctacactccatcccaccttactgttaggatataaagtaacatgcttacagactacctagcttcttccggccagtttcttcatcaggcatggtaggccrtagctgcctttccacagataagtatggttctattaaaaatgctaattagcctggtttgatcagtatacattgtatacatgtgttgaaataccactctgta

SEQ ID NO: 60195 - DNA, 201 bp, Homo sapiens
gaataggatctctttcaggaacaagtggatgtaatttgctatggaaatctgaattagacagatcactagtttgttcagacttggcagttcttctaatctgrtatcctgtccccaagtactgtctatatcagatattttagaaagcagctgtagtaaaatcctcacggaatgaagatcatccatctcacctctcatgatttt

SEQ ID NO: 60196 - DNA, 201 bp, Homo sapiens
atcaggcatggtaggccgtagctgcctttccacagataagtatggttctattaaaaatgctaattagcctggtttgatcagtatacattgtatacatgtgytgaaataccactctgtattccataaatttgtacaattattacatgtcaactaaaaataaaagggaaaaaatttgttaatgttttacctgtagagcagatt

SEQ ID NO: 60197 - DNA, 201 bp, Homo sapiens
aagatgtattaaagctttataatttaatacccaaatatagtccaaagaaatgtgtccttatcttaaagatgattgtcatcattgcatatgttatttaaatwtagcacagttcttgaattatgaaaagtactgatttcatattggaaagttatagtgtgaaagctaattcagtgcttgagactaatgaaatcagtaagcctg

SEQ ID NO: 60198 - DNA, 201 bp, Homo sapiens
ggttttttatatatatgtgtattatatatatgtatatatgtattatatatgtatatcttaatatgttatatatgtatataatacacgtgtgtgtgtgtgtrtgtgtgtgtgtgtgtgtgtgtgtgtgtgtgtgtatatatatatatatatatatatatatgaattggtcttcagtttttcccttcctacaatttatattct

SEQ ID NO: 60199 - DNA, 201 bp, Homo sapiens
atttgtgtgtgcatacacacatacactcattgtactatgtttattgcagttaactgaagtcctatgtcactagaatgctatgtaacagaaaatgttggtcrtacctcttgtgataaatatttgttgggtacttattttgtatcacacattggaagaaaaagataattaagatacattccagcccttgcccttgaggaactc

SEQ ID NO: 60200 - DNA, 201 bp, Homo sapiens
tgtatatatgtattatatatgtatatcttaatatgttatatatgtatataatacacgtgtgtgtgtgtgtatgtgtgtgtgtgtgtgtgtgtgtgtgtgtrtgtatatatatatatatatatatatatatgaattggtcttcagtttttcccttcctacaatttatattctaagttcaggcctaaacagttcgtggcctca

SEQ ID NO: 60201 - DNA, 201 bp, Homo sapiens
tatatatgtattatatatgtatatcttaatatgttatatatgtatataatacacgtgtgtgtgtgtgtatgtgtgtgtgtgtgtgtgtgtgtgtgtgtgtrtatatatatatatatatatatatatatgaattggtcttcagtttttcccttcctacaatttatattctaagttcaggcctaaacagttcgtggcctcaaa

SEQ ID NO: 60202 - DNA, 201 bp, Homo sapiens
cacttgaacccgggaggcagaggttgcagtgagccaagatcgtgccactgcactccagcctgagtgacagagcaagactccgtctcaaaaacaaaaaaacaaaaaaaaaaaagaggaatcactttacaattagcttactatattgctaatgtaatcaagacactgtgatagtggtagcaggaggatggggtggagatagac

SEQ ID NO: 60203 - DNA, 201 bp, Homo sapiens
cataaagaatatgtataaaggttcattcagggatttaattttgtacttgtttatataaacattgactagtcatgtttgctagaattagggagcttggcagyatcaacatttttacatattgattctttccttttctttctttcttttttttttttttttttgggacggagtctgttgcccaggctggagtgcagtgcgatc

SEQ ID NO: 60204 - DNA, 201 bp, Homo sapiens
gaaaaatcagaaaatgggtatccatggccaagcctgtgagtagtgagctgagatcatgccattgcactccagcctgggtgacaagagcaagacttaatttaaaaaaaaaaaaaaaagatgctcagtgttattagcaaccagggaaatgcaaattaaaactgtgttgaaatatcactatacaatcatcagaattgctaaaat

SEQ ID NO: 60205 - DNA, 201 bp, Homo sapiens
tattatagcacttttttaaaacatgtcttgccataaaaccagaacattcttgacttcctttttctaattttctctctggtttttaacactaaagagctccrgattcctcccctttctccgtttctactgccactactttaccccaaggtttcttgaccttagcactgttgacattttttgtcagctgtcctgtgcattgta

SEQ ID NO: 60206 - DNA, 201 bp, Homo sapiens
gaaaacaattatttcttgtttttggatgccattgagctttgctgtgtcctttggaccttagaaattttcttccccagcctgggcaacatggagaaaccccygtctcgacaaaaaataaaataaaaaattatatttacagggaaatggtcaagaaattaagaattaaaaaaaaaaatagcaggtgtggtgacatatacctga

SEQ ID NO: 60207 - DNA, 201 bp, Homo sapiens
tgatttttaattatacgcacacctaagtcattacttgtagtagttatattctgtaaagccactgcgaacactaaattagtgaatattgaatcattgcttcwaagagaaatacagggttaggatcctgcaaccctttggtcacaacatttccatcaatcagtacataactttgttttattctgtttggagatagcatattta

SEQ ID NO: 60208 - DNA, 201 bp, Homo sapiens
ctagccactcgagaggctgaggcacgggaattgcttgaacccaagaggtggaggttgcagtgagccaagatcataccactgcacttcagcctgggtgacasagtaagactctgtctccaataaaaaaaaaagaaagaaattgggtcctgatatgtcaataaatgtaagtattaagtatgttaactaatggtggagatgcag

SEQ ID NO: 60209 - DNA, 201 bp, Homo sapiens
agagagtgaagtgtagcctatgggatgagtataggcagatgatccaacttcaagcctctaagtgggaattttaaagttttaaagcttttaaaagcattatytatcatctaagcgggagttaaataaagaaaaagtaaatgaaaaaaatttaataatataaaaaatacaaaaacattattataaaagttgctgaagctcatt

SEQ ID NO: 60210 - DNA, 201 bp, Homo sapiens
ggaggcagagcttgcagtgagccgagatccgccagtgcactccagcctgggcgacagagccagactccgtctcaaaaaaaaaaaaaaattaataataatamcaataatatagtaatgatagctgtggtttactgagtgcttggtgtttgccatgaaatctgttaatactactacttacttgcataaaatccactggatttg

SEQ ID NO: 60211 - DNA, 201 bp, Homo sapiens
accccatctttactaaaaatacaaaaattagccgggcatggtggcagacgcctgtagtcccagctacttgggaggctgaggcaggagaatggcgtgaaccygggaggcagagcttgcagtgagccgagatccgccagtgcactccagcctgggcgacagagccagactccgtctcaaaaaaaaaaaaaaattaataataat

SEQ ID NO: 60212 - DNA, 201 bp, Homo sapiens
tggctatcaaatgccataaaagaatttggtttttctgggtaagtcagaacgaaatcaagtggaaaatagttaaatgttctgtcagtctctaagtcgtgctrtttataataatagctattgctgtttatttctgaagagtgagagctggattgtctcatttatataaaagaaaattacctttgttgctcaaaggtctatatt

SEQ ID NO: 60213 - DNA, 201 bp, Homo sapiens
tgaaattcttgtctctcctttcccatttattagtttagtcaagtatttactgataatagtgtggactcaagtatatttattttatattttaggttacactmcaatattacattattttgttgttcaggttgttccagctttgtcctttgggagcttcctgtattcctttaacatacatgtgtgtgtgtgtgcgcgtatttg

SEQ ID NO: 60214 - DNA, 201 bp, Homo sapiens
tatcaactgatgcaaaaaaggcatttgacatatccaacatgcattcatgattaaaaactcttagcaagtcagtaatgaaagagaattacctcaacttgatrtaagcatctgcataacaacctctacagataacatgaaacttaatggtgagggccaggcgcggtggctcacgcctgtaatcccagcactttggaaggccaa

SEQ ID NO: 60215 - DNA, 201 bp, Homo sapiens
gttagtagatttttttctctaatttttaaaatgtttaattcgctcataagcacagcacagggtattatccatttgtgtgtgcatacacacatacactcatygtactatgtttattgcagttaactgaagtcctatgtcactagaatgctatgtaacagaaaatgttggtcatacctcttgtgataaatatttgttgggtac

SEQ ID NO: 60216 - DNA, 201 bp, Homo sapiens
ttttgccatgttactcaggctggtctcaaactcctgggcttaagcaatctgccctccttaccctcccaaattgctggggttacaagcatgagccaacatgycccgctacattttatctttttttatcctcacaatgttttacagatgaggaaactgagtctttaaaaggctgtgcaacatgctcaaaatcatagaactaag

SEQ ID NO: 60217 - DNA, 201 bp, Homo sapiens
ctctggagtttagaatacattacttagctcatttctatcagggcagttactctacctacttgatgtgtataactccaacacattacgcttattcttttcgrtctttgcattctgttctggaacttctcacttcactctacccctacccccagcctgtattactggcactctcaggcttcaacttaaatgtcatctccttaa

SEQ ID NO: 60218 - DNA, 201 bp, Homo sapiens
actttaaggtcgggctcggtgaactagattcttacttttgagctctcccctctacttgtaatcgtggtaattgttgagcaggattgaaatgcattccgttstgtttcttggatagaaaatgatgaaagggttgttgccagagtggctagtgtgtgttagaaaatatattcgtgttgatgaatcttaacaatgagtttttta

SEQ ID NO: 60219 - DNA, 201 bp, Homo sapiens
cttgttgcccaggctggtctcgaactcctgggctcaagggatccttttgtctcggcctcccaaaatgctgggattacaggcgtgaaccactacgcctggcyttctcttaatctaactgtagccctgttcggggcttcaccaatggctcttggtactactgtacctggggcttccatatgaaggagtcccaggaatttcttt

SEQ ID NO: 60220 - DNA, 201 bp, Homo sapiens
taggagggcagtaatataagcagtgctagaggagaatcgactgagactctgaattgaagcttaaccattattagatgactgaagtggcagcctcaaggccrgaagctccctcagaagaatggttctcagaagaatgcagtagcattcacaatttagagtccccatggacttcctgaaggtacctgcagccgtttgtactgg

SEQ ID NO: 60221 - DNA, 201 bp, Homo sapiens
tatttaagttagctgtatttaattggacaaatattaaacatgaagatagcaaatgataacacactactttgtatcagtatgtaaagagtatacgaatatgwggtcagttctgaaacagacaagtactaagtaagagataaacatttttaggaaataatcttttggtattgcaagttgaatgctgctggtggacattttgta

SEQ ID NO: 60222 - DNA, 201 bp, Homo sapiens
ggattcctcccctttctccgtttctactgccactactttaccccaaggtttcttgaccttagcactgttgacattttttgtcagctgtcctgtgcattgtrtgatgtttagcagcatctttggcttttatccactagatgtcagtaataccatctccctaagtcatgacaatcaaaaatgtcttgaaacattgccggaagt

SEQ ID NO: 60223 - DNA, 201 bp, Homo sapiens
aacatcatattctcaaatctgggaaaatgtttgtgatcatataacaaaaatgttgtaaggggattatgcctgtctttttcatatgatttatattactacaygtgtattgaaaaaaaactggatacgtactttagtgttcatcatggttattaggtggtggtaaaattgtattttaatacttagatttttttctgtagttac

SEQ ID NO: 60224 - DNA, 201 bp, Homo sapiens
aagtaatagttaaacttctttcatttatttcttgtaaaataattacttgaatagaattagaatactctgctgagcccttgcctgatgcacccccttccatyccatatcttccctagtagagtgagttagttgcttcttcctctttgctcccacactactttgtacatatatatattatagcacttttttaaaacatgtctt

SEQ ID NO: 60225 - DNA, 201 bp, Homo sapiens
gcctgggcgacagagccagactccgtctcaaaaaaaaaaaaaaattaataataataacaataatatagtaatgatagctgtggtttactgagtgcttggtrtttgccatgaaatctgttaatactactacttacttgcataaaatccactggatttgtttaatttgaccctttccaatcagcctttctcttatttggtcac

SEQ ID NO: 60226 - DNA, 201 bp, Homo sapiens
ttatccatttgtgtgtgcatacacacatacactcattgtactatgtttattgcagttaactgaagtcctatgtcactagaatgctatgtaacagaaaatgytggtcatacctcttgtgataaatatttgttgggtacttattttgtatcacacattggaagaaaaagataattaagatacattccagcccttgcccttgag

SEQ ID NO: 60227 - DNA, 201 bp, Homo sapiens
tcctaggcaaataggtcactctacttaaaccacccctcatccagtactttttctcccctttatcatcatgattccttggtagaatggacattatccattgktatgaaaacctctcaaaaacctgtgttgtaaaggagcatggcagttcattttggcatataccgggtgattctaatgaggaacggtaaggagaaacactgc

SEQ ID NO: 60228 - DNA, 201 bp, Homo sapiens
ggcaggcagatcacaaggtcaggagtttgagaccagcctggccaatgtggtgaaacgtctctaccaaaaatacgaaaaaattagctgggcatggtggcgcrtgcctgtaattccagctactcggaaggctgaggcaggagaattgcttgaacctggaaggcagaggttgcagtgacccaagatcatgccactgcactacag

SEQ ID NO: 60229 - DNA, 201 bp, Homo sapiens
ggagcatggcagttcattttggcatataccgggtgattctaatgaggaacggtaaggagaaacactgcaagagcactgtcacttatggcagaagccgtctrgtcctgcgtctgctgcccattgggtttagatctgagtttgtgcatctttgatattcggtactttagaacttcaaatctattctgctttgctgtttttagg

SEQ ID NO: 60230 - DNA, 201 bp, Homo sapiens
cttgcccaggctagatagtgcagtggtgtcaacatgtctctctgcagcttcagcctcctgggttcaagtgatcctcccacctcagcctcccaagtagctgrgactacaggcgagggccaccatacccaactaatttttgtacttgttgtagagctggggtccctccatattgaccaggctggtcttgaactcctgggctca

SEQ ID NO: 60231 - DNA, 201 bp, Homo sapiens
ggggatgcaggcagtgtttcatactttcccgaggaaagaaatgcacaggtgccactcagtcatcacttgcctcagaggatgtgactctaatagagccttattttttttttttttttcctcttttgagaccaggtctcactatgttgtccaggctggagtacagtggctattcacaggcactatcatagcacattgcagccc

SEQ ID NO: 60232 - DNA, 201 bp, Homo sapiens
ggattcaggacaaactcctcctacaaaaagaaaattaaaactagttgctaacctttggagatctcagagactaggacttaactccttgaaatattaatgcygtttctactacaattttcttaagaactcttcatattaaattagatgattgcacattacaattgtattggcatgcaagattacttacatagacttgtacat

SEQ ID NO: 60233 - DNA, 201 bp, Homo sapiens
tgttagtagatttttttctctaatttttaaaatgtttaattcgctcataagcacagcacagggtattatccatttgtgtgtgcatacacacatacactcattgtactatgtttattgcagttaactgaagtcctatgtcactagaatgctatgtaacagaaaatgttggtcatacctcttgtgataaatatttgttgggta

SEQ ID NO: 60234 - DNA, 201 bp, Homo sapiens
ctgttagtagatttttttctctaatttttaaaatgtttaattcgctcataagcacagcacagggtattatccatttgtgtgtgcatacacacatacactcattgtactatgtttattgcagttaactgaagtcctatgtcactagaatgctatgtaacagaaaatgttggtcatacctcttgtgataaatatttgttgggt

SEQ ID NO: 60235 - DNA, 201 bp, Homo sapiens
gccccggaagtcgaggctgcagtgagccatgttcctgctactgcacgccagcctcagtaacaaagcaagaccctgtctcagaaaaaaaaaaaaaaaaaaaaggataagtttattgtatatttaagacttctgactgggtggggtggctcgcaagtgtaatatcaactctttgggaggctgaggcaggaggactgcttgagc

SEQ ID NO: 60236 - DNA, 201 bp, Homo sapiens
ctgtgtccctgctggcttgctgcgatgtgaacgattccgatcatccaccaccccgcccttaacgactggctttctctctctcaacgtgtcgggagcgttcwggtgtccttccagccctggaggtgttggggaaccaatacaatagccagcagtgtgggttgggccttgctactttaaggtcgggctcggtgaactagattc

SEQ ID NO: 60237 - DNA, 201 bp, Homo sapiens
ggcaggagaatggcgtgaacccgggaggcagagcttgcagtgagccgagatccgccagtgcactccagcctgggcgacagagccagactccgtctcaaaamaaaaaaaaaattaataataataacaataatatagtaatgatagctgtggtttactgagtgcttggtgtttgccatgaaatctgttaatactactacttac

SEQ ID NO: 60238 - DNA, 201 bp, Homo sapiens
ggtgatccacccgcctcagcctcccaaagtgctgggattacaggcatgagccaccatacccgaccaaccctgtctctttaaaaaaaaaaaaaaaaaaaaaattgaaagcaagcattctgtaaccctacttttgtaaagtatatttgtatgtccatatacacacacacttagagaaaggtctggaaggagggatatcaaaaa

SEQ ID NO: 60239 - DNA, 201 bp, Homo sapiens
tattcaagataacattagtttcagaacaggtctggatgttgaagactaatttgatcccctttcattttatcttttctttttaggtttggggcatttcatawcaaatatccaaaataggtacaaggaacaatgtgaatggtgatgtgtgttgccataatacagttatcatttgctgtgtacattgtaatatactactttctt

SEQ ID NO: 60240 - DNA, 201 bp, Homo sapiens
aaacttttactctgcaaaaaaaaccacatgaaaataataaaacaagctacagaacaacagaaaagatttgtaagccagtatccaataaaggactaatatctagaatatataaagaactctgaaaactcaacagtaacaacaacaacaacagaaaaatcagaaaatgggtatccatggccaagcctgtgagtagtgagctga

SEQ ID NO: 60241 - DNA, 201 bp, Homo sapiens
ttgttgctcaaaggtctatattggcttgtgttcctgctttttgatgttcactgaaagagttctctacgttatttttccttaagcattaatagctgtcccasagaaaatccagttccaagaatttctagtcaaatacattaggaaatttctgtatataattacatttgtttaaagacctatagtatgccttggcgaattaac

SEQ ID NO: 60242 - DNA, 201 bp, Homo sapiens
ttctcctgcctcagcctcccgagtagctgggactgcaggtgcctgccaccacgcccggctaattttttgtatttttagtagagacagggtttcaccttgtkagtcaggatggtctcgatctcctgacctcatgatctgccctcctcggcctcccaaagtgctgggattacaggcgtgagccactgcgcccggccagtttta

SEQ ID NO: 60243 - DNA, 201 bp, Homo sapiens
ccttggcctcccaaagtgctgaggttacaggcatgagccaccaagcctggccttgagcatcttttcatgtgcaggtggcaatctgtagttgtatagttctyggaaaaaaatatctactcaagttctttgcccatttttgaattgggttgttttgaggcaaggtctcactctgttccccaggctggagtgcaatggcacaat

SEQ ID NO: 60244 - DNA, 201 bp, Homo sapiens
agtagctggaattacaggcacgtgccaccatgccaggctaatttttgtatttttagtagagatggggatttgccatgttggccaggttggtcttgaactcytgacctcaggtgatccacccgccttgacctcccaaagtgctgagattacaggcgtgagccaccgtgcctggtctgtcttaactttttaatgtgcagttca

SEQ ID NO: 60245 - DNA, 201 bp, Homo sapiens
cagcaaactctctcagctccgggagtcacgggagcagcaccagcattcagacctggattctaaccagactcactcttcaggaactgtgacctcctcctcckccacagctaacatagacgacttgaaaaaaagactggagagaataaagagcagtcgcaaatgaagctgccccactcccccggcaccctgcagctttagttt

SEQ ID NO: 60246 - DNA, 201 bp, Homo sapiens
gctgtttggagctttaatagagataaaaatggtgatgaaggcacagaagtgtgttttgtcaatttaacataaaatttactatcttaactttttttttttttgagatggagtctcgctctgttgcccaggctggagtgcagtgatgcaatcttggctcactgcaacctccgcctcccaggttcaagtgatcctcctgcctta

SEQ ID NO: 60247 - DNA, 201 bp, Homo sapiens
tatccatttgtgtgtgcatacacacatacactcattgtactatgtttattgcagttaactgaagtcctatgtcactagaatgctatgtaacagaaaatgtyggtcatacctcttgtgataaatatttgttgggtacttattttgtatcacacattggaagaaaaagataattaagatacattccagcccttgcccttgagg

SEQ ID NO: 60248 - DNA, 201 bp, Homo sapiens
atccatttgtgtgtgcatacacacatacactcattgtactatgtttattgcagttaactgaagtcctatgtcactagaatgctatgtaacagaaaatgttkgtcatacctcttgtgataaatatttgttgggtacttattttgtatcacacattggaagaaaaagataattaagatacattccagcccttgcccttgagga

SEQ ID NO: 60249 - DNA, 201 bp, Homo sapiens
tccatttgtgtgtgcatacacacatacactcattgtactatgtttattgcagttaactgaagtcctatgtcactagaatgctatgtaacagaaaatgttgstcatacctcttgtgataaatatttgttgggtacttattttgtatcacacattggaagaaaaagataattaagatacattccagcccttgcccttgaggaa

SEQ ID NO: 60250 - DNA, 201 bp, Homo sapiens
ttttgttatgatctttcatttattcatttattaaacaattacatattggccactacaatgttccaattgtttgttccagtccttcagaatacatcatgaaygaaattaaatttctgtttcatgggagttacatttgagtaaagaaagataggtaataaacagttaaaaatatatatagagagagagagagacagagacaga

SEQ ID NO: 60251 - DNA, 201 bp, Homo sapiens
agtccttcagaatacatcatgaacgaaattaaatttctgtttcatgggagttacatttgagtaaagaaagataggtaataaacagttaaaaatatatatakagagagagagagacagagacagagaggcaggcaggccgggcgcggtggctcatgcttgtaatcccagaactttgggaggctgaggtgtgcagattacctg

SEQ ID NO: 60252 - DNA, 201 bp, Homo sapiens
ttactgtaagttgacagcatgagtttgtagttttatctgaagtaaagtttgtaaatataatattttgattgttctttacaattgaaaaaagctcattaacyacattttctttctaaagaccacactacagaacatcagtgaggatgttttagcagtaatggataataaaaatccaaccatcaagcagcagacatctctttt

SEQ ID NO: 60253 - DNA, 201 bp, Homo sapiens
acagaattaaatgagtctgtatgtaaggtacattttattgtgcctgtctcatatagtatgcacacaataaatggttgctattatgattataacgtaattgygtaacattttgctatagtgaataaatatgtgaatttggagttcattaagttattttctacttttatttttctgaactattagagtgggatcttctagtag

SEQ ID NO: 60254 - DNA, 201 bp, Homo sapiens
gctttcaccttcacacaccactcacccagagcaacttccagtcctgcaagctccattcctggtaaatgtcctatacaggtgtaccatttatcttttatacracattcttactgtaccttctctatgtttagatacataaatactttgtgttaacattgcctatagtattcagtacagtaacatgctgtacaggcttgtagc

SEQ ID NO: 60255 - DNA, 201 bp, Homo sapiens
gacctgaataaggaaagtcattccccaagtgtggcacttcatgttgactaattttagccttcaagtgtgttgtgtagttattttatctgaatccctttctyatgaagatgaatagagatttctgacctgttatcagattaagaattaggcttttcagttgggggcagtggctcatgcctgtaatcccagcactttggaagg

SEQ ID NO: 60256 - DNA, 201 bp, Homo sapiens
cctcaagtgatcctcctgccttggcctcccaaagtgctgaggttacaggcatgagccaccaagcctggccttgagcatcttttcatgtgcaggtggcaatstgtagttgtatagttcttggaaaaaaatatctactcaagttctttgcccatttttgaattgggttgttttgaggcaaggtctcactctgttccccaggct

SEQ ID NO: 60257 - DNA, 201 bp, Homo sapiens
atggaagaattgtgtgttggggggatggggggtcgttttgagatgaaacagttccacctcataaggagcatgcactctagatccctcacatgtgcagttcrcagtagggtttgcactcgtatgagaaccttaatgccctgctgatctggcaggaggcagagctcagggggtaattctcgcttggtagctgttcacctcctg

SEQ ID NO: 60258 - DNA, 201 bp, Homo sapiens
tcaattagtcttaaaattattttagactagttcagaaagtctttaagaaagctagaaaaattatacatctgaattttttaaaaaaattttaatctgttttsagaggtactagtcaaatacattgtaagatgtccttctattggaatttgtctgatgtttttctcattagactggagttacaggttttgggcaggaagacca

SEQ ID NO: 60259 - DNA, 201 bp, Homo sapiens
tgtgtcacccaggccacagtgcagtggctcaatcatggcttactatagtttcaacctcctgggttcaagcagtcctcccacctcagcctcttgagtaactsagactacaggcgcatgccactacacctggctatggagggaattcttaacatgtaaaaggcaaaatctcatttaatctttacaacaatgattagatgagtc

SEQ ID NO: 60260 - DNA, 201 bp, Homo sapiens
tcgagaccagcctggccaacatagcgaaaccctgtctctcctaaaaatacaaaaattagttgggcatggtggcacacctgtaatcccagctacttgggaarttgaggcaggagaatcgcttgaacccaggaggtggaggttgcagtgagccaatatctcgccattgcactccagcctggatgacagagcgagactcaggaa

SEQ ID NO: 60261 - DNA, 201 bp, Homo sapiens
tttaccttaaatatgtgtactattgtttactattttctttctatctgatatgaagattttaaatcttggattattttttaaaaccactttagtgacttaartatttaaagcatttcttgtaactttctctagaagcaagttcaaaaggtcttcagttacactgttatgataagagatacatttaaatatcaatggaaagaa

SEQ ID NO: 60262 - DNA, 201 bp, Homo sapiens
gataagagatacatttaaatatcaatggaaagaaacagaaaagctttcaaactaagtgtttggaaatgtgtaaatgccattcaagatgtcattaatggctsaggtgggtggatcacttgaggtcaggagctcgagaccagcctggacaacatggtgaaaccctgtctctactaaaaatacaaaaattagccaggggtggtg

SEQ ID NO: 60263 - DNA, 201 bp, Homo sapiens
agatttttttctctaatttttaaaatgtttaattcgctcataagcacagcacagggtattatccatttgtgtgtgcatacacacatacactcattgtactwtgtttattgcagttaactgaagtcctatgtcactagaatgctatgtaacagaaaatgttggtcatacctcttgtgataaatatttgttgggtacttattt

SEQ ID NO: 60264 - DNA, 201 bp, Homo sapiens
aaacagaaaagctttcaaactaagtgtttggaaatgtgtaaatgccattcaagatgtcattaatggctgaggtgggtggatcacttgaggtcaggagctcsagaccagcctggacaacatggtgaaaccctgtctctactaaaaatacaaaaattagccaggggtggtggtgggcgcctttggtcccacctactgaggagg

SEQ ID NO: 60265 - DNA, 201 bp, Homo sapiens
catttgtgtgtgcatacacacatacactcattgtactatgtttattgcagttaactgaagtcctatgtcactagaatgctatgtaacagaaaatgttggtyatacctcttgtgataaatatttgttgggtacttattttgtatcacacattggaagaaaaagataattaagatacattccagcccttgcccttgaggaact

SEQ ID NO: 60266 - DNA, 201 bp, Homo sapiens
tgggctaaggaagaaatttggacaatatgcaggacatgtaagtaacactcctttttagatacagatcaacaaaatttatcaaaaatggtaggcctagtttkctgtttgctttaaaacaactccttggcatagatgtgtatatactgtacaaagtaaatttctctctgttttgttaatattcagcatagatatatcttagaa

SEQ ID NO: 60267 - DNA, 201 bp, Homo sapiens
ctcccacctcagcctcttgagtaactgagactacaggcgcatgccactacacctggctatggagggaattcttaacatgtaaaaggcaaaatctcatttawtctttacaacaatgattagatgagtcatgttaggcaagttactctgtttgcctcaattgcctcattattaaatagggataataatatcaacttcaaggtt

SEQ ID NO: 60268 - DNA, 201 bp, Homo sapiens
gttgcatgtgtgtataagagggttgtagtgtttttgtaggcagccctagtagtaattctcagttatgcagtcagtatagtaatttattgtgtattttaggrtgtgtattcagtactaaatgcaaataatcataagaggaggaaaatttaaaaatcagatttttcaattaataaactttctgtgcaatattacttgttagta

SEQ ID NO: 60269 - DNA, 201 bp, Homo sapiens
tgaattagtatcagatattttgtccccttgcattagatttggttaagcaacatgaactactttactctcaggaacgaaggaaacccaagagagaatttctrccaggttaaatgatggcccctagctctggggagtgggaaggagtagagatggatgattagatgaatgactggacacacttcagctggtgtcatggtagaa

SEQ ID NO: 60270 - DNA, 201 bp, Homo sapiens
atcacatctgcaaagaccctttttccaaataaagtaacatttacaagtcccagggattacaacgtgatttctttgggggtcattatcagcctacacaaatrcatatgtaaatgtgtatgtgagatacacacacacacacacacacacacacacacacacatacaaaaaaggaattagacttcatatactgtcttgcaaatt

SEQ ID NO: 60271 - DNA, 201 bp, Homo sapiens
acttacacagttctgatgttagatgttaaacagttgccactcattgttttcgttgttttcaacaaaatccctggggatagggcttttcccactgagctagycagagtccagtcaaataacaggactttcaaatggagcttttctaggaagctgccagacaagacagtactttgggtcaaaactttttgaggaggtccaaac

SEQ ID NO: 60272 - DNA, 201 bp, Homo sapiens
actgggagcctgacattatcccctgacactgtctccagacccgctggacagaagccggaaaggggcagggtggaagaatagatgtcattgtcatccatccygggtcacatggggtttgatggcagtcggcgtgctggcatgtgccctgtcctttctttaaggcttggaaacctccccccactgaggaaggcagagaggaat

SEQ ID NO: 60273 - DNA, 201 bp, Homo sapiens
ctttctttaaggcttggaaacctccccccactgaggaaggcagagaggaatccccatttcacagaggagacaggccaagaaaaggaaagagatggaattcraggtcacactgctggtactcagtttaccaggatttaagctggaaacagtccatgatctggagtcacttttttttttgagaccgagtcttgctctgtcacc

SEQ ID NO: 60274 - DNA, 201 bp, Homo sapiens
tgtatctgtgccatggggaggtcgtcaaaccacagagaagcttttaaaccagctggacaagaagttccctcccccagggcacaggccttgtcttttgaagrgacaaagaggtgctgccctcagtgctctgtaatgggaagggccggggtggcctggctgaaagaatgaccctgaactccctgccaggccctgcagctatgg

SEQ ID NO: 60275 - DNA, 201 bp, Homo sapiens
ggtcttggcataaatgcgagtgaaccccaccttgaggtcagcttttctgtctttcccagatgtgaagctggagttgggggttgcctgggaggatgacatgyaggctggatctggggctcagtggggtggggaaacctgcgtgtcacccagttcctccttgcccctgacctgcctgcccctacagagtggccggagcccagc

SEQ ID NO: 60276 - DNA, 201 bp, Homo sapiens
tggtcttggcataaatgcgagtgaaccccaccttgaggtcagcttttctgtctttcccagatgtgaagctggagttgggggttgcctgggaggatgacatkcaggctggatctggggctcagtggggtggggaaacctgcgtgtcacccagttcctccttgcccctgacctgcctgcccctacagagtggccggagcccag

SEQ ID NO: 60277 - DNA, 201 bp, Homo sapiens
agctaggtgaccgccctggtgtcacacaacaccaggggatccaagcgcacagccctggcctcagtcttctccctccacagcggcacgaggggcagctggtsgctgggcaactgatggggttgctgcctgggctggcatcagccatgaagtatctgtcagagatgggctacgttcaccggggcctggcagctcgccatgtgc

SEQ ID NO: 60278 - DNA, 201 bp, Homo sapiens
gaagcaggtccttctgcctctaaatgctctcttatgtctccaagctgcagcaagtatagaaagagcctggaggattagagccgaccaccatgagagaagcygggctgtaaggggtgggcaagcagcagaaggcctaatgcttttccctctatgggacaatgaagaaaagggctgtgggggcagaggtgcttctttcctctg

SEQ ID NO: 60279 - DNA, 201 bp, Homo sapiens
cgggcaggggtccctcacttttctctttggtagggcttggaattggcatcatccccactggccgggctgacctgtggtcacagggtgaactaaagcctggygagagctaggtgaccgccctggtgtcacacaacaccaggggatccaagcgcacagccctggcctcagtcttctccctccacagcggcacgaggggcagct

SEQ ID NO: 60280 - DNA, 201 bp, Homo sapiens
gaccattggaatcgttaagaagcaggtccttctgcctctaaatgctctcttatgtctccaagctgcagcaagtatagaaagagcctggaggattagagccraccaccatgagagaagctgggctgtaaggggtgggcaagcagcagaaggcctaatgcttttccctctatgggacaatgaagaaaagggctgtgggggcag

SEQ ID NO: 60281 - DNA, 201 bp, Homo sapiens
tggtgtgggagtttggagtgcccctgcctctccaggtccttccctcagctatgggagggagcttcagccagggacctcagctttcactgactcaaggcggyccttctcctggagcggccactctggctcagaatgacctttcttttctttctttctttctttttttttttttttgagatggagtctcgctctgttgcccag

SEQ ID NO: 60282 - DNA, 201 bp, Homo sapiens
attttaggatgttttttctatttctgcaaaaaatgcctgggattttgataggattgcattaaatctgtagatcacttttggtagtagagacattttaacartattaagtgttctattccatgaacacaggatgcctttccaattatttgtgttttatttcatttctttcagcaatattttatagttttctgtataaaagtc

SEQ ID NO: 60283 - DNA, 201 bp, Homo sapiens
ggcggtatctgaggtgctgtttccccacagggcggtttggggagctgtgctgtggctgcttgcagctccccggtcgccaggagctgctcgtagccgtgcayatgctgagggacagcgcctccgactcacagaggctcggcttcctggccgaggccctcacgctgggccagtttgaccatagccacatcgtgcggctggagg

SEQ ID NO: 60284 - DNA, 201 bp, Homo sapiens
ccatgattgtgttgactattcatggtccttttagattccatatgaattttaggatgttttttctatttctgcaaaaaatgcctgggattttgataggattrcattaaatctgtagatcacttttggtagtagagacattttaacagtattaagtgttctattccatgaacacaggatgcctttccaattatttgtgtttta

SEQ ID NO: 60285 - DNA, 201 bp, Homo sapiens
gcctctggcggtatctgaggtgctgtttccccacagggcggtttggggagctgtgctgtggctgcttgcagctccccggtcgccaggagctgctcgtagcygtgcatatgctgagggacagcgcctccgactcacagaggctcggcttcctggccgaggccctcacgctgggccagtttgaccatagccacatcgtgcggc

SEQ ID NO: 60286 - DNA, 201 bp, Homo sapiens
ccgggaacagtggctcatgcccttagtctgagcactttgggagcctgaggccaggagcaatatagtgagaccctgtctctacaaaaaattttaaaaattasccaggcatggtgatgtgtgcctgtagtaccaggtgctcaggagggtgaaggaggaggatcagttgagcccaggagtttgaggctgcagcgagtgataatt

SEQ ID NO: 60287 - DNA, 201 bp, Homo sapiens
ttgggaggccggggtgggcggatcatgaggtcaggagatggagaccatcctggctaacatggtgaaaccccgtctctactaaaaatacaaaaaattagctrggcgtggtggcgggcacctgtagtcccagctactcgggaggctgaggcaggagaatggcgtgaacctgggaagtggagcttgcagtgagccgagatcccg

SEQ ID NO: 60288 - DNA, 201 bp, Homo sapiens
actacaggggcatgcagccacacccggctaattttttgtatttttagtagagacagggtttcaccatgttagccaggatggtctcgatctcctgagctcgkgatctgtcctccttggcctcccaaagtgctgggattacaggcgtgagccactgcgcccggctaccaatatggatttcttttgattgagtaaaccttttga

SEQ ID NO: 60289 - DNA, 201 bp, Homo sapiens
ctgagcactcgctcagtccctcataacacattacttcataaaattcccacagcaagcctaggaggtgtcatcattgttctcattttacacacggggaaacygaggctcagggagtaagatcacttgcttgtggaccaatagtgggctaaccactggaaaagtcaggagggaaccttcctaaatgttctcttccctgggctt

SEQ ID NO: 60290 - DNA, 201 bp, Homo sapiens
cgcgtctggggttcacgccattctcctgcctcagcctcctgagtaactgggactacaggggcatgcagccacacccggctaattttttgtatttttagtaragacagggtttcaccatgttagccaggatggtctcgatctcctgagctcgtgatctgtcctccttggcctcccaaagtgctgggattacaggcgtgagcc

SEQ ID NO: 60291 - DNA, 201 bp, Homo sapiens
tccccagctaacttcttttgttggccagaactggattgtaagcccaaccctaaaccattcactggcaaagggaatgagtgcacacaaatgtcttagaacarccagaagttacccaagtcacctatggggagacagtagactatgaaccaaaaattcagctcagctagcaggaaagggggacaaggctgttgactaggtttc

SEQ ID NO: 60292 - DNA, 201 bp, Homo sapiens
aagacccccatctatgcctctcaaagctcatcacataggctggttccctcatggtagcaaggtggctgcagcagctccagacatcacatccttaccattcrgaggcagaaaaagaactgtttcttccttgcaggtatctttttaaaagcaagaaacttttctctgaatcccctgtccccagctaacttcttttgttggcca

SEQ ID NO: 60293 - DNA, 201 bp, Homo sapiens
tggctttcactttattgagaatagcctttcaatcacaaaagcttttagtttcttttttttttttccccaagatggagtcttgctctgttgcccagggtggmgtacagtggtgcaatcttggctcactgcaacctctacctcctgggttcaagcgattctcctgcctcagcctccagagtagctgggactacaggtgcacac

SEQ ID NO: 60294 - DNA, 201 bp, Homo sapiens
ttctccctgtgtcttcacatcatcatctctctaggtgtttttctctgtgttcaaattcttcttttcatgaagatgccagtcatattggattagggcccacmctaatgacctcattttaacttgattacctctgtaaaaataagatcacattctgagatgggaagtggtggttgggacttcaacatatcttttttggagaca

SEQ ID NO: 60295 - DNA, 201 bp, Homo sapiens; identical to SEQ ID NO: 6119

SEQ ID NO: 60296 - DNA, 201 bp, Homo sapiens
gcagtggcctctggcggtatctgaggtgctgtttccccacagggcggtttggggagctgtgctgtggctgcttgcagctccccggtcgccaggagctgctygtagccgtgcatatgctgagggacagcgcctccgactcacagaggctcggcttcctggccgaggccctcacgctgggccagtttgaccatagccacatcg

SEQ ID NO: 60297 - DNA, 201 bp, Homo sapiens
gaggtttgtacgtggtaaaaatttttaaactatttcatggctactttaaaacaatgtgcactattttatggtgtagttctttctctctctgtctttatatttctatatctatctatatatacacagatgttcctcaacttaatgacgggcttatgtcccattgggcttattataagttgaaaatattataagtcaaaaatg

SEQ ID NO: 60298 - DNA, 201 bp, Homo sapiens
ggagttgcaataattttcaccatgtgaaagtagctagggatggtggtggtggtgacggtttggtctagggctacggttgtatctgtgccatggggaggtcrtcaaaccacagagaagcttttaaaccagctggacaagaagttccctcccccagggcacaggccttgtcttttgaagggacaaagaggtgctgccctcagt

SEQ ID NO: 60299 - DNA, 201 bp, Homo sapiens
gccagcaaggccctgcccctaggggccccaagtaccggcctgtggctttgttgactgtgatgcagtcctttggcccgtggctgcctctgtctcaggaagcsctccacaatgaccttggatcaggtcaggcctgtctgtcccgtgtcccaacagtacagcacctttctcctttgccagcactggtgagtgggcttgtggcta

SEQ ID NO: 60300 - DNA, 201 bp, Homo sapiens
attgcactcctctgcttcaaccccacaggggctctcctctgctcccagaataaaagccaaagtctttatcttggccagcaaggccctgcccctaggggccycaagtaccggcctgtggctttgttgactgtgatgcagtcctttggcccgtggctgcctctgtctcaggaagccctccacaatgaccttggatcaggtcag

SEQ ID NO: 60301 - DNA, 201 bp, Homo sapiens
ttctcagactccatcctctccctgggccatgctcattgctcctgatttgtatctgcagagcaggcctctcttccaagctccagacacacacacacacgtcraacgcccgtcttatcttccctgcttatcccccaggcctgcaaactcagatgtctaaatgtgaactttttgtctcctcatcccagtaaatggcaccaccat

SEQ ID NO: 60302 - DNA, 201 bp, Homo sapiens
cttggtgttccttggctcgcagacgcatcactctagtcacatggctgtcttctccctgtgtcttcacatcatcatctctctaggtgtttttctctgtgttyaaattcttcttttcatgaagatgccagtcatattggattagggcccacactaatgacctcattttaacttgattacctctgtaaaaataagatcacattc

SEQ ID NO: 60303 - DNA, 201 bp, Homo sapiens
tagcttgcccacttctcaccagaccgtgtggtccagtggaagcctctctcctctcctcaccacgcaccctctttcgctcctccatccactcagccttcccsccttcatctccacccatctctcctggatgttgctcctcattcgtggaagtcctgtcaccaccctgggtgacttcagtagctgccagacagcctgtcccat

SEQ ID NO: 60304 - DNA, 201 bp, Homo sapiens; identical to SEQ ID NO: 29894

SEQ ID NO: 60305 - DNA, 201 bp, Homo sapiens
gcttgaaagccacctttgttattaaaggtctgtggtttctttttatggtaacctgagctgactaatacatataataactttttaactttttgaggaattaycaactttttcaaagcagctctaccattttgcattcctacctgcaaagtacaagggtccaagtttctctgcctcctcaccaatacttgttattgtttgtct

SEQ ID NO: 60306 - DNA, 201 bp, Homo sapiens
aggggtagagaggtgttctcctccagcatgcatgtcccagcctggtgggctgtctgcagcacctctcacaccgtcctgggtgtagtacctgctctgcgccrtggtccctcacctccaatttccctcctctccagtccaccctagcttgcccacttctcaccagaccgtgtggtccagtggaagcctctctcctctcctcac

SEQ ID NO: 60307 - DNA, 201 bp, Homo sapiens
tggtgcatgcctgtaatcccagctactcgggaggctgaggtaggagaattgcttgaacctgggaggtggaggttgcggtaaaccgaggtcgtgccattgcrttccaacatgggcaacaagagcgaaactccatctcaaaaaaaaaaaaaaaagaaaagaaaagaaaagggagagacaccacagctcactcactctttgtcc

SEQ ID NO: 60308 - DNA, 201 bp, Homo sapiens
gagtgagcccagtctagtgtggaggggtagagaggtgttctcctccagcatgcatgtcccagcctggtgggctgtctgcagcacctctcacaccgtcctgkgtgtagtacctgctctgcgccatggtccctcacctccaatttccctcctctccagtccaccctagcttgcccacttctcaccagaccgtgtggtccagtg

SEQ ID NO: 60309 - DNA, 201 bp, Homo sapiens
attatgttacctccagattcatgtgttaaaaccctaaaccccaatgtgactatatttggagagagtctctttaaggaggtaattaaggttaaatgagatayaagggtgggccctaatccattaggactggtatctctataagaaaagggagagacactacccggtgtggtggctcacgcctgtaatcccaggactttggga

SEQ ID NO: 60310 - DNA, 201 bp, Homo sapiens
gcttgcaggagggtgagcagagaaaggggataggaggaagacatagagcttgagtatggttcagagaagattctagtccttttgcaggcagcagaggcctyctgccatgtatcctccccttctccccagggccacactctgctgcaggcagagtcgcccagatgggtcccaggctgggcgggctggggagccacatctcag

SEQ ID NO: 60311 - DNA, 201 bp, Homo sapiens
gggaaaagacagaaatcttgtgtatgtatgtgtgtgggaggggcaggacagggagggcaattcataaagcagaaacctcccacccccagcagaaagaagcytgcaggagggtgagcagagaaaggggataggaggaagacatagagcttgagtatggttcagagaagattctagtccttttgcaggcagcagaggcctcct

SEQ ID NO: 60312 - DNA, 201 bp, Homo sapiens
ccatccctgggcacaggaagcaccttgatgattgtcaccgagtacatgagccatggggccctggacggcttcctcagggtgagtggccctggggctgccartgaccactttattctgtaaagcgggcaggggtccctcacttttctctttggtagggcttggaattggcatcatccccactggccgggctgacctgtggtc

SEQ ID NO: 60313 - DNA, 201 bp, Homo sapiens
gcatgcatcatcccggcccctccccccagctcactgttcatgtggcagccagcactgcagctagctcagctgctctgggatgaaggggatttagcgccttractcattaaatgtcagaaggcatcactgaggaaggaatcaagctccggctgctccagtgtgattagaattctccggaggagctcagaggcccccagcccc

SEQ ID NO: 60314 - DNA, 201 bp, Homo sapiens
aggcatctctgcccactttgcacacacgcagatttgcacctgcaagcacactgctgtacaaatgtaggcatgcatcatcccggcccctccccccagctcaytgttcatgtggcagccagcactgcagctagctcagctgctctgggatgaaggggatttagcgccttaactcattaaatgtcagaaggcatcactgaggaa

SEQ ID NO: 60315 - DNA, 201 bp, Homo sapiens; identical to SEQ ID NO: 29882

SEQ ID NO: 60316 - DNA, 201 bp, Homo sapiens
atgcctctcagtcagttccctagccccgcccacagcccgttagaccacgccccaggcctctctagtccggtcccacagccccgcacgccgcaccctcttcsccgcacccccagccctgccgtgaggtgggtcaaggtggagaatcccacgtaacttactttcagcgccctgggaggaggatgagatccgcagggaccgagt

SEQ ID NO: 60317 - DNA, 201 bp, Homo sapiens; identical to SEQ ID NO: 6120

SEQ ID NO: 60318 - DNA, 201 bp, Homo sapiens
tttgcaagaaagataagcgagtggtatggtttctgactcccttcctaatcgagcctatagggtcggcctgtcaccctgcatccctgctttctgtgatcccrcttctgtctttggcagtggtgttgccaagaagtctgaggctagggttattttcattcttttctacttaacttggacatatgacatgtacacgtatgcaca

SEQ ID NO: 60319 - DNA, 201 bp, Homo sapiens; identical to SEQ ID NO: 29891

SEQ ID NO: 60320 - DNA, 201 bp, Homo sapiens; identical to SEQ ID NO: 29892

SEQ ID NO: 60321 - DNA, 201 bp, Homo sapiens; identical to SEQ ID NO: 29893

SEQ ID NO: 60322 - DNA, 201 bp, Homo sapiens
caccccactagcggaccgtgccttctccaccttcccctcctttggctctgtgggcgcgtggctggaggccctggacctgtgccgctacaaggacagcttcrcggctgctggctatgggagcctggaggccgtggccgagatgactgcccagtgagtccaaggcaccgaggtcaaggccggggctgggggattccacaggcc

SEQ ID NO: 60323 - DNA, 201 bp, Homo sapiens; identical to SEQ ID NO: 29895

SEQ ID NO: 60324 - DNA, 201 bp, Homo sapiens; identical to SEQ ID NO: 29897

SEQ ID NO: 60325 - DNA, 201 bp, Homo sapiens
cttcaccatgttggccaggctggtctcaatctcttgacttcaggtgatctgccccctcggcctctccaagtgctgggattacaggcaagagccaccgcgcycagcctatatatcttttttgaagaaatgtctactcaagctggtctgagtgcagtattgtttacaactaactgatcacaaccagttatagatttctttgtt

SEQ ID NO: 60326 - DNA, 201 bp, Homo sapiens
cacgcggaagctgcctaaagaggtgtactttccaatctcagttcagtcttcagggccacttagtacttttcccattcctaatagttatgccaaaccttcasctctctcaagcacctcttctccatcctcactcccacctcagcagacaccctcattccttttcttcttaggcaggaactctctccactgctccctgtcacc

SEQ ID NO: 60327 - DNA, 201 bp, Homo sapiens
tgggcaccttgctgcacccacctgctagtccccagacttggacctttctcctccctgtgtcccacgcggaagctgcctaaagaggtgtactttccaatctyagttcagtcttcagggccacttagtacttttcccattcctaatagttatgccaaaccttcacctctctcaagcacctcttctccatcctcactcccacct

SEQ ID NO: 60328 - DNA, 201 bp, Homo sapiens
gcgcttgccaccatgaccagctaatatttttactttttgggggtctcactatgttgctcaggctggtttcgaactcctgggctcaggtgatccctccactyggcctgccaaagtgctgggatcacaggtttgagccactgccccccgccttccaaagcaggatctttttcttttttctttttttaaaaagagcgatggaat

SEQ ID NO: 60329 - DNA, 201 bp, Homo sapiens
agctgagaccacaggcgcttgccaccatgaccagctaatatttttactttttgggggtctcactatgttgctcaggctggtttcgaactcctgggctcagrtgatccctccactcggcctgccaaagtgctgggatcacaggtttgagccactgccccccgccttccaaagcaggatctttttcttttttctttttttaaa

SEQ ID NO: 60330 - DNA, 201 bp, Homo sapiens
ttccaggcttaagtggtcctcccacctcagcttcccaagtagctgagaccacaggcgcttgccaccatgaccagctaatatttttactttttgggggtctyactatgttgctcaggctggtttcgaactcctgggctcaggtgatccctccactcggcctgccaaagtgctgggatcacaggtttgagccactgccccccg

SEQ ID NO: 60331 - DNA, 201 bp, Homo sapiens
ggggtgacacatctcacatacgagtgtgaatccccaatcatcacacttgcaaactacaaaaggatcacatttttaaaaattcagtatagaagaagaaaaaacccataatcttattacatagataaaaacaactattaatatcttagagtatatacgtccagaaaatttttcctgtctatcttgatctctgtattcatattt

SEQ ID NO: 60332 - DNA, 201 bp, Homo sapiens
caactctcaacctcatgatctgctggcctcaggcttccaaagtgctgggattacagacgtgagccactgcgcgcctagccagactttctttttttttttttgaaatggagttttgctcgtcacccaggctggagtgtggtggtgtgatcacagttcatggcaacctctgcctcctgggttcaagtgattctcctgcctcag

SEQ ID NO: 60333 - DNA, 201 bp, Homo sapiens
ccccagtggtggaggccccattcctcaggctcatctctttctctcccagtcaaagtcccaacacgtcgcacattcctggacccccagagctgtggggaccygctgcaggctgtgcatctgttcgccaaggaactggatgcgaaaagcgtcacgctggagaggagccttggaggaggcaagctgggcgcccaggaagccttg

SEQ ID NO: 60334 - DNA, 201 bp, Homo sapiens
ggctggagtgtagtggcacaatcacagctccctgcagcctcaactttccaggcttaagtggtcctcccacctcagcttcccaagtagctgagaccacaggygcttgccaccatgaccagctaatatttttactttttgggggtctcactatgttgctcaggctggtttcgaactcctgggctcaggtgatccctccactcg

SEQ ID NO: 60335 - DNA, 201 bp, Homo sapiens
cattgggtacctctcagatagtagagactgctgagatccccagtctcccttcttgtggccctggctatggttctcccaatctgcagagtgtggtttcccaygagctgtgtctccaaattgagatttttttttttttttgaggtagggtcttactgtgtcacccaggctggagtgtagtggcacaatcacagctccctgcag

SEQ ID NO: 60336 - DNA, 201 bp, Homo sapiens
cgcccccgtctctgacccttcccggggcaagcccctcctcccgctcgcccctgctcccactcacccctgctcccgctcgcccctgctcccgcttgccccgtgctcatccgccctcgacccctcactgactgaccatctctgtaccaatctccctgactgaaccccacgcccccattcctcccaccccagacccctcacacc

SEQ ID NO: 60337 - DNA, 201 bp, Homo sapiens
ctcgcctgaatgcaaaaagtgtcagacctcggccaggtgctggaaagagaagattatagctggggatcatttgaatgtgtacagatgggcagggaggcatkctggggagaggaagctatctgaacaaaggcgggcaggtttggctggagtgggcgtagtgggggcaggagctggggaccgtcagtggagaagggctgatgg

SEQ ID NO: 60338 - DNA, 201 bp, Homo sapiens
gcagaggtggtgctattctcagctacaagtgccaccgagtgtgggtgggtgcttgtggtgaagacaggggctaaggatccaaggaaaagatccctgggaamccccaagatgattgaggttgggttttcgcactcagcccacattcacgtaagggcgcttctcctgcctccctgttcctgttcaccctttgttctcctagaa

SEQ ID NO: 60339 - DNA, 201 bp, Homo sapiens; identical to SEQ ID NO: 29887

SEQ ID NO: 60340 - DNA, 201 bp, Homo sapiens; identical to SEQ ID NO: 29861

SEQ ID NO: 60341 - DNA, 201 bp, Homo sapiens; identical to SEQ ID NO: 6115

SEQ ID NO: 60342 - DNA, 201 bp, Homo sapiens; identical to SEQ ID NO: 29866

SEQ ID NO: 60343 - DNA, 201 bp, Homo sapiens; identical to SEQ ID NO: 29867

SEQ ID NO: 60344 - DNA, 201 bp, Homo sapiens; identical to SEQ ID NO: 29868

SEQ ID NO: 60345 - DNA, 201 bp, Homo sapiens
tggcctgttagaaaacattgagtcttcagccagttagacagtcaaaaaaaaaaaaaaaagtgaataagtgaggagagaactggctgtctaggaacagaaaygtggcatctggatggagctaatacaggacagtggcttgcacatagtagtagatcctccaagcaatgttgttgattgattgacacagcaagcaagactggg

SEQ ID NO: 60346 - DNA, 201 bp, Homo sapiens; identical to SEQ ID NO: 29870

SEQ ID NO: 60347 - DNA, 201 bp, Homo sapiens
ggcattttacattaacaatctttttttttttttgagacggagtcttgctctatcacccaggctggaatgcaatggctcagtcttggctcactgcaacctcygcctcctgggttgaagcgactctcctgcctcagcctcctgagtagctggtattacaggcacacaccaccacaaccggctaatttttgtatttttagtaga

SEQ ID NO: 60348 - DNA, 201 bp, Homo sapiens
atggggtcgcaccatattggccaggctggtgtcaaactcctgacctcaagtcatctacccgccttggcctcccaaagtgctgggattacaggcatgagccmcctcatgccaggctgaaaataatcatttaaccaatatggatttcttttttttttttctttttctttttctttctttctttcttttttttttttttttttg

SEQ ID NO: 60349 - DNA, 201 bp, Homo sapiens
tcaagtgattctcctgcctcagcctcccgagtagctgggattacaggtgcgcaccaccacacccagctaagttttgtatttttagtagagatggggtcgcmccatattggccaggctggtgtcaaactcctgacctcaagtcatctacccgccttggcctcccaaagtgctgggattacaggcatgagccacctcatgcca

SEQ ID NO: 60350 - DNA, 201 bp, Homo sapiens; identical to SEQ ID NO: 29874

SEQ ID NO: 60351 - DNA, 201 bp, Homo sapiens
gcctggtcctctgcctgcctcaacctcgtgattttcctcccagctgcctcagggtccagggaccagagccccgccattgtcgtcaccgtagtgaccatctyggccctcctcgtcctgggctccgtgatgagtgtgctggccatttggaggaggtaggtggctggccccagcctaggtgactcctggtgggtcatgtcccgt

SEQ ID NO: 60352 - DNA, 201 bp, Homo sapiens
gctcattctctcattctgtcctttgaggcttcaggcctgcctagggcactggctcagcttagcctggatggacaggccctggtggccctcatcctatcatsccccggaaggaggatctggtgtcttctctaaaatttctcttatgcagaggtggtgctattctcagctacaagtgccaccgagtgtgggtgggtgcttgtg

SEQ ID NO: 60353 - DNA, 201 bp, Homo sapiens
tgagccttgcaggacagttgtgaaaaatcagacatcgaggaaaggaaaagccttgtgggccattgggggctttcatgtgtcagggctcattctctcattcygtcctttgaggcttcaggcctgcctagggcactggctcagcttagcctggatggacaggccctggtggccctcatcctatcatcccccggaaggaggatc

SEQ ID NO: 60354 - DNA, 201 bp, Homo sapiens
cacgcccccgtctctgacccttcccggggcaagcccctcctcccgctcgcccctgctcccactcacccctgctcccgctcgcccctgctcccgcttgccctgggctcatccgccctcgacccctcactgactgaccatctctgtaccaatctccctgactgaaccccacgcccccattcctcccaccccagacccctcaca

SEQ ID NO: 60355 - DNA, 201 bp, Homo sapiens
gcccccacgcccccgtctctgacccttcccggggcaagcccctcctcccgctcgcccctgctcccactcacccctgctcccgctcgcccctgctcccgctcgccccgggctcatccgccctcgacccctcactgactgaccatctctgtaccaatctccctgactgaaccccacgcccccattcctcccaccccagacccc

SEQ ID NO: 60356 - DNA, 201 bp, Homo sapiens
gattcaatgaattaatagacgtaatttaaaaaataataaatagagacggggtttggccatgttgtccaggctggtctccaactcctgggctcaagtgatcctccagctttggccttccaaagtgctgggattacaggcatgagccaccgcgcccggctgaaagtaaaatgtttcaaagttttccgaacacacagcgttttc

SEQ ID NO: 60357 - DNA, 201 bp, Homo sapiens
ggctcagtcttggctcactgcaacctccgcctcctgggttgaagcgactctcctgcctcagcctcctgagtagctggtattacaggcacacaccaccacawccggctaatttttgtatttttagtagagccccgcgtttcgccatgttggccaggctggtctcgaactcttgacgtcaggtgatccacccgcctcagcctc

SEQ ID NO: 60358 - DNA, 201 bp, Homo sapiens
agaacttcactcactcctcaatgacatgagggactcctttgctgaaaatagtttttgaatactggaagtctgttgagacctgtgagtgttggggatgagtrggaaggaggagagagtcctgagtcactgctgggtgtctgacctgggtaacccagagtctgaggtaccactgactgagatggagaagcactgaggtggaag

SEQ ID NO: 60359 - DNA, 201 bp, Homo sapiens
acatgatctcggctcactgcaacctccgtctcccaggttcaagtgattctcctgcttcagcctcccaagtagctgggattacaggcatgcacaactacacmcagctcatttttgtatttttagtagagacgaggtttcatcgtgttggccaggctggtctatatctcctgacctcaggtgatccacccgccttagcctccc

SEQ ID NO: 60360 - DNA, 201 bp, Homo sapiens
acttttactggcccttctctctccacccacccccctccacctggctggctttacttccagttgggaatttatgacacactcactcacatgatggtggtgggagggtgtgtgtgtgtgtgtgcatgtatgcttgtgtgtctgtccctgcgtaactgtggaacagctcttggggcacctctcctcccctctctttctcacacc

SEQ ID NO: 60361 - DNA, 201 bp, Homo sapiens
ctccacctcccgggttcaactgatcttcttcctcagcctcccaagtagctgggattacaggcatgtaccaccatgcctggctaattttgcatttctttagyagagacagggtttcaccatttgatcaggctggtctcgaactcctggcctcaagtggtccacctgcctcgacctgacgtcaagtgatccacctgcccggct

SEQ ID NO: 60362 - DNA, 201 bp, Homo sapiens
aacttttactggcccttctctctccacccacccccctccacctggctggctttacttccagttgggaatttatgacacactcactcacatgatggtggtgtgagggtgtgtgtgtgtgtgtgcatgtatgcttgtgtgtctgtccctgcgtaactgtggaacagctcttggggcacctctcctcccctctctttctcacac

SEQ ID NO: 60363 - DNA, 201 bp, Homo sapiens
cctccacctcccgggttcaactgatcttcttcctcagcctcccaagtagctgggattacaggcatgtaccaccatgcctggctaattttgcatttctttakcagagacagggtttcaccatttgatcaggctggtctcgaactcctggcctcaagtggtccacctgcctcgacctgacgtcaagtgatccacctgcccggc

SEQ ID NO: 60364 - DNA, 201 bp, Homo sapiens
accatgttggccaggatggtctcaatctctttttttttttttttttttttttgagacagaattttgcttttgttgcccaggctggagtgcaatggcacgayctcagctcactgcaacctccacctcccgggttcaactgatcttcttcctcagcctcccaagtagctgggattacaggcatgtaccaccatgcctggctaa

SEQ ID NO: 60365 - DNA, 201 bp, Homo sapiens
ctgagaagcgcccccgggggatagggaagagcactcttcctcgaaagcagctctgcagtagagtgctggctgtgcattgtccacttgacaaagacttggctttttttttttttttaaagggtcagacactgaagggaggaataaaggatttttttgagttatttttagaatgggaggcaatgccactctgtgggcagtgta

SEQ ID NO: 60366 - DNA, 201 bp, Homo sapiens
tccagtgtcatgaatcttttcccctgtgttttcttctaggagttttatcatttcagatcctacatttaggtctttaatccactttgagttcattttttgcmtatgattttaggtgagggtccaacttcattcatttgcaggtggatatccacttttctcagtgccatttggtgaagagactatcctttctgcatagcataa

SEQ ID NO: 60367 - DNA, 201 bp, Homo sapiens
tctcctttggccatgcctctcagtcagttccctagccccgcccacagcccgttagaccacgccccaggcctctctagtccggtcccacagccccgcacgcygcaccctcttccccgcacccccagccctgccgtgaggtgggtcaaggtggagaatcccacgtaacttactttcagcgccctgggaggaggatgagatccg

SEQ ID NO: 60368 - DNA, 201 bp, Homo sapiens
gttcaagtgattctcctgcctcagcctcccgagtagctgggattacaggtgcgcaccaccacacccagctaagttttgtatttttagtagagatggggtckcaccatattggccaggctggtgtcaaactcctgacctcaagtcatctacccgccttggcctcccaaagtgctgggattacaggcatgagccacctcatgc

SEQ ID NO: 60369 - DNA, 201 bp, Homo sapiens
gggtttcaccatgttggccaggatggtctccaactctcaacctcatgatctgctggcctcaggcttccaaagtgctgggattacagacgtgagccactgcrcgcctagccagactttctttttttttttttgaaatggagttttgctcgtcacccaggctggagtgtggtggtgtgatcacagttcatggcaacctctgcc

SEQ ID NO: 60370 - DNA, 201 bp, Homo sapiens
acgcccccgtctctgacccttcccggggcaagcccctcctcccgctcgcccctgctcccactcacccctgctcccgctcgcccctgctcccgcttgcccccggctcatccgccctcgacccctcactgactgaccatctctgtaccaatctccctgactgaaccccacgcccccattcctcccaccccagacccctcacac

SEQ ID NO: 60371 - DNA, 201 bp, Homo sapiens; identical to SEQ ID NO: 6118

SEQ ID NO: 60372 - DNA, 201 bp, Homo sapiens; identical to SEQ ID NO: 29899

SEQ ID NO: 60373 - DNA, 201 bp, Homo sapiens; identical to SEQ ID NO: 29901

SEQ ID NO: 60374 - DNA, 201 bp, Homo sapiens; identical to SEQ ID NO: 29904

SEQ ID NO: 60375 - DNA, 201 bp, Homo sapiens; identical to SEQ ID NO: 29849

SEQ ID NO: 60376 - DNA, 201 bp, Homo sapiens; identical to SEQ ID NO: 29851

SEQ ID NO: 60377 - DNA, 201 bp, Homo sapiens
ctttgggggaaaaaatcagggcatataacaagtagctttaattctctgctagggccaggtgcagtggctcacacctgtaatcccagcaatttgggaggctraggcaggaggattgcttgagccaggagttcaagatcagcctgggcaacacagggagatcccatctctccacacacaaaaaattagccaggcatggttgca

SEQ ID NO: 60378 - DNA, 201 bp, Homo sapiens; identical to SEQ ID NO: 29854

SEQ ID NO: 60379 - DNA, 201 bp, Homo sapiens
agaagtatagaagtttgccaggagaaaaaggatataaggaattacagaacaagacccagaggtgtgaaaggatgagctcagtgtaccatggttagagtggytggcagtggggagctgttggaggacattaggaagggaagggaaatgattggatttgcatttagaaagttaaggccttccaagtgccttctgcagctaaca

SEQ ID NO: 60380 - DNA, 201 bp, Homo sapiens
ggggtttggagaagtatagaagtttgccaggagaaaaaggatataaggaattacagaacaagacccagaggtgtgaaaggatgagctcagtgtaccatggktagagtggctggcagtggggagctgttggaggacattaggaagggaagggaaatgattggatttgcatttagaaagttaaggccttccaagtgccttctg

SEQ ID NO: 60381 - DNA, 201 bp, Homo sapiens
ggtgtcacacaacaccaggggatccaagcgcacagccctggcctcagtcttctccctccacagcggcacgaggggcagctggtcgctgggcaactgatggrgttgctgcctgggctggcatcagccatgaagtatctgtcagagatgggctacgttcaccggggcctggcagctcgccatgtgctggtcagcagcgacctt

SEQ ID NO: 60382 - DNA, 201 bp, Homo sapiens
tcagagtgagcagacttactccatggtgaagacaggggcgcccacagtcaccgtcaccaacctgaagccggctacccgctacgtctttcagatccgggccrcttccccggggccatcctgggaggcccagagttttaaccccagcattgaagtacagaccctgggggagggtaagtagtgtgtgtgagtggacagggacct

SEQ ID NO: 60383 - DNA, 201 bp, Homo sapiens
ttgatttccctgatgattaatgatattaagcatcttttcatgtgcttcttggccttttgtatatctttttttttgagacagagtctcactctgttgcccasgctggagtgcagtggtgcgatctcagctcactgcaacctctgcctcccaggttcaaacaattcttgtgcctcagcctctggagtagctgggattacagat

SEQ ID NO: 60384 - DNA, 201 bp, Homo sapiens
tttcaaagagtttgactactttagatacctcacataagtggaatcatgcagtatttgtctttttgtgacgaattgtttcacttagcatagtgtcttcgagkttcattcatattgtagcatataacagaattttcttctttttaaggactaatatcctgttgtatgtttacaccatatattcttttttcttttctttttttt

SEQ ID NO: 60385 - DNA, 201 bp, Homo sapiens
tttcctttatttttatttatttattttttttgagactgggtcttgctgtattgcttaggctggagtgcagtggcagccttgaccttctggtcttgggcaakcctcctgtctcagcctcccacgtgtctgggaccacaggtgtgtgacaccatgcccagctaattgtttgattttttgtagagacagggtctcactttgttg

SEQ ID NO: 60386 - DNA, 201 bp, Homo sapiens; identical to SEQ ID NO: 29886

SEQ ID NO: 60387 - DNA, 201 bp, Homo sapiens
gggaagtggagcttgcagtgagccgagatcccgcccctgctctccagcctgggtgacagagtgagactctgtctcaaaaaataaacaaataaataaataartaataaaataaaataaaagcaactaatccctgagctccagcctacagagatgatgatttgtttgctctgggttgtgacctgggcaacattttttttactg

SEQ ID NO: 60388 - DNA, 201 bp, Homo sapiens
tttgggaggccggggtgggcggatcatgaggtcaggagatggagaccatcctggctaacatggtgaaaccccgtctctactaaaaatacaaaaaattagcygggcgtggtggcgggcacctgtagtcccagctactcgggaggctgaggcaggagaatggcgtgaacctgggaagtggagcttgcagtgagccgagatccc

SEQ ID NO: 60389 - DNA, 201 bp, Homo sapiens
gaagggaggaataaaggatttttttgagttatttttagaatgggaggcaatgccactctgtgggcagtgtagcctaggggttcattacaattgcacttttkgatctagtcccactgccttgatcataagtagaaatgtgccactctactctccagcccccattctggcgatcagctgtcaagactagtttatggtgatggt

SEQ ID NO: 60390 - DNA, 201 bp, Homo sapiens
ccatctctgccccatctgtattcgcaaggaactttgccacctcctagaatgcttcatcactcctctcgcctttgtgctcaggccttttctgggagctgccrtctcaaagtgaattttggctgagaagcgcccccgggggatagggaagagcactcttcctcgaaagcagctctgcagtagagtgctggctgtgcattgtcc

SEQ ID NO: 60391 - DNA, 201 bp, Homo sapiens
ggggacaaggctgttgactaggtttccagtactatctgctgtaactttggccccacttgggtgctggctgattcccatcccaaatctacagctggagagcmggtgcttggtgttagtttttagctccactagcaggatttatcaggctttcatctaattatctcttcggagctgagatggaaccatcttctacctctctat

SEQ ID NO: 60392 - DNA, 201 bp, Homo sapiens
ggcccccacgcccccgtctctgacccttcccggggcaagcccctcctcccgctcgcccctgctcccactcacccctgctcccgctcgcccctgctcccgcctgccccgggctcatccgccctcgacccctcactgactgaccatctctgtaccaatctccctgactgaaccccacgcccccattcctcccaccccagaccc

SEQ ID NO: 60393 - DNA, 201 bp, Homo sapiens
tggggagtggggagctggggacaatgccaaggaaagcttcacaagggagatgttatttgaactggggtttggagaagtatagaagtttgccaggagaaaarggatataaggaattacagaacaagacccagaggtgtgaaaggatgagctcagtgtaccatggttagagtggctggcagtggggagctgttggaggacatt

SEQ ID NO: 60394 - DNA, 201 bp, Homo sapiens; identical to SEQ ID NO: 29865

SEQ ID NO: 60395 - DNA, 201 bp, Homo sapiens; identical to SEQ ID NO: 29871

SEQ ID NO: 60396 - DNA, 201 bp, Homo sapiens; identical to SEQ ID NO: 29872

SEQ ID NO: 60397 - DNA, 201 bp, Homo sapiens; identical to SEQ ID NO: 29855

SEQ ID NO: 60398 - DNA, 201 bp, Homo sapiens
ttagttatgaggttttcagctgcaagtaacaataaatctcagtctaactgattttattttattattattattatattattattattagagacaaggtcttrctctgtcactcaggctggagtgcagtggcatgatcataggctcactgtaacctcaaactcctggggtcaggtgatcctcccgcctgagcctcccaagtgg

SEQ ID NO: 60399 - DNA, 201 bp, Homo sapiens; identical to SEQ ID NO: 29878

SEQ ID NO: 60400 - DNA, 201 bp, Homo sapiens; identical to SEQ ID NO: 29880

SEQ ID NO: 60401 - DNA, 201 bp, Homo sapiens
tatggcaaaggaggaggggatgcccatgatgaagaggagctgtatttccactgtgagttggctgggcctggctggggaggggcgggctccaccctgcctcrctcctcagccctctgccttgctacactgcatgagcccgcttgtcagccccagtggtggaggccccattcctcaggctcatctctttctctcccagtcaaa

SEQ ID NO: 60402 - DNA, 201 bp, Homo sapiens; identical to SEQ ID NO: 29881

SEQ ID NO: 60403 - DNA, 201 bp, Homo sapiens
ggaggctgtgttttctttcttcttaaagtgccagagcgttttacttactctctatcatattaaatcacttttcaagatctacttctcctgagtcttcagartaatgttcctattctcttattctgaaatattttttcatatacccaatttctggtattttctgtttacttgttcttgagtaaggaaatagctggtgtttgt

SEQ ID NO: 60404 - DNA, 201 bp, Homo sapiens
acttttagtttcttcacccagcccttctcagtttctccatttttatctcatctcgtttctttttcttctccacctgttttctccttatgaccttctgtacmtagttggtggaggctgtgttttctttcttcttaaagtgccagagcgttttacttactctctatcatattaaatcacttttcaagatctacttctcctgag

SEQ ID NO: 60405 - DNA, 201 bp, Homo sapiens
gaacactgtactgaaagtgcaaaaatagaatggttgtattgcttttacaccatggtaaaacaatcatcagttaaaccatcacgagttattattcagttgcrgttccttcttattttttacttgatgttccaaagactgagaggggttcattttgcattctgtttgtgattttgttaaaattccttgtatttgtaatgaatt

SEQ ID NO: 60406 - DNA, 201 bp, Homo sapiens
tgaacactgtactgaaagtgcaaaaatagaatggttgtattgcttttacaccatggtaaaacaatcatcagttaaaccatcacgagttattattcagttgyagttccttcttattttttacttgatgttccaaagactgagaggggttcattttgcattctgtttgtgattttgttaaaattccttgtatttgtaatgaat

SEQ ID NO: 60407 - DNA, 201 bp, Homo sapiens
gtcaaaaatgcatttaatgcacctagcctgccagatatcataccttagcctagcctactttaaacatgcccagaacacttacattagcctacaggtgggcraaatcacctattttacaatgagtattttacactgagtatctcatgtaatttattgaacactgtactgaaagtgcaaaaatagaatggttgtattgctttt

SEQ ID NO: 60408 - DNA, 201 bp, Homo sapiens
tggcagccttgaccttctggtcttgggcaatcctcctgtctcagcctcccacgtgtctgggaccacaggtgtgtgacaccatgcccagctaattgtttgattttttgtagagacagggtctcactttgttgtccaggctggtgttgaactcctgggctcaagcgatcctcccaccctggccctcccaaagtgctgagatta

SEQ ID NO: 60409 - DNA, 201 bp, Homo sapiens
tttttgtatttttagttgagacagttttaccatgttggccaggctggtctcgaactcctgacctcgtgatccacccgcctcagcctcccaaagggctgggwttacaggagtgaaccactgtgcccggccaaaagcttttaattttgatgaagtcaaatttatttatttcttctttggttgcttgtgcttttggtgtcatcg

SEQ ID NO: 60410 - DNA, 201 bp, Homo sapiens
aggtgcacaccaccacatccagctatttttttttttttagatgggctggagtgcagtggcatgatctctgctcactgcaacctgtgcctcctgggttcaartggttctcctgcctcagcctcccgagtagctgggattacaggcacacactgacgcacccagctaatttttttttttttttgtatttttagttgagacagt

SEQ ID NO: 60411 - DNA, 201 bp, Homo sapiens
gatccacctaccttggccacccaaaatgctgagattacaggtatgagccaccatgcctggcttgaaagccacctttgttattaaaggtctgtggtttcttkttatggtaacctgagctgactaatacatataataactttttaactttttgaggaattaccaactttttcaaagcagctctaccattttgcattcctacct

SEQ ID NO: 60412 - DNA, 201 bp, Homo sapiens
tgtggggacctgctgcaggctgtgcatctgttcgccaaggaactggatgcgaaaagcgtcacgctggagaggagccttggaggaggcaagctgggcgcccrggaagccttgtccccatctggaagcctcacccactctataggccccgcccctactctgtccacacctctatcctgaagcccacctccacccaggtctctg

SEQ ID NO: 60413 - DNA, 201 bp, Homo sapiens; identical to SEQ ID NO: 29900

SEQ ID NO: 60414 - DNA, 201 bp, Homo sapiens; identical to SEQ ID NO: 29902

SEQ ID NO: 60415 - DNA, 201 bp, Homo sapiens
aaaagaaaagtactaaaattagctgggcatgatggcatccgcctggagtcccagctacttaggagattgaggtgtgaagatcactcaagtccaggaggcaraggttgcagtgagctgtgatcatgccactgaactccagcctgggtgacggaatgagaccttgtctcaaaaaataaaaaataaaaaatttaaaaaaattaa

SEQ ID NO: 60416 - DNA, 201 bp, Homo sapiens
cccagctacttaggagattgaggtgtgaagatcactcaagtccaggaggcaaaggttgcagtgagctgtgatcatgccactgaactccagcctgggtgacrgaatgagaccttgtctcaaaaaataaaaaataaaaaatttaaaaaaattaaaaaaaaccccaaaacaaaaatccaatctgggctggccatggtggttctc

SEQ ID NO: 60417 - DNA, 201 bp, Homo sapiens
actcaagctggtctgagtgcagtattgtttacaactaactgatcacaaccagttatagatttctttgttcatctccactcccactgcctcgcttgatagcaaaaaaaaaaaaaaaaaaaaaaaaaaagcctacagttatttggtctttgttgttgagttctagacattctttatacattctggatattaaccccttagata

SEQ ID NO: 60418 - DNA, 201 bp, Homo sapiens
ttattattattattatattattattattagagacaaggtcttactctgtcactcaggctggagtgcagtggcatgatcataggctcactgtaacctcaaaytcctggggtcaggtgatcctcccgcctgagcctcccaagtggctaggactgcaggcatgccaacatgcctagctaacttttttttctttttaaattgttt

SEQ ID NO: 60419 - DNA, 201 bp, Homo sapiens
ctaacatggcgaaacccagtctctattgaaaaaacaaaaattagccagacatggtggtgggtgcctgtaatcccagctactcaggaggctgaggcagggaraattgcttgaacccaggaggtggaggttgcagtgagccgagattgcaccacactgcattccagcctaggtgacacagcaagactctgcctcaaaaaaaaa

SEQ ID NO: 60420 - DNA, 201 bp, Homo sapiens
gcccagcttgggtcaaagtccgtcccagttcctgaatgctatggtcagaaagctggagccaccgaatatcagtggggagaataactttctggggctgtggrtatggcagggcctctaataaggtgtgggcagggacgaaacgacgggaggagcatctctagtatgccattgtcaggtgtgttggggtggagcggggggcag

SEQ ID NO: 60421 - DNA, 201 bp, Homo sapiens
ggggctttcatgtgtcagggctcattctctcattctgtcctttgaggcttcaggcctgcctagggcactggctcagcttagcctggatggacaggccctgrtggccctcatcctatcatcccccggaaggaggatctggtgtcttctctaaaatttctcttatgcagaggtggtgctattctcagctacaagtgccaccga

SEQ ID NO: 60422 - DNA, 201 bp, Homo sapiens
caggtgatccacctaccttggccacccaaaatgctgagattacaggtatgagccaccatgcctggcttgaaagccacctttgttattaaaggtctgtggtytctttttatggtaacctgagctgactaatacatataataactttttaactttttgaggaattaccaactttttcaaagcagctctaccattttgcattcc

SEQ ID NO: 60423 - DNA, 201 bp, Homo sapiens; identical to SEQ ID NO: 6117

SEQ ID NO: 60424 - DNA, 201 bp, Homo sapiens
aatcttcctgcctcaggcccctcttctctgtctgcttgcttctggttctgcctggccactgccccaggcttccttgggtgtgtgtgtgtgtgtctgtgtcygtgtgtgcgcatgtgtgtgtgtgtgtctgtgtctgtgtgtgtgcatgtgtgtgtgcacacaccatatgctggggaaacccagagcctcctctctgctccc

SEQ ID NO: 60425 - DNA, 201 bp, Homo sapiens
ctgtggaggatggcttccggctgccaccccccaggaactgtcctaaccttctgcaccgactaatgctcgactgctggcagaaggacccaggtgagcggccyaggttctcccagatccacagcatcctgagcaagatggtgcaggacccagagccccccaagtgtgccctgactacctgtcccaggtacgttcccacatggg

SEQ ID NO: 60426 - DNA, 201 bp, Homo sapiens
tggagtgcagtggtgcgatctcagctcactgcaacctccgcttcccaggttcaagcaattctcaagcctcagcttgccaagtagctgggattataggtgcrtgccaccacgcctggctaatatttgtattttttagcagagacagggtttccccatattggccaggttggtttcaaactcctggcctcaggtgatccacct

SEQ ID NO: 60427 - DNA, 201 bp, Homo sapiens
tggaggttgcggtaaaccgaggtcgtgccattgcgttccaacatgggcaacaagagcgaaactccatctcaaaaaaaaaaaaaaaagaaaagaaaagaaawgggagagacaccacagctcactcactctttgtccatatgtgcacagaggaaaggccacgtgagaatacagtgggaaggtggctggtcaggaaaacagctc

SEQ ID NO: 60428 - DNA, 201 bp, Homo sapiens
ctgcctcactcctcagccctctgccttgctacactgcatgagcccgcttgtcagccccagtggtggaggccccattcctcaggctcatctctttctctccyagtcaaagtcccaacacgtcgcacattcctggacccccagagctgtggggacctgctgcaggctgtgcatctgttcgccaaggaactggatgcgaaaagc

SEQ ID NO: 60429 - DNA, 201 bp, Homo sapiens
aagtgctgggattacaggcgtgaggcactgcacctggtggtttgatatttttaatctttactgtaacgtcttgatcagttttataaatttgtgctttcctmgaaaatattttggtgttctttttctaatttattattagaaatgtatatacatttcctcagtacctggagttaacttcactttctctttcttcctgttgta

SEQ ID NO: 60430 - DNA, 201 bp, Homo sapiens
tgcttgcttctggttctgcctggccactgccccaggcttccttgggtgtgtgtgtgtgtgtctgtgtctgtgtgtgcgcatgtgtgtgtgtgtgtctgtgbctgtgtgtgtgcatgtgtgtgtgcacacaccatatgctggggaaacccagagcctcctctctgctccccacccctgtggcccaggtgatcaaggctgtgg

SEQ ID NO: 60431 - DNA, 201 bp, Homo sapiens
attggttttggaacccaggtctgtctgacctcaaagccctgtgcctttaatccctaggccatataatgcttcattgaactttttctaaaaatcagaaatgratgttaattttataaaatgcttattaagcattttcaatatgaccaaattttttcctttttgacctgtcggtatgatgaattctattaatggatatttcag

SEQ ID NO: 60432 - DNA, 201 bp, Homo sapiens
ggccctggacctgtgccgctacaaggacagcttcgcggctgctggctatgggagcctggaggccgtggccgagatgactgcccagtgagtccaaggcaccraggtcaaggccggggctgggggattccacaggccctgcccctgcctatactggggagtcccaacctgtccagagaagcggagggagagtggagggccttc

SEQ ID NO: 60433 - DNA, 201 bp, Homo sapiens
tagggctacggttgtatctgtgccatggggaggtcgtcaaaccacagagaagcttttaaaccagctggacaagaagttccctcccccagggcacaggcctkgtcttttgaagggacaaagaggtgctgccctcagtgctctgtaatgggaagggccggggtggcctggctgaaagaatgaccctgaactccctgccaggcc

SEQ ID NO: 60434 - DNA, 201 bp, Homo sapiens
tcagctggcctctccccgggagaccaccaggtgtgggcccagatcccagctgtcggttgagcacagctcctctgacccgcaggcctcccaccccactagcsgaccgtgccttctccaccttcccctcctttggctctgtgggcgcgtggctggaggccctggacctgtgccgctacaaggacagcttcgcggctgctggct

SEQ ID NO: 60435 - DNA, 201 bp, Homo sapiens
acttttctctttggtagggcttggaattggcatcatccccactggccgggctgacctgtggtcacagggtgaactaaagcctggtgagagctaggtgaccrccctggtgtcacacaacaccaggggatccaagcgcacagccctggcctcagtcttctccctccacagcggcacgaggggcagctggtcgctgggcaactg

SEQ ID NO: 60436 - DNA, 201 bp, Homo sapiens
gcaattgttcaccccattgccccagagggctgtagcctgcctgcctgcccaggcccacctcactgcacatcctcctggtcacttctgcttctcctggattktgcccacatccccgggtacaatgacctttgactggagaaatagatgtggtaatagccctaacacatttgtagttccaatgaatcaaatatgtgaaattaa

SEQ ID NO: 60437 - DNA, 201 bp, Homo sapiens
tgccccaggcttccttgggtgtgtgtgtgtgtgtctgtgtctgtgtgtgcgcatgtgtgtgtgtgtgtctgtgtctgtgtgtgtgcatgtgtgtgtgcacrcaccatatgctggggaaacccagagcctcctctctgctccccacccctgtggcccaggtgatcaaggctgtggaggatggcttccggctgccacccccca

SEQ ID NO: 60438 - DNA, 201 bp, Homo sapiens
cccgttggccctcaatcttcctgcctcaggcccctcttctctgtctgcttgcttctggttctgcctggccactgccccaggcttccttgggtgtgtgtgtstgtgtctgtgtctgtgtgtgcgcatgtgtgtgtgtgtgtctgtgtctgtgtgtgtgcatgtgtgtgtgcacacaccatatgctggggaaacccagagcct

SEQ ID NO: 60439 - DNA, 201 bp, Homo sapiens
cctgcctgcccctacagagtggccggagcccagcgctatgggccgctcccgagacacttcagtttggccacttcagctctgccagtgacgtgtggagcttyggcatcatcatgtgggaggtgatggcctttggggagcggccttactgggacatgtctggccaagacgtgagtaacccgtggctccagctgcatgccttct

SEQ ID NO: 60440 - DNA, 201 bp, Homo sapiens
tgtccatcctcagctggcctctccccgggagaccaccaggtgtgggcccagatcccagctgtcggttgagcacagctcctctgacccgcaggcctcccacyccactagcggaccgtgccttctccaccttcccctcctttggctctgtgggcgcgtggctggaggccctggacctgtgccgctacaaggacagcttcgcgg

SEQ ID NO: 60441 - DNA, 201 bp, Homo sapiens
gagttggctgggcctggctggggaggggcgggctccaccctgcctcactcctcagccctctgccttgctacactgcatgagcccgcttgtcagccccagtrgtggaggccccattcctcaggctcatctctttctctcccagtcaaagtcccaacacgtcgcacattcctggacccccagagctgtggggacctgctgcag

SEQ ID NO: 60442 - DNA, 201 bp, Homo sapiens
gatgacatgcaggctggatctggggctcagtggggtggggaaacctgcgtgtcacccagttcctccttgcccctgacctgcctgcccctacagagtggccrgagcccagcgctatgggccgctcccgagacacttcagtttggccacttcagctctgccagtgacgtgtggagcttcggcatcatcatgtgggaggtgatg

SEQ ID NO: 60443 - DNA, 201 bp, Homo sapiens
cagcctaattaattaatgactttgaaatccactgactaatgcctgttcaccgacgtgaattagattgggaaactgtcctggaggagctcacaggagagggrtttgtgaacagctataacccatgtctcagctggatagagactcagtttggatagagacccaaacatgggacactgtccctttccccactaggccttagag

SEQ ID NO: 60444 - DNA, 201 bp, Homo sapiens
attcctcaggctcatctctttctctcccagtcaaagtcccaacacgtcgcacattcctggacccccagagctgtggggacctgctgcaggctgtgcatctrttcgccaaggaactggatgcgaaaagcgtcacgctggagaggagccttggaggaggcaagctgggcgcccaggaagccttgtccccatctggaagcctca

SEQ ID NO: 60445 - DNA, 201 bp, Homo sapiens
aagggctatatttgaaaggcttcagtgtactctcatggagcctgctgagtagaagccttgctgggccactggacctgggcgggtgtctggcagctcccctytggagccacagtgctgctcatctcaacctctctctgcacaccagtccagcccatgatgcagaggggcttgcttacggcacgttgccaatgcccaggtagg

SEQ ID NO: 60446 - DNA, 201 bp, Homo sapiens
gtccttctgcctctaaatgctctcttatgtctccaagctgcagcaagtatagaaagagcctggaggattagagccgaccaccatgagagaagctgggctgwaaggggtgggcaagcagcagaaggcctaatgcttttccctctatgggacaatgaagaaaagggctgtgggggcagaggtgcttctttcctctggtcccac

SEQ ID NO: 60447 - DNA, 201 bp, Homo sapiens
agtcaaagtcccaacacgtcgcacattcctggacccccagagctgtggggacctgctgcaggctgtgcatctgttcgccaaggaactggatgcgaaaagcrtcacgctggagaggagccttggaggaggcaagctgggcgcccaggaagccttgtccccatctggaagcctcacccactctataggccccgcccctactct

SEQ ID NO: 60448 - DNA, 201 bp, Homo sapiens
gctgctaacctggtcctcaggatctcacctctatctgccctgagcagctcatgaaaatattttcctgaacaaaggcagttccccctaagaggcattctggyaccagctgtcaagataataattctttccaacctgctacatgactctaatccaagataggaagagctctgagtccaaagggaagtgaagataaaatgctga

SEQ ID NO: 60449 - DNA, 201 bp, Homo sapiens
aaacattactcaaacaggatttatttcaaaggcatcattcttgtggcatgctgtttaaaggggaagcaaagctcatattggtacaattcttatactcaaakaaagtacaaattttgcagaatatcctcttaagacctaccaaggggacaacttcttcaatttggttcaaattagcaaaatataaagcattttcagcatctc

SEQ ID NO: 60450 - DNA, 201 bp, Homo sapiens
ctaccatgtgtcatagtagctgtggggtcattgctccttgcccactctaagtgctccagatcatgagcttcaagaccctagtcttattctgatggtgattkaatgccctggaactctcaaggccccagacttttgcttgtgaatgggtctaagctgcttgcttggctctggtccggagagcattcatttccttttagaagg

SEQ ID NO: 60451 - DNA, 201 bp, Homo sapiens
acacacagtggacacacagtggaattcccagggctttccctgacatgctggatgtcagcgcaatcaactccatgcccaccctctctagtggatgagtctasgctcccaggaagtcctaatactctaatttattctgcttgtcctcttgtcctctcatcctccctttttccctgttgtgtcccagttgtaagctctctcctc

SEQ ID NO: 60452 - DNA, 201 bp, Homo sapiens
gaccagggctcttcaatataacttagaaggagttagaaggagagggtcagccctagaaggaggatgagctgggcagggcggggctggggttcatgggccastgcaacagactggaattcagtggactctctaggccaggcaggaagctagagggcctcccatgaccatagcagacacacagtggacacacagtggaattcc

SEQ ID NO: 60453 - DNA, 201 bp, Homo sapiens
aaatgaaatgcctgggacatcatcgttaagtggcatctgatgcataagcagtgccctaggaatggggttgcctgccttggtctctaaaggatgggttcaaraggcaagagcagcacacaagaagatagcttcaagcaggagaaaaagcttggcccagggcccaaaggggatacgacccttcaggttggccctgacctctgg

SEQ ID NO: 60454 - DNA, 201 bp, Homo sapiens
cttacgtaccacttgggacacagatgctgccctgagtatttactgaacgccaggcactgttctaagtccctcgcatgtatttactcatctattacagcaascctttataacctgtggcttgcaggtgagaagatggagacacagagaggttaggcgacttgcttgaggtcacacagctatcaagtagcagaactcaggcat

SEQ ID NO: 60455 - DNA, 201 bp, Homo sapiens
ccttagactttgccttcccaaaaatgccagtcctgatgagggtaggagattttgtcttacaatattgggtggctgatagcaagcattggtgtctctccccyattcctgctctaaccaccaccactataatcatgagcattggttttagatgaagaaagaactggctttgaatgctgttcccactactaactgtatgaactt

SEQ ID NO: 60456 - DNA, 201 bp, Homo sapiens
tgagtcaaggtttgactcctgcaactacccattggttcagtttctcccagttatttaaactttcttccatagaatggacatttagctacccaaaaacaggkgccattttcctctcagtaggtgatatattggtatatgtcttaggctgcggagtaaaaaagacctgggcttccaattttgaatctgccagcaaccagctgt

SEQ ID NO: 60457 - DNA, 201 bp, Homo sapiens
actatgcattgtgcatagtaagagttcacattaaattcctcattttaattctcacagtatcctgttgggacagacagatgaagaaccagagaccagagagkttaagtagcttgccaaaggtcacacagcagtgtaagcagtacgggtgattcttaagcccacattgtttgacttccgagacatatcagaaaactacgtcaa

SEQ ID NO: 60458 - DNA, 201 bp, Homo sapiens
caatcacctctttaagtccccacctttcaacactaccatattggggattaactttccagcacatgacatttgggggacccatgcaaaccatatcatggagragggacatccttgttaggtagtggtagaaagcttagtgccactattgtctgcagttacatggaaagcaaaatatgtacctaataaacttagtgatctagc

SEQ ID NO: 60459 - DNA, 201 bp, Homo sapiens
gtcagggcatttattgtctttctgtctagtggacaaactcctattcattttcctgcaaccctcctctgtgaatcctttcctgatcctctgagacagtcagycttccctccttggggttcccacaaatgttgaagaaaagtaaaatgagaataacagctactaaataagtaattattaagtatataaaaactgttctgtagg

SEQ ID NO: 60460 - DNA, 201 bp, Homo sapiens
cataagcagtgccctaggaatggggttgcctgccttggtctctaaaggatgggttcaaaaggcaagagcagcacacaagaagatagcttcaagcaggagawaaagcttggcccagggcccaaaggggatacgacccttcaggttggccctgacctctgggttggattaccagtgacacaatgaacatttcattatgaggcc

SEQ ID NO: 60461 - DNA, 201 bp, Homo sapiens
cttaagatacactattctcaaaaacctaagtgcttagcctggcttatggaggaggcaatgcaatctaccacaagatgattaagacaacaatgaacttaagwcccagccactgctggagaatatctgcctgtgaattcaatttggttcaattcaatccgatttaattcagtgcagttattgagtgcccaccacataccccat

SEQ ID NO: 60462 - DNA, 201 bp, Homo sapiens
tgggttggattaccagtgacacaatgaacatttcattatgaggccatcccttgaggtagttgcattgcaacagctctccctacccagtgctgcatttccartgctttctctgttcaggctgctgggtgacatttctatgtctccccttcaacggtgaaatatttcagtggttgtccatcacctatgggagtctgacatggc

SEQ ID NO: 60463 - DNA, 201 bp, Homo sapiens
tccccacactctgtcattataaaccacgtaaattcctcgatacccatgttacaacgaacagatgcggctctgtatttttaatgtattatctctaattagcrgcagtgggcatggaagaactctgtggtccctggggctgtccctcactgatgcagctgcgagtacatttgtgatgaagaatctggccaggctcctctggcc

SEQ ID NO: 60464 - DNA, 201 bp, Homo sapiens
aaagctgtttctcagggtcatatgggaatagaatgagaagacatggcataaagaacttacgtaccacttgggacacagatgctgccctgagtatttactgmacgccaggcactgttctaagtccctcgcatgtatttactcatctattacagcaaccctttataacctgtggcttgcaggtgagaagatggagacacagag

SEQ ID NO: 60465 - DNA, 201 bp, Homo sapiens
ttttcctctcagtaggtgatatattggtatatgtcttaggctgcggagtaaaaaagacctgggcttccaattttgaatctgccagcaaccagctgtgtgtrgttgggcaagttgctaaatatctccgagcctcagatgatttcctctagaataaatgatgacacatttacctcacctcatttagtaaggactaaatgaaat

SEQ ID NO: 60466 - DNA, 201 bp, Homo sapiens
aagaagggggctggttagtgagagcaaatgtatgctccttagctctgtccaaagaggaagggtatttcttataataaatgtcatgctcatgactgacatgytttgggcgtttactatggactaagccctatttctaagtgttctccagatatcatcacgtataattctagaggcagtgtcagcccccggccaatgaccacc

SEQ ID NO: 60467 - DNA, 201 bp, Homo sapiens
aagagggtaggagaatgactcaatgctgcagcacaagccctcttttggcaagatcgatgtgtgggcagaaggcaaatggctgctgagaggaaatgggccasacctggctggtcttattctatcctgtaatggcagaaagctgttcaggatggctatggcgcacagcccagggctgactcagcattgcctcttcctaacctg

SEQ ID NO: 60468 - DNA, 201 bp, Homo sapiens
cagttatttaaactttcttccatagaatggacatttagctacccaaaaacaggtgccattttcctctcagtaggtgatatattggtatatgtcttaggctrcggagtaaaaaagacctgggcttccaattttgaatctgccagcaaccagctgtgtgtagttgggcaagttgctaaatatctccgagcctcagatgatttc

SEQ ID NO: 60469 - DNA, 201 bp, Homo sapiens
ggctggttagtgagagcaaatgtatgctccttagctctgtccaaagaggaagggtatttcttataataaatgtcatgctcatgactgacatgctttgggcrtttactatggactaagccctatttctaagtgttctccagatatcatcacgtataattctagaggcagtgtcagcccccggccaatgaccaccatggacct

SEQ ID NO: 60470 - DNA, 201 bp, Homo sapiens
ttccatagaatggacatttagctacccaaaaacaggtgccattttcctctcagtaggtgatatattggtatatgtcttaggctgcggagtaaaaaagaccygggcttccaattttgaatctgccagcaaccagctgtgtgtagttgggcaagttgctaaatatctccgagcctcagatgatttcctctagaataaatgatg

SEQ ID NO: 60471 - DNA, 201 bp, Homo sapiens
tgaggtcacaaaggcattgatgcccctttgtcctatcatgtgaccacttgtcacacttccatcaaacagtacctgccccttaggtgtgctagggaataaaygaaatgcctgggacatcatcgttaagtggcatctgatgcataagcagtgccctaggaatggggttgcctgccttggtctctaaaggatgggttcaaaagg

SEQ ID NO: 60472 - DNA, 201 bp, Homo sapiens
ctctagtggatgagtctaggctcccaggaagtcctaatactctaatttattctgcttgtcctcttgtcctctcatcctccctttttccctgttgtgtcccmgttgtaagctctctcctcacacctaagctgatggctcccagacatctattttcaacctttactcctccccaaaactttagatccttacatccttctacct

SEQ ID NO: 60473 - DNA, 201 bp, Homo sapiens
acagtggacacacagtggaattcccagggctttccctgacatgctggatgtcagcgcaatcaactccatgcccaccctctctagtggatgagtctaggctyccaggaagtcctaatactctaatttattctgcttgtcctcttgtcctctcatcctccctttttccctgttgtgtcccagttgtaagctctctcctcacac

SEQ ID NO: 60474 - DNA, 201 bp, Homo sapiens
ggtgacatttctatgtctccccttcaacggtgaaatatttcagtggttgtccatcacctatgggagtctgacatggcataatcaggccactggggcattgmtagttgtgctgtccctgatattcaccgtggtaggcagtttctgaaatggctcccagtgatctccaactcctgaaattcacactctgtgtaatcccctccc

SEQ ID NO: 60475 - DNA, 201 bp, Homo sapiens
ttgaggtcacacagctatcaagtagcagaactcaggcatcctggctgcagcacccacactctaccatgtgtcatagtagctgtggggtcattgctccttgyccactctaagtgctccagatcatgagcttcaagaccctagtcttattctgatggtgatttaatgccctggaactctcaaggccccagacttttgcttgtg

SEQ ID NO: 60476 - DNA, 201 bp, Homo sapiens
gctagtctcgtttaatttgtggaaagtccttttttactgctttgcccattggaggtgtctccttttattagaaagtaaccatcttattccaattctatgcrtgttactggtatttataaatgtatgagtttttttgcggtataataaatgtaaattttctttgtattctaattgttggttagtttcattgcaatttaattg

SEQ ID NO: 60477 - DNA, 201 bp, Homo sapiens; identical to SEQ ID NO: 54485

SEQ ID NO: 60478 - DNA, 201 bp, Homo sapiens
ttaatttgtggaaagtccttttttactgctttgcccattggaggtgtctccttttattagaaagtaaccatcttattccaattctatgcatgttactggtrtttataaatgtatgagtttttttgcggtataataaatgtaaattttctttgtattctaattgttggttagtttcattgcaatttaattgcatttaaagtg

SEQ ID NO: 60479 - DNA, 201 bp, Homo sapiens; identical to SEQ ID NO: 54486

SEQ ID NO: 60480 - DNA, 201 bp, Homo sapiens; identical to SEQ ID NO: 54487

SEQ ID NO: 60481 - DNA, 201 bp, Homo sapiens
ccattggaggtgtctccttttattagaaagtaaccatcttattccaattctatgcatgttactggtatttataaatgtatgagtttttttgcggtataatraatgtaaattttctttgtattctaattgttggttagtttcattgcaatttaattgcatttaaagtgtaaaagtaaattttgtattttcagaaatctttaa

SEQ ID NO: 60482 - DNA, 201 bp, Homo sapiens
agggtgcagagagggttagcgaggcaaatcccagtttcaggaagagctttgaattcacttaagtgttaataaggatctactgaggctagtctcgtttaatytgtggaaagtccttttttactgctttgcccattggaggtgtctccttttattagaaagtaaccatcttattccaattctatgcatgttactggtatttat

SEQ ID NO: 60483 - DNA, 201 bp, Homo sapiens
agcagcaagcaggaagaggaggctttctaaggcggtcgctccgggaaatccgggccctaggattgtccactcatcccagtatcagcgagatacggggagayagagttagcgacaacgtgagccagagctggagcacgtttggtgagagaccagaaagcaatggaggccggagaggggaaggagcgcgttccgaaacaaagg

SEQ ID NO: 60484 - DNA, 201 bp, Homo sapiens; identical to SEQ ID NO: 54515

SEQ ID NO: 60485 - DNA, 201 bp, Homo sapiens
tccgcgctcggccaccgccacgctgcacgtgctcctggtggacggcttctcccagccctacctgctgctcccggaggcggcaccggcccaggcccaggcckacttgctcaccgtctacctggtggtggcgttggcctcggtgtcttcgctcttcctcttctcggtgctcctgttcgtggcggtgcggctgtgcaggaggag

SEQ ID NO: 60486 - DNA, 201 bp, Homo sapiens; identical to SEQ ID NO: 54519

SEQ ID NO: 60487 - DNA, 201 bp, Homo sapiens; identical to SEQ ID NO: 54499

SEQ ID NO: 60488 - DNA, 201 bp, Homo sapiens; identical to SEQ ID NO: 54520

SEQ ID NO: 60489 - DNA, 201 bp, Homo sapiens; identical to SEQ ID NO: 54503

SEQ ID NO: 60490 - DNA, 201 bp, Homo sapiens
tgtaaattttctttgtattctaattgttggttagtttcattgcaatttaattgcatttaaagtgtaaaagtaaattttgtattttcagaaatctttaagttagagcatcttttccagacctcacagtctatggtcctagataattttgaagtcctacatttgaaaatatttgttatcattacatgagttatattttccagc

SEQ ID NO: 60491 - DNA, 201 bp, Homo sapiens; identical to SEQ ID NO: 54505

SEQ ID NO: 60492 - DNA, 201 bp, Homo sapiens
agacttggagtttggaagccagatggaccaagcaaggagcctgactctgagctcaccagctgtgcaattcgggtgagttccttcacccttctgagccatcycttggctcgtctggaaaatgcaaaaaaaaaaaaaagaaaaacaccaggtttttgcatcctcctggatgagggatataaagtgcctgacacagcatatgac

SEQ ID NO: 60493 - DNA, 201 bp, Homo sapiens
aaaaaaaaaaaaagaaaaacaccaggtttttgcatcctcctggatgagggatataaagtgcctgacacagcatatgacagggatttgataaatgggggctrttagctgtcccattgtggatgtgagaatagcattctgctggctaaaaggcagacatgaatgttctagaacatggcgatcccggaatgtgcagtgaaggca

SEQ ID NO: 60494 - DNA, 201 bp, Homo sapiens
gggtggagcagacagacttggagtttggaagccagatggaccaagcaaggagcctgactctgagctcaccagctgtgcaattcgggtgagttccttcaccyttctgagccatcccttggctcgtctggaaaatgcaaaaaaaaaaaaaagaaaaacaccaggtttttgcatcctcctggatgagggatataaagtgcctga

SEQ ID NO: 60495 - DNA, 201 bp, Homo sapiens
gcacatgacagcctccgctgagccaaatggcccaaagacttctgaatgagcttttgctgcaacaaaaaactttggatcattttgagagcctcccgtgaggygccaatatgttgcagtaccttcccggccccgacactgatgtgattcatcgtaggtaacatatgaatacgctcaagctggccagcagcttgaaaaattgga

SEQ ID NO: 60496 - DNA, 201 bp, Homo sapiens
ccttgtcgaagtccacatcggactgatctagaatgccccgtggggggattgcatggcctttgccttgagatgcaggtgaaagaaaggaaccaaacaaggcrtgagtgtgttggggaatcttcccagtggagcaaacccccttaacacaccagctgttgggaacagctgcccctaaatccaattaaaccctcatctccctgg

SEQ ID NO: 60497 - DNA, 201 bp, Homo sapiens
gagaacagagaaggctccaagggtgttgggagtgagccaggggctggtctggggagtgggtctcacgcactgctcaggttggcacgagggacctcccccaycccaacccagccccaagggtcccagcagggctctcagcatggctgttttgagggtacacaggtggctggagaggggtggggcagttgcatggtgggtggc

SEQ ID NO: 60498 - DNA, 201 bp, Homo sapiens
tcctcaccctctacagatgggcctcagggcctggaggtgggcagatggggccagagtggccagcagagacttgcatgggctctgaaagccccagagctcargcctaaggctgctaggtgagaccagcaggcagctgtggcatccgaccttgggacgcccaagctgggcagccgctccatgtgccccaaacaggatatcctc

SEQ ID NO: 60499 - DNA, 201 bp, Homo sapiens
cagacactggaagcagcccagccccctgcccaataccacagccctggggtgtcccctgacattcctggaggtccctgggcaaatgcatttcctgcctgggytctcagggtaggagaacagagaaggctccaagggtgttgggagtgagccaggggctggtctggggagtgggtctcacgcactgctcaggttggcacgagg

SEQ ID NO: 60500 - DNA, 201 bp, Homo sapiens; identical to SEQ ID NO: 40739

SEQ ID NO: 60501 - DNA, 201 bp, Homo sapiens
aatgtgggagaaaagaagagtggccagttccaggggtagctccaaaagagactgcagagctgtccgagaccctgacaagggaggcccaaggcaacagttcygcaggagtggaggcagcagagcagaggcctgtggaagatggcgagaggggcatgaagccaacagaagggtggaaatggaccctgaactccgggaaggctc

SEQ ID NO: 60502 - DNA, 201 bp, Homo sapiens
gagaggggcatgaagccaacagaagggtggaaatggaccctgaactccgggaaggctcgagaatggacacccagggacatagaggctcaaactcagaaacyagaacctccagagtcagcagagaagcttctggaatctcccggtgtggaggctggagaaggggaggctgagaaggaggaggcgggggctcagggcaggcct

SEQ ID NO: 60503 - DNA, 201 bp, Homo sapiens
ccccccactcccatgcaggctgtgcatttctgagaagcccagtcagaagttggtggggggtgaggagacaggcagggtagggggggagatataaacatagrccgagagcaaataaaataagtcattttcagagtagaaaataaagtacagaggttattattccaaaagaggatatgagaagaaaacaaaaatgggttccca

SEQ ID NO: 60504 - DNA, 201 bp, Homo sapiens
cggtactggaggagctgggcccggagcctgaggtccccagtgcccccaaccctccagcagcccaacccgacgacgaagaggatgaggaagagctgctgctsctgcagccagagctccagggcgggctgcgcaccaaggccctgattgtgggtaagcggaggctccgccggcccgagggcgccccctgctgtcagagcgggc

SEQ ID NO: 60505 - DNA, 201 bp, Homo sapiens
gtccgagggagaccagagagaggaggctggggatagggggagcccaagagttgagcctgaggcctctggaggctcgggactggaggcaaagcccaggagargtgggagacaggagctcccgactgtcagaggcatggaaatggaggctgagtcctggagaaactccagagcggagtctgagactagcagagtctcgagagc

SEQ ID NO: 60506 - DNA, 201 bp, Homo sapiens; identical to SEQ ID NO: 40748

SEQ ID NO: 60507 - DNA, 201 bp, Homo sapiens
agttatggtgagattaaacagttataaggatgcctggcacagagtccgagctaaatgagtgatggatgtggttactggtggtaacatgctttagatatggragatattataggacttcctgcatgccaactgcccttcaatttgtgtgggggggaagggtgggcagaaggcagaggctctcactcattctctaacattatt

SEQ ID NO: 60508 - DNA, 201 bp, Homo sapiens
ataaggaagcagccgctgcttgggtgggggtggggaggaggcagcacagagttcctctgacccagacgcctcaccctccaccctctaccccctgtcagcamcctgttcttcagggactgggtgccttgtcccagctctgctgcaacacactggctcaggaataggagataggaggaccctgccaccaacccccgcttcacc

SEQ ID NO: 60509 - DNA, 201 bp, Homo sapiens; identical to SEQ ID NO: 40729

SEQ ID NO: 60510 - DNA, 201 bp, Homo sapiens
atggatgtggttactggtggtaacatgctttagatatggaagatattataggacttcctgcatgccaactgcccttcaatttgtgtgggggggaagggtgrgcagaaggcagaggctctcactcattctctaacattattgccccctctcccacagatgagtcctgccggcggtgaccatcttccaacatagggatatacc

SEQ ID NO: 60511 - DNA, 201 bp, Homo sapiens
tgagtcaccccctctctacccccccactcccatgcaggctgtgcatttctgagaagcccagtcagaagttggtggggggtgaggagacaggcagggtaggsggggagatataaacatagaccgagagcaaataaaataagtcattttcagagtagaaaataaagtacagaggttattattccaaaagaggatatgagaaga

SEQ ID NO: 60512 - DNA, 201 bp, Homo sapiens
caagcttgggctgtcccctggggagcctagccctgtgctagggactgtagaggctggacctccagacccggatgagtctgcggtccttctggaggccatcrggccagtgcaccagaaccgattcatccggcaggagcggcagcagcagcagcagcaacaacaacggagtgaagagctgctagcagagagaaagcctgggcc

SEQ ID NO: 60513 - DNA, 201 bp, Homo sapiens
tctgtgcctgtccctttgggcacactgtggacccccaccccaggtttgtgtggactttcctttctgcccttgtcatctcccccagccttcagggtgtcagyggctcatctttcccctgtgtgttgctggagtctcttggttcctctcggcctttctgttcatctcccatctcttcctaggccctagactccctttgctatg

SEQ ID NO: 60514 - DNA, 201 bp, Homo sapiens
ggatatacctccctccttcttataactgaagatcctggagcccggaagattcagggcagacagaccctgataatgagcctggcagggaagggcaaccaacwtcttgtaacttgctttccccaccctgtttctgggggcagagccaattgcccaatttctaccctaatccaaagtccctggtgtgggtggggttaaacgtgc

SEQ ID NO: 60515 - DNA, 201 bp, Homo sapiens
gtggaattttccacttgtgtcataatgtgggctctcaaaaagtttcagattttggagcattttggatttcaaattttcagatcagaaatgctcaacctgtrttagacactggaagccttagaaaattctccttactgtaagccccagtttactacctaataactaccacctagttatatcttctgtgcaacaaatatggtc

SEQ ID NO: 60516 - DNA, 201 bp, Homo sapiens
agatggagctctacataagaaattacagattagtccagatttccttccagtttaaaagcattgtctttctgacagtaaaaccagagaaaggacatttcaargaatgactcaaagaattagtaatgaacctcaaacagttcatctttccttgttattatgaccttgcaaatgtgtttatattttcaagaccggtagctaagt

SEQ ID NO: 60517 - DNA, 201 bp, Homo sapiens
gtaaggctctgggtgataggaggtgggagagtgggtggaggagagaaggaacaacttagagtagaaaacaagtaggctcagatgagctgagagttatttgrcagtgaaaagagtattcctcgtagagaagttgctgtttggggactgggacttgaaaactgctaataggtttttaaaactttcaatgtgaaataagcagtc

SEQ ID NO: 60518 - DNA, 201 bp, Homo sapiens
tctaacagcaaaggaagtattgatatattcccttccaaatcacaggctttacacaatacaactaggagaagaaagccaaactaaaattcaaatgtactaartttttttcctatctctgggtgactttgggcaaatcattgaatctttcaacctcagatttattataagtaaaataaagtaacacctctcttaacctacctt

SEQ ID NO: 60519 - DNA, 201 bp, Homo sapiens
aatcactagtttcttgtattcataaactcagagatacagagggcttggtttgaagttggggtgagatgaaacctttgctctgagccaaagctctggggccytgcattccctgcattgggttgatgactgtcagcatcactgccgcaggccatgcttgactaaggtacctggttttagccacagccacctccttgtatgtta

SEQ ID NO: 60520 - DNA, 201 bp, Homo sapiens
gccttgtggaacaaggtaagctttctctttgcctacgagcctccctttagctcagacagagtttctgttcctacagctatgatcacttagacatatctcarataggcatgatagttaacccaaggggacttctgatctgagcattgtttgagcaaaggcctatctccaaataggagcttttccatcttaagaaccattatt

SEQ ID NO: 60521 - DNA, 201 bp, Homo sapiens
tgtctttctgacagtaaaaccagagaaaggacatttcaaggaatgactcaaagaattagtaatgaacctcaaacagttcatctttccttgttattatgacyttgcaaatgtgtttatattttcaagaccggtagctaagttctatgaatttacaaggtgcaaaataggactttgttttctttgctccccaaatgcctcctt

SEQ ID NO: 60522 - DNA, 201 bp, Homo sapiens
aagactgttgcaccagagtattctgatgcctttgctcttgtttgctcccacacagcacaagttgaccccggaatatctggagctcaaaaagtaccaggccrttgcttctaacagtaagatctattttggcagcaacatccctaacatgttcgtggactcctcatgtgctttgaaatattcagatattaggactggaagaga

SEQ ID NO: 60523 - DNA, 201 bp, Homo sapiens
cctctcctgcgatagtcctgggtgctccactgattggaggatagagccagctgtctgacacacaaatggtcttttcagccacagtcttatcaagtatcctrtatgtattcctttctaaactgctactcatgaatgaggaaagtctgatgctaagatactgcctgcactggaatgttaaacactaaatatataacaagctgt

SEQ ID NO: 60524 - DNA, 201 bp, Homo sapiens; identical to SEQ ID NO: 24413

SEQ ID NO: 60525 - DNA, 201 bp, Homo sapiens
aacccaaaatcccagaagccataagaagaaattttgagttaatgtgagtaatatgcatgggatcccaatatttctgtttagggctgtctgcatattaataytccagtctagaggaaacatgtgagacaatacactctggggtggagtatgtgtcttatcttctttactcttactctagtaatattgcctattcttgtgtct

SEQ ID NO: 60526 - DNA, 201 bp, Homo sapiens
ctactaaaaatacaaaaaattagccaggcatggtggtgggcgcctgtagtcccagctactcgggaggctgaggcaggagaatggcgtgaactcaggaggcraagcttgcagtgagtcgagatagtgccactgcactccagcctgggtgacagagtgagactccatctcaaaaaaaaaaaaaaaaaaagattgcttctggtg

SEQ ID NO: 60527 - DNA, 201 bp, Homo sapiens
tttcattagttattgagtccttggtcttttctcatcaaatcgaattttctcctgtgtttttcatcttgtcagttaatggtaactctttcccctcaagccartctagaagtgtaggaggcatctttgacaatcgcctcaccctcagcatctaatcagtccctatgtcctgcagattccaccaccaaaatccatgtattaata

SEQ ID NO: 60528 - DNA, 201 bp, Homo sapiens
catgtggaccctttttttccttcagtttaacttttctggagcagtgtgctgcgtagttcggcctgagtttgtgcagcttgttaagacaactcttgtgtacrctatgttgaagctcaacaaaaaagtcatgggaccacttctagaaatctttcagctgtcaggcctgtcagtctcatgacagtttgttggttgtgccaaaca

SEQ ID NO: 60529 - DNA, 201 bp, Homo sapiens
acagggagaatggatagggtttataggcagcttgagtctgtggatagcattttcatttgtacagattaagaatagggaagttttttgaccaaagtttcagrttgtagtatgcatccttgttgttgacatgcacttagttttacctggataggtagtgccgtttatgaaagcatggcaggattgtttacagttcatttcaga

SEQ ID NO: 60530 - DNA, 201 bp, Homo sapiens
ttacagttcatttcagattacagtggcttcccttatactccaggtcactgtgtattagattgccctctttggccctcggttgatgctgaaagtttaatacrtctttaattaaataattcaattatagaggaatgtacagagaacaatataatgaaagcttaagattttgccttattcccttcagatctttttttttttttt

SEQ ID NO: 60531 - DNA, 201 bp, Homo sapiens
tttttaatttcttttttctagtactgtaatttgtttttgttatagtttacaatttattggttcctcataaattgaaatacacacacaaaaaggtaaggtayttttccacaggtggtttgagaagcactgctctagaatagctatctcaaagtagaattgatgggtcatagggtagcatgtcttcacattcaacatattgac

SEQ ID NO: 60532 - DNA, 201 bp, Homo sapiens
ttttctagtactgtaatttgtttttgttatagtttacaatttattggttcctcataaattgaaatacacacacaaaaaggtaaggtatttttccacaggtrgtttgagaagcactgctctagaatagctatctcaaagtagaattgatgggtcatagggtagcatgtcttcacattcaacatattgacaaattgctctctc

SEQ ID NO: 60533 - DNA, 201 bp, Homo sapiens
gtgttatttaatcttgtaatcttatgtctaggcttcctgctaagtgagagtttaattataaattcttaaatcccctaggttttcttcctgtccccttttasatggcttagggaaagaattgtgtctactgaagtgaaatgtattcttcccctaatcagactgatttccatatgttgttccatatttattttacccattctt

SEQ ID NO: 60534 - DNA, 201 bp, Homo sapiens
aggaagctcaccgagcaggggcggcccactggcctccgggggcggaggagttggcaaggggtcagcgggctcagccagaagggaagaatgaggggacaggkgtactggactccccggctcagcctgcgagagagcgccaagtttccggagggagagggtagaaactggagggggtggacctgtcactcacgggactgaggg

SEQ ID NO: 60535 - DNA, 201 bp, Homo sapiens
ttcaatttctagccccattgaacatagtagtttagtttttggatggtgtaatatagattgattttacattggtggagaaagagggaattatctcctggagyagttcgtaaagcatactgttttatggaaagaaaaaaatcacttggaagttttctttccattatgtactttttctaggggtcagagataagatgtcctaaa

SEQ ID NO: 60536 - DNA, 201 bp, Homo sapiens
cctatctccaaataggagcttttccatcttaagaaccattattgttcttatggtattattggaaaaaactggagttttagagcaagtagacctaactgtgyattagcactgctgcatctgctttattgactattttttaaagactttattttttacagcagttttaggttcatagtgaaattgaccaaaaagtacagacag

SEQ ID NO: 60537 - DNA, 201 bp, Homo sapiens
tccagcttttgggtttgtttgtgactgtgggtagctcagctttccttttcttccttaaattggggcttattagctaccactttattttcaggcagacaagrtatgaaaattacccataatcaatagtaaagaatatacaagataataaaccccatctctggccgggcgccgtggctcacgcctgtaatcccagcactttgg

SEQ ID NO: 60538 - DNA, 201 bp, Homo sapiens
ttgggtcactgtgttttccagattgtgggttgtaaaatcaactttagtgagtcatgaacagcattttaaataaaatggaatagaataggaaaagaaatggyatgtaataagtttaaatattctgtgacacttgtgtttcacagtgtggcggggtaggtgtttatattggacgtcagtgcaaaatgtgtttcttactgtgtc

SEQ ID NO: 60539 - DNA, 201 bp, Homo sapiens
gagatggagtcttgttctgtcacccaggctggagtgcagtggcatgatctcagctcagtgcaacctctgccttttgggttcatgcaattctcctgcctcascctccctagtagctgggactacaggtgtatgcctccacaccaggctaatttttgtatttttagtagagacagtgtttcaccatgttggccaggctggtct

SEQ ID NO: 60540 - DNA, 201 bp, Homo sapiens
ctagactcttactagtgttctctttatgtatggacatttcaggagcagtttcagtggctaaagatgcagtttgctgtaaaactattgctggaagcttaagsagctataattttatatgaatagtaccttgaattaaatatttaatagaggaaagagtcctgaagccgttagggttgaagagagtgctcatattttgtttct

SEQ ID NO: 60541 - DNA, 201 bp, Homo sapiens
tgttttattcagcaattatttgagatgctatggtgatttatagaatacctttctcaatttgactttagatctctgccaaaataaaatactcttgtagcttrctatgggtgacatttgtgaactcctagagggaactgataagctgaggctcttacaaggaagtaaaattcatatttctgccatgtatgaagcattaagata

SEQ ID NO: 60542 - DNA, 201 bp, Homo sapiens
ctgtattagacactggaagccttagaaaattctccttactgtaagccccagtttactacctaataactaccacctagttatatcttctgtgcaacaaatayggtcactgcacatgggtgcccacctgaggagggcaggggctgaaacccagcttcattctgcatgtcaaaccatgcacctgcaggactgtagaaacggctg

SEQ ID NO: 60543 - DNA, 201 bp, Homo sapiens
agacattgacatctatagagggacagaaatgctatgaaaaaggaagcgaactctttctgtgttttaagtgaatattagtatgtttcattatcagcttctcyccaggtctatctataactgtgttttatggattgcctttagtagttcacactttttttctttgtttttagtggtggggtcatgatctatattgaccgaata

SEQ ID NO: 60544 - DNA, 201 bp, Homo sapiens
cccaaattatttctagggtataatcactgcattgaattgtatcaaaagaagaatgtgaagttcaaggtattttttaaattacttattttaaatgactattwcaagtgtaaaaaagacattgacatctatagagggacagaaatgctatgaaaaaggaagcgaactctttctgtgttttaagtgaatattagtatgtttcat

SEQ ID NO: 60545 - DNA, 201 bp, Homo sapiens
tgaggcaggagaatggcgtgaactcaggaggcgaagcttgcagtgagtcgagatagtgccactgcactccagcctgggtgacagagtgagactccatctcaaaaaaaaaaaaaaaaaaagattgcttctggtgacggaaaaatgaatattgtgtgttttctgctctcaaataaatcatagtattcagactgtcatttgatg

SEQ ID NO: 60546 - DNA, 201 bp, Homo sapiens
ggaaacatggaagattataaattttcttctaaggattgctttagctatgtttcacaggttttgaaatgtactttgtatattggtgttcagttttaattctwaaccttttccttctaatttcttctttggctcatgaattattaaaagtatatgcttcaatttctggtttagtgggttttgaggggctacctttttattgtt

SEQ ID NO: 60547 - DNA, 201 bp, Homo sapiens
atccattatttcctttaagattacttccagaaggtcttccttggtttaacttatgtcactcattctttctttctcctgccacattaattgtcctgtgttgccatgcatttatgttgctctgtttttgttctgtggtactttcataaagtatctttttttcccattagcttgtggaccgttgctacagagttgcatgaagga

SEQ ID NO: 60548 - DNA, 201 bp, Homo sapiens
ccccgtctctactaaaaatacaaaaaattagccgggcgtggtggcgggcgcctgtagtcccagctacttgggaggctgaggcaggagaatggcgtgaaccygggaggcggagcttgcagtgagccgagatcccgccactgcactccagcctgggcgacagagcgagactccgtctcaaaaaataaaaaaaaaattaaaaat

SEQ ID NO: 60549 - DNA, 201 bp, Homo sapiens
cgggaggcggagcttgcagtgagccgagatcccgccactgcactccagcctgggcgacagagcgagactccgtctcaaaaaataaaaaaaaaattaaaaawaaataaaccccatcacgaccagtttcttttccacctgtccaaaaaaaaaacaaaattaattggggggaaaaacagttttcatggagggcctcacactact

SEQ ID NO: 60550 - DNA, 201 bp, Homo sapiens
tgcctgcactggaatgttaaacactaaatatataacaagctgtgttttcctaagctgagatctgttgaataatgtttacattcgtcccccggggaaatgtmtgctcagccaccattcaagagatgactgagaaggagatggtaagttcaagaagactgattgcacctgggacccaggccctttctttgggatccagtccca

SEQ ID NO: 60551 - DNA, 201 bp, Homo sapiens
atcagactgatttccatatgttgttccatatttattttacccattctttccttagttcatgccatcacttctttatctgccatctcactctccattccttytctcctgtctaaatcttgccaggcttttaaaggctcatcccagattcttcctcttctgatctatagctcttaaagtctatattgtaaattttggcccttt

SEQ ID NO: 60552 - DNA, 201 bp, Homo sapiens
ctagagagatcccaaactccccagccagcattcagggccctctgtctagtattaccatggtctcttgtcagaatttcatctttcatccaaattgtcccttstgctccaggcaagcctatctactttcgttcgcctatacacatgttgtcttcaactgtgtgtatttcagtaggatatttattgagcttaagatgttcctct

SEQ ID NO: 60553 - DNA, 201 bp, Homo sapiens
caagtagacctaactgtgtattagcactgctgcatctgctttattgactattttttaaagactttattttttacagcagttttaggttcatagtgaaattsaccaaaaagtacagacagtttttatatacctctttccccaacacattcctttattgacactttaaagcttagtttcctcctttataaaggcagtaaaatc

SEQ ID NO: 60554 - DNA, 201 bp, Homo sapiens
cactggaagccttagaaaattctccttactgtaagccccagtttactacctaataactaccacctagttatatcttctgtgcaacaaatatggtcactgcrcatgggtgcccacctgaggagggcaggggctgaaacccagcttcattctgcatgtcaaaccatgcacctgcaggactgtagaaacggctggtgccgtttt

SEQ ID NO: 60555 - DNA, 201 bp, Homo sapiens
agtagacctaactgtgtattagcactgctgcatctgctttattgactattttttaaagactttattttttacagcagttttaggttcatagtgaaattgascaaaaagtacagacagtttttatatacctctttccccaacacattcctttattgacactttaaagcttagtttcctcctttataaaggcagtaaaatcta

SEQ ID NO: 60556 - DNA, 201 bp, Homo sapiens
ctttctgtgttttaagtgaatattagtatgtttcattatcagcttctccccaggtctatctataactgtgttttatggattgcctttagtagttcacactytttttctttgtttttagtggtggggtcatgatctatattgaccgaatagaagtggttaatatgttggctccttatgcaggtatgttacccatctacctgt

SEQ ID NO: 60557 - DNA, 201 bp, Homo sapiens
acatagtgagatgttgatgttcttagctcggtcttgaagtcacttgttatatattgctgcttcctgtctgtctctgttgactgattctggatgaaatttgkgggggggctggagacaatgcagtaaatagagcttttatgtctggacttattttacttgaagcttagtacctgggtggaatgtaaggctctgggtgatagg

SEQ ID NO: 60558 - DNA, 201 bp, Homo sapiens
aagtctaataagttacccagtaaaaaagcttatccatagttaagtaatacatttagtgggtaaacttattggataaacagactatctgcttgtcatcttcrttccttaatttctttattagataattccttgcaatttttttcccacacaaaagggaagaaaaggcagtttaagctctgtaaaagaatagtactgtggaaa

SEQ ID NO: 60559 - DNA, 201 bp, Homo sapiens
ttgggaggctgaggtgggaggatgacttgaacacagcaggttgaggctgcagtgaactgtgttcatgctgtactcttgtctgggcaacagagcaaaacccwgtctataaataaataaataaatagcatttgtatatagagaacttgtttttgaaccttaccctttgagaggggtagaattcgtttttaaaaataaactttt

SEQ ID NO: 60560 - DNA, 201 bp, Homo sapiens
attttaagtcaggaacgcagctgttaatgtgatagccactctccaaagtgagagagggtcattggcagttattcagacttgactcatgatactcaggagarcaataggtgaaatgtatatagggagagagaagactgttgcaccagagtattctgatgcctttgctcttgtttgctcccacacagcacaagttgaccccgg

SEQ ID NO: 60561 - DNA, 201 bp, Homo sapiens
tcttcaaattttttctttgtcatttaactttgttttttccttgctgataactttgaagtgttcatgttttacatagtaatttcagtgattttgtctttatrgtgtgttgctgagctggcatgttttaagagcttttcaccaccttaaaagtatagcaattaaaattagaaattataaaaattgtatctgcttttacagttg

SEQ ID NO: 60562 - DNA, 201 bp, Homo sapiens
taatggtaacttaacagtagatcctgagtatagtaaaactaagctccttagcctgtcactcaagacagaggtctcctagccctctttctcttcttattttwtgttgtcttcgcttgttggctggttccatatcacctctccattgtgacttgttcatttgtgccttcttgtctttcttttttttgtttttgtttttgtttt

SEQ ID NO: 60563 - DNA, 201 bp, Homo sapiens
ctcaagccaatctagaagtgtaggaggcatctttgacaatcgcctcaccctcagcatctaatcagtccctatgtcctgcagattccaccaccaaaatccaygtattaataaaactgaccacacctccatcttcactgtcatctcaagccaagctaccaactctaaccttgacatgtgcagtagcagtagccgcctgtcttc

SEQ ID NO: 60564 - DNA, 201 bp, Homo sapiens
tggaggagagaaggaacaacttagagtagaaaacaagtaggctcagatgagctgagagttatttgacagtgaaaagagtattcctcgtagagaagttgctstttggggactgggacttgaaaactgctaataggtttttaaaactttcaatgtgaaataagcagtcacaatattaagcagtggggaaagggactcttaact

SEQ ID NO: 60565 - DNA, 201 bp, Homo sapiens
tttagtagagatgaggtttcactgtgttaaccaggatggtctcgagctcctgaccttgtgatccgctcgccttggcctcccaaagtgctgggattacaggygtaagccaccgcacctggccatagcatgctaaatattatacataaaccagtaacatagttgtttattatcattatcaaatattgtatactgtacataact

SEQ ID NO: 60566 - DNA, 201 bp, Homo sapiens
cgttattggctggagggcgctgacgtctgattgttgcgcggtcgcatttttccggggaacgcggattcgcattcccaattttaggtggcagtcgcaacccrtactattcggacagatggcacagaaaccgctgcgcctgtgagtgaccgtgaatggaagcctctctccctgtgtctctttcgtgtgtgtaggtgacgacac

SEQ ID NO: 60567 - DNA, 201 bp, Homo sapiens
acaaggatgtggaggaattggaatcctcacacattgctggtgagagtgtaaaatggtgcagccgctttggaaaactgtttagcagttcttgaaaggttaartgtaagagtcagcagcatggtaacggcaattttattcctgtcccaagataagggaaaacatatgtccacacaaaaacttgtacacagatgatcataatag

SEQ ID NO: 60568 - DNA, 201 bp, Homo sapiens
ctgagccacctgtttggcttccactgcttctgtgaactccttcccgaaggtcagatgtgtcaaggacacgtcatccaggatgagcccaaaggtggctgctygctctgtaaggtcgttgctcatctgcctggagaccagctctctttaggtgattagttctccagcatcaaagtgagccaccactgacttgaggatctcagt

SEQ ID NO: 60569 - DNA, 201 bp, Homo sapiens
cacctgtttggcttccactgcttctgtgaactccttcccgaaggtcagatgtgtcaaggacacgtcatccaggatgagcccaaaggtggctgcttgctctrtaaggtcgttgctcatctgcctggagaccagctctctttaggtgattagttctccagcatcaaagtgagccaccactgacttgaggatctcagtagtgat

SEQ ID NO: 60570 - DNA, 201 bp, Homo sapiens
ttatactttcgtcaaaaggtgtgcacattataaaatttggcaagcattgttaaattcatctaaaaactttgttccaatttatacccctaccccagcagtgkttttttttttccccctccatatttctcactggatcaagtcaaagtttttgtttgtttgtttaagatggagtctctgtctattgcccaggctggagtgtag

SEQ ID NO: 60571 - DNA, 201 bp, Homo sapiens
gtggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgagg

SEQ ID NO: 60572 - DNA, 201 bp, Homo sapiens
ctccatgttggtcgggctggtctctatctcctgacctcaggtgattcgcccgcctcagcctcccaaagtgctgggattgcaggcatgagccgccacccccrgcccacgtcaaagttttattaaagtttttgccaatgtgataaatgatatataattgttacttagttgcatttccctaatcagtagtaagtttaaacatct

SEQ ID NO: 60573 - DNA, 201 bp, Homo sapiens
tggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggc

SEQ ID NO: 60574 - DNA, 201 bp, Homo sapiens
ggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcg

SEQ ID NO: 60575 - DNA, 201 bp, Homo sapiens
cccctaatgtcattatgttctttttctctaaagtatctttacgcgttcagtattgttcccatgaagctaatggatgcagcagaactggtaaaacagcctcyggatgtcactgaaaacccttacagaaaatctgggcaggaagcatccataggaaagcaaattcttgcccctgtggtatgttctgattgagggttggcattt

SEQ ID NO: 60576 - DNA, 201 bp, Homo sapiens
ttagtcgagacggggtttcaccatattggccaggctggtctcgaactcctgaccttgtgatctgcctgccttggcctcccgaaggtattacaggcatgagycacccacgcctggcaagatctggtttttgacatgttgagcctaaggtttttgacatgttgagctatcaaggcattccaaaaatgttattaaataggcaat

SEQ ID NO: 60577 - DNA, 201 bp, Homo sapiens
tatagtttagtacataagacaagtttaatcgttagaatctaaatcttttttttccccttgggaaatcatgatgatgtttagaaaatcttagtagatttcarctaagcttagtgttttttattgtagtttggggttaacagtttgatacattaggtctttctttgtccaaactggattcagacgtttggggttacagtttta

SEQ ID NO: 60578 - DNA, 201 bp, Homo sapiens
tgaggagcacaggctcagcccattgtggcagtgttgtataccagtcttttcaggatataaaaatcagacaaagctgagttctgtggggtgattatatgctstagtgcttggaccatagtaacacctggctttcttttacatgaagctcagcctccaggaccctgctggttttgccttgctagccctgaagtggaaaaacat

SEQ ID NO: 60579 - DNA, 201 bp, Homo sapiens
ctgttggaaatcccagagcactctgacatcaagcaggtgaaacaggggatggtgatattcagggaagagtaaatatctgttttttttgttgttgtttgttstttgtttgtttgtttgagacagagtcttgctctgttgcctaggttggagtgcagtggcatgatcttggctcactgcaacctccgccttccgggttcaagt

SEQ ID NO: 60580 - DNA, 201 bp, Homo sapiens
tgagacaaagtctcgctctgtcacccaagcaggattgcagtggcataactgtggctcactgtagcctcaacctcctgggctctagagttcctcccacctcrgcctcatgagtagctgggaccacaggcgcatgctaccatgcctggcaaacttttttgattttttatagagacaggagggtctccctgtgttgcccaggct

SEQ ID NO: 60581 - DNA, 201 bp, Homo sapiens
ctgcactccagcctgggcgacagaacgagactctcaaaacaaaacaaaacaaaacaaaacaaacaaaaaacaatacaaataatggccgggcgcggtggctsacgcctgtaatcctagcactttgggaggctgaggcgggcggatcacttgcggtcaggagttcgagaccagcctggccaacgtggtgacaccccgtctcta

SEQ ID NO: 60582 - DNA, 201 bp, Homo sapiens
gctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcgg

SEQ ID NO: 60583 - DNA, 201 bp, Homo sapiens
ctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcggg

SEQ ID NO: 60584 - DNA, 201 bp, Homo sapiens
gcacaaggatatagcaaagctagggaagatcgagagaagggctgctaaagtgatgaaggaagagagaaagacacatatgatgctctgtaaggaaggatgakaaaatgaggcccctttgttttgcggggagctaaaaattgattttgatcaaggcttataaataaccatacagtatatttatggaggagaaaagtatagttc

SEQ ID NO: 60585 - DNA, 201 bp, Homo sapiens
taatcctagcactttgggaggctgaggcgggcggatcacttgcggtcaggagttcgagaccagcctggccaacgtggtgacaccccgtctctactaatacaaaaaaaaaaaattagccaggcgtggtggcgcgtgcctgtaatcccagctacttgggaggctgaggcaggagaatcgcttgaacccggaggcggaggttgc

SEQ ID NO: 60586 - DNA, 201 bp, Homo sapiens
gggttatgttctgagaaatgagttggtaggcgatttcgtcattgtgcgaacatctttgagtgtacttccagagacctagatggtatggcttcctgtacacytaggctaaatggtatagctgtacgtcaagttactgtactgaatactgtaggcaattgtaacacaatggtaagcatttttgtatttaaatatagaaagggt

SEQ ID NO: 60587 - DNA, 201 bp, Homo sapiens
gaagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgatagga

SEQ ID NO: 60588 - DNA, 201 bp, Homo sapiens
tgtacgtcaagttactgtactgaatactgtaggcaattgtaacacaatggtaagcatttttgtatttaaatatagaaagggtacagtgaaaacacctggcygggtgtggtggcttatgcctgtaatcccaacactttgggaggccgaggtgggtggatcacctgaggtcagaagttcaagaccagcctggccaacatggtg

SEQ ID NO: 60589 - DNA, 201 bp, Homo sapiens
aagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgataggag

SEQ ID NO: 60590 - DNA, 201 bp, Homo sapiens
ttcagtagtaataacatgcatgaagctgtcatctcctatgataacagtgccctctggaatacttcctgaaggacctgcctgaggcttttttacagtcaactttttttttttttttttgaatacgtaggagtgtactctaaacagtaaagagcataccatactgaatatatttttttttttttgagatggagtcttgctctg

SEQ ID NO: 60591 - DNA, 201 bp, Homo sapiens
tctaaaggttagttgaataacatttaatcttctgcttttggccattccaggaagaatcagcctgtcagtttttctttgatttaaatgaaaagcagggaagraagcgttcatccacaggtagagatagcaaatcttctcctcatccaaagcagcctcgcaaacctcgtaagtacctttattccagaggtttcttctatgaac

SEQ ID NO: 60592 - DNA, 201 bp, Homo sapiens
tctcctatgataacagtgccctctggaatacttcctgaaggacctgcctgaggcttttttacagtcaactttttttttttttttttgaatacgtaggagtrtactctaaacagtaaagagcataccatactgaatatatttttttttttttgagatggagtcttgctctgttgcccaggctggagtgcagtgccgcgatct

SEQ ID NO: 60593 - DNA, 201 bp, Homo sapiens
tttatagcttcagattcagaaactagagccttatgaaatttttttttttttttttttgagatggagtctcgctctgttgcccaggttggagtgcaatggcrtgatctcagttcactgcaacctctgcctcccgggttcaagtgattctcctgcctaagcttcccaagtagctgggattacaggcacctgccatcacatctg

SEQ ID NO: 60594 - DNA, 201 bp, Homo sapiens
aggacctgcctgaggcttttttacagtcaactttttttttttttttttgaatacgtaggagtgtactctaaacagtaaagagcataccatactgaatatatttttttttttttgagatggagtcttgctctgttgcccaggctggagtgcagtgccgcgatctcagctcactgcaagctctgcctcgtgggttcatgctat

SEQ ID NO: 60595 - DNA, 201 bp, Homo sapiens
tctgcccgcctcagcctcccaaagtgctgggattacaggcgtgagccaccacccccggcctatgaatttttatctggaattatgtaatgctggaagctgaktcacactaactgatcacatcaaagataaaatttcagttttgcttagtagtggagggtgtagcttactaatgacaggaatacccatattcacactcctggt

SEQ ID NO: 60596 - DNA, 201 bp, Homo sapiens
gggtgaggtggggtggagtggagtggaggttgcagtgagccaaggtcgtgccactgcactttagcctgggtgacagagtgagaccctgtctcagaaaaagaaaaaaaaaaagtttggcgaggtgtacaataaaagcacgccagaaagagacactcacaaaacaataaaattttaatatttcaagatgagttaaaagacatt

SEQ ID NO: 60597 - DNA, 201 bp, Homo sapiens
tggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtc

SEQ ID NO: 60598 - DNA, 201 bp, Homo sapiens
aatgtgtgtgtctcatgggaaagtcattctatttcacatttccccagatacttttgcttgggtagggctggattagacattaaataataccagtgtttgastctgatttccctgggttttctgtagaccattgttctttttcattcatttagaatgaagaaaacttaatttttaacactatagtcaccagtgactagaatt

SEQ ID NO: 60599 - DNA, 201 bp, Homo sapiens
atttaagtgagcaagaagagaataccccccttaccataatcccacagcctaatgcagaatcataggtaatacaggtttttctgttaaatctccatatactyattctagaagaatgtcttgttctctaaaaatatactgcgaaaacagaagttttgggaacaagccactcaaaacttacacagttcttaagaatcggaatac

SEQ ID NO: 60600 - DNA, 201 bp, Homo sapiens
atggactaagacaattccttaagtgtgtagtgcttctgaagacaggtgccttcatccatttctcattgatttgttctacttttggtttctggggttgatcstttcaacttatcctaacaatctgaggaccgttttttgtgtcttccttcctgtagactgactagagtctcaatttcatcttacactttaaggagttacact

SEQ ID NO: 60601 - DNA, 201 bp, Homo sapiens
ttctcatctaggcctgaaactagaggggaaaaaggtcttgtttgtggcccaacccaacatcccaagtaggccacatgagtatttcagcctagagtctacaytgtccttaggtagaaacctcttacaaacctgtaatgacctttgggtgtctgtggaagagtttgggatctcctccctgcaattattctttttgattgcctt

SEQ ID NO: 60602 - DNA, 201 bp, Homo sapiens
aactattcacaaaaattgcaagtacaggattagagatggtgcagaggagctctttagtttagacatcattacctaaagaatgcacatcataatagagaagytgatgtttatggcagtgaccttctgacaaaaatagctagacgactcaggcttctagagtaaccttttaaacaaatacaatataaagtggttattatacaa

SEQ ID NO: 60603 - DNA, 201 bp, Homo sapiens
gtggatcacctgaggtgaggagtttgagaccagcctggccaacatggtgaaaccccgtctttactaaagctacaaaaattagctgggcgtggtgccaggcrcttgtaatcccagctactcaggaggctgaggcaggagaattgcttgagcctgggaggtggaggttgcagtgagccaagatcgctccattgcactccagcc

SEQ ID NO: 60604 - DNA, 201 bp, Homo sapiens
tcttgaactcctgacctcgcgatccatttgccttggcctcccaaagtgctgggattacagtcatgagccaacgcacccggtctggataattgttttctaamgtatctatatttgcctgtactggtactcattgggcccttctgtgctcactcatggcatcttcccatcagagaatatctgagtggtagaccattcttgcat

SEQ ID NO: 60605 - DNA, 201 bp, Homo sapiens
gaggagtttgagaccagcctggccaacatggtgaaaccccgtctttactaaagctacaaaaattagctgggcgtggtgccaggcacttgtaatcccagctrctcaggaggctgaggcaggagaattgcttgagcctgggaggtggaggttgcagtgagccaagatcgctccattgcactccagcctgggtgacagtgaaac

SEQ ID NO: 60606 - DNA, 201 bp, Homo sapiens
ctggctcgccgcttccggaaagactttgagccctatgactttactctggatgactaaaacaaagggaagaactttttatgaactccacaggaagtagtaargcttttttttttttttaattaaaagaattttttttgagacaaagtctcgctctgtcacccaagcaggattgcagtggcataactgtggctcactgtagcc

SEQ ID NO: 60607 - DNA, 201 bp, Homo sapiens
cttttctgcctctttggatgcatctgagtttgaggttttactttccttctaccccattaggttgtatgtttgcttttgttttgtagaatttagtcagcagsttaaggcttaggaacattagatgctaatcatgccatcttagctttttttgtgagcccaaggagtatattcgggggtgggggtgggaatgaaagttactgg

SEQ ID NO: 60608 - DNA, 201 bp, Homo sapiens
ggattagtttatgctatttttctctcccacacaatttgtatagtaagttaggctttgaattgccttctgtttgggaagcttcaataggttcaagatcacaygcaggagataagagatttggaatgtgtgacatagctcagtgctgctctaggcctcagtgagaagtgacttttcttttccattcatctttctattgtccag

SEQ ID NO: 60609 - DNA, 201 bp, Homo sapiens
aggagtgtactctaaacagtaaagagcataccatactgaatatatttttttttttttgagatggagtcttgctctgttgcccaggctggagtgcagtgccrcgatctcagctcactgcaagctctgcctcgtgggttcatgctattctcccgcctcagcctcctgagtagctgggactacaggcgcccgccaccacgcccg

SEQ ID NO: 60610 - DNA, 201 bp, Homo sapiens
acatcactaggcgataggaattttttagttccattataatcttatgggaccaccattacatatgtggtcccttgttgaccgaaacattgttatgtggcacrtaactgtattcttgtctttaacctaaaaaggttattgaaatgcttaagaacgctttggcatgatcaaattttcattttggaaagcagttctgtctgcaat

SEQ ID NO: 60611 - DNA, 201 bp, Homo sapiens
catttttatatgtgttcttttcctagttatagtttagtacataagacaagtttaatcgttagaatctaaatcttttttttccccttgggaaatcatgatgrtgtttagaaaatcttagtagatttcagctaagcttagtgttttttattgtagtttggggttaacagtttgatacattaggtctttctttgtccaaactgg

SEQ ID NO: 60612 - DNA, 201 bp, Homo sapiens
ggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtcc

SEQ ID NO: 60613 - DNA, 201 bp, Homo sapiens
tttctgtgaaatcttcacagtaaaataggttgattacagttgggtaaatagtatttcccctaatgtcattatgttctttttctctaaagtatctttacgcrttcagtattgttcccatgaagctaatggatgcagcagaactggtaaaacagcctccggatgtcactgaaaacccttacagaaaatctgggcaggaagcat

SEQ ID NO: 60614 - DNA, 201 bp, Homo sapiens
gtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtcca

SEQ ID NO: 60615 - DNA, 201 bp, Homo sapiens
ggattgcagtggcataactgtggctcactgtagcctcaacctcctgggctctagagttcctcccacctcagcctcatgagtagctgggaccacaggcgcawgctaccatgcctggcaaacttttttgattttttatagagacaggagggtctccctgtgttgcccaggctggtctgtaatgcctaggctcaagggatcctc

SEQ ID NO: 60616 - DNA, 201 bp, Homo sapiens
aggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtccaca

SEQ ID NO: 60617 - DNA, 201 bp, Homo sapiens
ggcatgtggatcacctgaggtcaggggttcaagaccagcctggccaacatggtgaaaccgtgtgtctactaaaaatataaaaattagcagggcatggtggygcatgcctgtaatcccagctcctcgggagactgaggcaggagaattgcttgaacctgggaggcggagattgcagtgagccgagattgcaccactgcactt

SEQ ID NO: 60618 - DNA, 201 bp, Homo sapiens; identical to SEQ ID NO: 24457

SEQ ID NO: 60619 - DNA, 201 bp, Homo sapiens
gcagggcatggtggcgcatgcctgtaatcccagctcctcgggagactgaggcaggagaattgcttgaacctgggaggcggagattgcagtgagccgagatygcaccactgcacttcaccctgggcgacagagcaaggctctgtctcaaaaaaaaaaaaataaaataaataaaatagccaagctacaaggttgggtgtagta

SEQ ID NO: 60620 - DNA, 201 bp, Homo sapiens
ataatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtgg

SEQ ID NO: 60621 - DNA, 201 bp, Homo sapiens
cacctcccgggttcaagtgattctcctgcctcagcctcctgagtagcttggattacaggcgtgtgtgaccatacccggctaattttttttatatttttagyagagacagggtttcaccgtgttagtcaggatcatctcgatctccttacctcgtgatccgcccacctcggcctcccagagtgctgggattacaggcgtgag

SEQ ID NO: 60622 - DNA, 201 bp, Homo sapiens
taatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggc

SEQ ID NO: 60623 - DNA, 201 bp, Homo sapiens
aggtttcaccatattggtcagcctagtctggaacttctgacctcaggcggtccacctgcctcggcctctcaaagttttgggattacaagcgtgagccactrtcccagccgaaagtggtcattttgaaatcagaagttgtatctttttgtggttgagggtgataaaaactgaaaaactgttttcaagtttggagcatgggag

SEQ ID NO: 60624 - DNA, 201 bp, Homo sapiens
tttactatatgaatttagtgccaggaaaggaaagagcagctaaggtacttgggttatttctgtgaaatagattttttggatccagtaggaggatcaagcartgaacttggtagtgaacatgtgatagtgagcttgaaatactggtaggacatccaacatatagttggaagtgagagttattattattattttttgagatgg

SEQ ID NO: 60625 - DNA, 201 bp, Homo sapiens
aatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggca

SEQ ID NO: 60626 - DNA, 201 bp, Homo sapiens
gttgctacaatctctaaaatcagattttttcaagaaagaatttttattaataacctcaagtacttttcgcctacaccctcaggctcactttttgtataggyttttctccctggagaatcctacatgctgtattgatgtctcaattctgtgtgctgcttcttcagtgctaccttgccctggccaaaggaggcttatctgatg

SEQ ID NO: 60627 - DNA, 201 bp, Homo sapiens
atagtcttggctcactgcaacctctgcctcccggattcaagcgattcttctgcctcagcctcctgagtagctggggttacgggtgtgtgccaccatgcccrgctaattttgtattttttagtagagacagggtttcaccatgttggtcaggctggtctcgaaatcctgacctgaggtgatccagctgcctcagcctcccaa

SEQ ID NO: 60628 - DNA, 201 bp, Homo sapiens
atgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggcat

SEQ ID NO: 60629 - DNA, 201 bp, Homo sapiens
gggcaacagagtgagactccgtctcaaaaaaaaaaaaaaaaaaaaaaaaggccaatagacatataaaaagatgctcttatcattagccattatggtaatgyaaatcaaaagcacaatgatacaccacttcatacccactaggatggcagtagtcaaaaaggcaaatacataataacaagtgttgacaaggatgtggaggaa

SEQ ID NO: 60630 - DNA, 201 bp, Homo sapiens
ccgccttccgggttcaagtgattctcctgcctcagcctccccagtagctgggactacaggcatgcgccaccatacctggctactttttgtatttttagtcragacggggtttcaccatattggccaggctggtctcgaactcctgaccttgtgatctgcctgccttggcctcccgaaggtattacaggcatgagccaccca

SEQ ID NO: 60631 - DNA, 201 bp, Homo sapiens
ccaggcgtggtggcagacgcccgtagtcccagctacttaggaggctgaggcaggagaatggcatgaacctgggaggcggagcttgcagtgagccgagatcrcgccactgtactccaccctaggcgacagagcgagactccgtctcaaaaaaaataaaataagaatggcctgacttcgaggctgttctgaggcgcttcctgt

SEQ ID NO: 60632 - DNA, 201 bp, Homo sapiens
gctactcaggaggctgagagtcaggaggatcacttaagcctaggagtttgaggatgcagtgaggtatgattgcaccactgtacttcagcctgggcaacatygcaagaccctgtctctaaaaaaaaaaaaaaaaaaaagaggcagtggacaatttggaactagagcactgggtattgactagactggagatgaacagggcat

SEQ ID NO: 60633 - DNA, 201 bp, Homo sapiens
taaagaattgtatattgaaatctgcaaattgattaagaattaaaaactgatttgaaactattaaataactagttgaatattactatcaattatgtactgtwtgatattttaaaatctcatatatctgtttaaaaaactcattttagctgctgttgtgtgtaggaaatttctttggctccacccaagatgctgaatgggagg

SEQ ID NO: 60634 - DNA, 201 bp, Homo sapiens
ccgtagtcccagctacttaggaggctgaggcaggagaatggcatgaacctgggaggcggagcttgcagtgagccgagatcgcgccactgtactccaccctrggcgacagagcgagactccgtctcaaaaaaaataaaataagaatggcctgacttcgaggctgttctgaggcgcttcctgtactatggaaaaagcaccttt

SEQ ID NO: 60635 - DNA, 201 bp, Homo sapiens
tgctatgaacagagtggtgggctacatgggacaattgataaaaagctaaattgtaaacagtccttgccccagaggacccatggtcttagggcagatgtttwcatatatgacagtaatgtaatgtagaatgtgaagagtaccatgacagagttttggagaacaatgtgctgtagaaattcagaaaagggacagctcatttct

SEQ ID NO: 60636 - DNA, 201 bp, Homo sapiens
aaatgaggctctagagcagtgcccggtagacttttcacaacgatggaaatgctcaaatatctgcactgtccaatacagttgtgactagccacttgtggccmctgagtgctgaaatgtggctaatgtgactgaggaactaaatttttgattttatttaattaattagaatttaaatttaaatagccatacctggctaatggt

SEQ ID NO: 60637 - DNA, 201 bp, Homo sapiens
gaaatgtggctaatgtgactgaggaactaaatttttgattttatttaattaattagaatttaaatttaaatagccatacctggctaatggttaccccactrgatagcaggctgtagagagcttaggtagcttgtcctagtcacacagtggtaggttcaaacccaggcctgttggacctcaaaacttgaggtcttaacctca

SEQ ID NO: 60638 - DNA, 201 bp, Homo sapiens
acctgaggtgaggagtttgagaccagcctggccaacatggtgaaaccccgtctttactaaagctacaaaaattagctgggcgtggtgccaggcacttgtartcccagctactcaggaggctgaggcaggagaattgcttgagcctgggaggtggaggttgcagtgagccaagatcgctccattgcactccagcctgggtga

SEQ ID NO: 60639 - DNA, 201 bp, Homo sapiens
caaaaccatagagggagtaacataacttaagcaaagattgaagatgggaagttgctggcaagaagatacagtttgaaggggagtggaaaatgtgtagaacrgagtatctgatgctggtgtctgtgatttgcagctgttttttctcccctagttaaaaatgggctttgagtgagccttgaacctgtcttggactaattcaga

SEQ ID NO: 60640 - DNA, 201 bp, Homo sapiens
aggtgaggagtttgagaccagcctggccaacatggtgaaaccccgtctttactaaagctacaaaaattagctgggcgtggtgccaggcacttgtaatcccrgctactcaggaggctgaggcaggagaattgcttgagcctgggaggtggaggttgcagtgagccaagatcgctccattgcactccagcctgggtgacagtg

SEQ ID NO: 60641 - DNA, 201 bp, Homo sapiens
gtgtgtgagtgtgtctgtatgtagttattctttagtcctaagagccaagatagttgttttgttgacattgggcttgtgctgctgttacgtgggcctgagtyccctagaaggagaggcagaggaattttaaatcagagtgggtatgactaggctcctgactctgcaaactcatgtctagttgaggtgacaaaactacagttt

SEQ ID NO: 60642 - DNA, 201 bp, Homo sapiens
cctttccctcttgattcttccttgaggcgcaaacacctgagagaggcttctgtccctcggcggtctccgtaagtaagtgaaccgttattggctggagggcrctgacgtctgattgttgcgcggtcgcatttttccggggaacgcggattcgcattcccaattttaggtggcagtcgcaacccatactattcggacagatgg

SEQ ID NO: 60643 - DNA, 201 bp, Homo sapiens
tttaggatgggtagggtggaactaccctagggaatgacagaggcagagagtaatcaaattgccagttcagttaagaaaacttggagaaagtactagaaagrtgacaggtcagggcctgtggaaagctgtggttctataggcagtggggaacctcttaatgttttgaggaaagaacattaaactgactactttctgtaggat

SEQ ID NO: 60644 - DNA, 201 bp, Homo sapiens
tctttgctatcagtgatgactggcacattacatggtcaagaacagcagtcaaagataataggtttgtgtacccatggaatgagaaagtgagtcccttcccstaccacagtgttctgtactccatggaatcggtcaaagatgacagctctttgctcagcatccacattatatagggcagagttcaccacgtctcctgcaaca

SEQ ID NO: 60645 - DNA, 201 bp, Homo sapiens
ctaaaaaggcagtcttctgttgcttatatacctgtattgggttaaaaatgttgatattctttttatagcttcagattcagaaactagagccttatgaaatttttttttttttttttttgagatggagtctcgctctgttgcccaggttggagtgcaatggcgtgatctcagttcactgcaacctctgcctcccgggttcaa

SEQ ID NO: 60646 - DNA, 201 bp, Homo sapiens
gactttcttattatagatgagaagtgattccttccttcagccttaactttgagcccaccacactaagagcatagttggaataattttttattttttttccygagacagtcttgttctgtcgcccaggctggagtgcagtggcacgatctcggctcactgtaacctccgccttccaggttcaagcaattcacctgcttcagt

SEQ ID NO: 60647 - DNA, 201 bp, Homo sapiens
cttagctactcaggaggctgagagtcaggaggatcacttaagcctaggagtttgaggatgcagtgaggtatgattgcaccactgtacttcagcctgggcarcatcgcaagaccctgtctctaaaaaaaaaaaaaaaaaaaagaggcagtggacaatttggaactagagcactgggtattgactagactggagatgaacagg

SEQ ID NO: 60648 - DNA, 201 bp, Homo sapiens
attttttgtattttagtagggatggggtttcactatgtgcatcttttctagactgtagcttccttagaactgtatttttcttcgcattgccttttcctgtstccagatgtctgcatttaagtccatgtagaatcttctctagaacgcagaaagccttttccctaatcttctcttcccaactttttccagtaatatttgtaa

SEQ ID NO: 60649 - DNA, 201 bp, Homo sapiens
ttcccaccagcagtgtatgaaggtttctgcttttccacatccctgtcaacatttgttatagcaatagccagttttacaagatagctctcttttcctctctyataaataggtatggttctctaggggtgatgcttttatatacttcttggactctctgtattttttagcccgtctaattgagagtgatgagttccttttgct

SEQ ID NO: 60650 - DNA, 201 bp, Homo sapiens
agctgctggagagtttacacttcagacatgtaaaatggcagggacataggagagtcatgggagattcatccccctattgatggcttttcattctgcaattytgactaaaatttgttcatttttctttgaacccaggtcgtaaaggtatcttcactggaagctcggggctgcagattgtgtacctcagtgggacagaatcct

SEQ ID NO: 60651 - DNA, 201 bp, Homo sapiens
gtttgggttgtttctactttatggctattagaaataatgctcccataaaatatctgcatgcaagtctttgtgtggatatagacctaggaatggtctatatkttggatagacctaggaatggatttgctaggttatatagtaaatttatgtttaacttttaagaaactgctaaactgttttccaaaatgactgcaccatctt

SEQ ID NO: 60652 - DNA, 201 bp, Homo sapiens
cactggtggaagtaagcctaaggaagattttgaaaaggttatgtgtgagggcagaaaacactgggtgagcttcattgaagggaaatgtaagaatgcatttsggaacaaatctccatggttggattcaggattatcagtgatgatccagaagtggagcctgtataccaccccttgccagtttcagcaccatgtgtccatgac

SEQ ID NO: 60653 - DNA, 201 bp, Homo sapiens
acaggcgtgagccaccatacctggccagattttaatattttatgagtaatcttgaaaaggatggtacaccaggagtgacaactatcatggggagtgaaacrctacactggtggaagtaagcctaaggaagattttgaaaaggttatgtgtgagggcagaaaacactgggtgagcttcattgaagggaaatgtaagaatgca

SEQ ID NO: 60654 - DNA, 201 bp, Homo sapiens
gtttttactgaatttaattttacctttgtagtcacacataaaaataaagtttgcactcctttaagtcttgattgaacacataccatttttgttaaattgarttcccttcatgagcataggaacttagtagctgctgagtggctgggggagggagacctatttactgtttactattgatctttatattttttgaatttgaat

SEQ ID NO: 60655 - DNA, 201 bp, Homo sapiens
aattttttaccacaaataaatatgagataatgtatatgttaattagcttgatttagccatcccacagtatatacacatttcaaaacagcatgttgtatacmataaaaaatacaaattttagttatcaattaaaaataaatgagagggaaaatttaaaaaatttttttttgtcttttttttttttttgagacggagtctcgc

SEQ ID NO: 60656 - DNA, 201 bp, Homo sapiens
atgggttcataaaataatagaatgatcaaactcgaaggaaggactttaagagtgtttcattgagattctctttcttcatctttttgtttcacacaagaagstgaccttgggagggtaaattttccagggtcatggctaatggcatagctggggctttaattggggctcctgacacccagttcagtgttcttttgttgtagc

SEQ ID NO: 60657 - DNA, 201 bp, Homo sapiens
tgatattttattcaatagagttcaagcaattcagaagaaaagtggaaactttgatgtaagatgtttgtttttactgaatttaattttacctttgtagtcayacataaaaataaagtttgcactcctttaagtcttgattgaacacataccatttttgttaaattgagttcccttcatgagcataggaacttagtagctgct

SEQ ID NO: 60658 - DNA, 201 bp, Homo sapiens
cctggccaacatggtgaaaccccgtctttactaaagctacaaaaattagctgggcgtggtgccaggcacttgtaatcccagctactcaggaggctgaggcrggagaattgcttgagcctgggaggtggaggttgcagtgagccaagatcgctccattgcactccagcctgggtgacagtgaaactccatctcaaaaataaa

SEQ ID NO: 60659 - DNA, 201 bp, Homo sapiens
tgagaccctcagtggatctgcccagtggtttacgtgcactgaaccttgcaaggtaactgcagagagactagatcatgtatctatctaatccaaaagaccartatataccaaacccggcaggcccatttgtttcctgaattgctataatgtttatctctttgtttgcagcttggcttgtggagatgttgaaggaaagtttga

SEQ ID NO: 60660 - DNA, 201 bp, Homo sapiens
gctctgtcgcccaggctggagtgcaatggcatgatctcggctcactgcaacctccgtctcccaggttcatgccattctcctgcctcagcctcctgagtagytgggactacaggcgaccgccaccacacctggctaattctttgtatttttagtagagacagggtttcaccgtgttagccaggatggtctcgatctcctgat

SEQ ID NO: 60661 - DNA, 201 bp, Homo sapiens; identical to SEQ ID NO: 24477

SEQ ID NO: 60662 - DNA, 201 bp, Homo sapiens
cactgcaacctccgtctcccaggttcatgccattctcctgcctcagcctcctgagtagctgggactacaggcgaccgccaccacacctggctaattctttrtatttttagtagagacagggtttcaccgtgttagccaggatggtctcgatctcctgatatagaggtcaagttcttaaagaatatactgccaagaaaacca

SEQ ID NO: 60663 - DNA, 201 bp, Homo sapiens
agttttagtcccaaggatgtgtcttctctgagaatgatgctgtgtacaacctcccagtttaagggtgttgatatcttgctcacatccccatggcccaagtrtgtggggaactttgggaattcttctgtgagtagtgtttgtttagttggaatttctaaaagcaaattgcactggcttgagttgggacttttttcttttcct

SEQ ID NO: 60664 - DNA, 201 bp, Homo sapiens
cctggctactttttgtatttttagtcgagacggggtttcaccatattggccaggctggtctcgaactcctgaccttgtgatctgcctgccttggcctcccraaggtattacaggcatgagccacccacgcctggcaagatctggtttttgacatgttgagcctaaggtttttgacatgttgagctatcaaggcattccaaa

SEQ ID NO: 60665 - DNA, 201 bp, Homo sapiens
gccaccatacctggctactttttgtatttttagtcgagacggggtttcaccatattggccaggctggtctcgaactcctgaccttgtgatctgcctgcctyggcctcccgaaggtattacaggcatgagccacccacgcctggcaagatctggtttttgacatgttgagcctaaggtttttgacatgttgagctatcaagg

SEQ ID NO: 60666 - DNA, 201 bp, Homo sapiens
cattctacaggaaaatgcacagcatgccacccggtttatagctctggcaaatgttggaaatccagaaaagaaaaaggtaaagatttacctatttggtggarggttgatattcatggtctgcctgataaatgtatctcttgtccagtttagcattcagatcttctcttctccctgactgcaaggtctcagcagtttcggaga

SEQ ID NO: 60667 - DNA, 201 bp, Homo sapiens
tgtatttttagtcgagacggggtttcaccatattggccaggctggtctcgaactcctgaccttgtgatctgcctgccttggcctcccgaaggtattacagkcatgagccacccacgcctggcaagatctggtttttgacatgttgagcctaaggtttttgacatgttgagctatcaaggcattccaaaaatgttattaaat

SEQ ID NO: 60668 - DNA, 201 bp, Homo sapiens
ccttacagacaggctgacacaggcttgtctggcctgaggatattctgtgctgaggggtgtttctccacccctgtgatggatttgctacttctcagagactrtgcaggcacaacttctctgggacctgcacaaggaatttctcctgtctccccaacccccaggtcattcctgtcccaatcagctgctctactactgatgaca

SEQ ID NO: 60669 - DNA, 201 bp, Homo sapiens
aggaggctgaggcaggagaattgcttgagcctgggaggtggaggttgcagtgagccaagatcgctccattgcactccagcctgggtgacagtgaaactccrtctcaaaaataaaagaataaaagtatgtctgtcatccagctcctatgtctgttatccagctccaagtacagcttgtgtatatcaacattttcaaaaacct

SEQ ID NO: 60670 - DNA, 201 bp, Homo sapiens
gggacttgtgggcctcagggcttggggcaggcatgggactggcccaggcacacaggtcccggggcatcaggagaaaggctgggtcttgggaccttgtcctycccagttggcctactgttacacattaaaacgatttgcccagctccttctgtgtcctctcttgcctctggcctttctctggggcacaggcctcttacggct

SEQ ID NO: 60671 - DNA, 201 bp, Homo sapiens
agcctggcttggtgttgctgaggtctaaagagattagacttgacacgggggtgctgggagaagggacagctttagaagagaaggatgagctgtttcatctygcttccgtttctccaggttcatggatcaacatccggagatggatttttccaaggctaaattcaactagcccctgttttttcctccctgaactcttggggc

SEQ ID NO: 60672 - DNA, 201 bp, Homo sapiens
aggtgaggggcctcgttgtttccagagcttcaccgattcctgtcactgcctgccctcagctgtcagacctggacagtgagactcgcagcatggtggaaaaratgatgtatgaccagcgacagaagtccatggggctgccaacttcagacgaacagaagaaacaggagattctgaagaagtgagcaattcagagacggggtt

SEQ ID NO: 60673 - DNA, 201 bp, Homo sapiens
aggtggaggcgggcctgggcagccgcgcgcgtgcgtgtttccggctccgctgcggaaggcggacgactagagtcgttgggcccggcgcgacccgcaggagsgtagagagcgcgggactagagtgcagagctccgggacgtggatcggagccggcgcgatgggcggagagcaggaggaggagcggttcgacggcatgttgct

SEQ ID NO: 60674 - DNA, 201 bp, Homo sapiens
atgggcggagagcaggaggaggagcggttcgacggcatgttgctggccatggctcagcagcacgagggcggcgtgcaggaggtaacggcccgcgcggcgtyggcccacccggcggccttggccacgctccttccgcccttctctgccttcgagggctgagacccaccccagcggctcgcgggcttctgggatgcccctaca

SEQ ID NO: 60675 - DNA, 201 bp, Homo sapiens
tgtaaagacagggtctcatgttgcccaggctggtctgaaactcctgggctcaagggatcttcctgccttggcttcccaaagtgttgggattacaggtaggmgccactgcacctggcacttccctgcttaaaaactttttctggctgggcgtggtagctcatgcctgtaatcctagcgctttgggaggctgaggtgggcaga

SEQ ID NO: 60676 - DNA, 201 bp, Homo sapiens
cactgcgcccagcttccggcctggccacccgccagcaggtctcacccggttcgcatcagtcccgggcccccggcgcccctcagtagtagcaaattatcgcrtccctgagcttaggatccccctttagtttcacatatgcccccacccccgtttccactttgatggcggcttccaaggagcatcccttagtaagaaccgtcg

SEQ ID NO: 60677 - DNA, 201 bp, Homo sapiens
taaatcacgaggtctggagttcaagaccaacttggccaagatggtgaaaccccatctctactaaaaatacaaaaattagccaggcatggtggtgggcgccygtaatcccagctactcgggaggctgaggcagagaattgcttgaacccgggaggcggaggttgccatgagccgagatcacgccactgcactccagcctggg

SEQ ID NO: 60678 - DNA, 201 bp, Homo sapiens
tcaccatgttggccaggctggtcttgaactcctgacctcaagtgacccgcccacctgagcctcctgaagtactgggattataggtgtgagccagtgtcttsatgggctttttactttctggagaggaaagctgggcccaggcttttcatgccctggatgcagaggagtgttccatacgcttaggctgcttctagcatcaca

SEQ ID NO: 60679 - DNA, 201 bp, Homo sapiens
caagcagttcttctgcctcagcctcccaagtagctgggattacaggcacccaccaccacgcccggctaatatatatatatatatatatatatatatatatwtttttttttttttttttttttttttttttttttttttgagatggagttttgctgttgttgcccaggctggagtacggtgtcctgatctcggctcaccaca

SEQ ID NO: 60680 - DNA, 201 bp, Homo sapiens
gagagagatgaaccgtgtgtgtgtgtgtgtgtgtgtgtgtgtgtgtgtgtgtgtgtgtgtgtcagggtcttgctctgttgtcccagctggagcacagtggygtgatccagccgccttagcctcccaaagtgctgggactacctaatttttctttttcttttttttttttttttgagacggagtcttgctctatgacctagg

SEQ ID NO: 60681 - DNA, 201 bp, Homo sapiens
catacgcttaggctgcttctagcatcacaaggaaagtgaaaggcgcacacacacacaggatatgagaaatctgcttcatggtggaagtgactaagagaacytgctggggagataatctcctcagttgggaagctcagaggaaaaatagtcaagtcccaagttccctcctagacaaaacaagttgacttgtgtgcagttgaa

SEQ ID NO: 60682 - DNA, 201 bp, Homo sapiens
aattggctcaagagaattttgcaccttatccaaagtcttgagctgagctgtgggagaaccagggttgaaaccagtctgttgtaaacctgtcctctgccccracacagtgcctctcagttccttttccaatgaggaggttttatttatttatttattttctgagacagagtcttgctttgtcacccaagctgaagcgcagtg

SEQ ID NO: 60683 - DNA, 201 bp, Homo sapiens
tacacttgtaatcccagcactttgggaagatgaggcaggtggatcacttgacccaggagtttgagaccagcctgggcaacatggcaaaaccttgtctctayaaaaaaatacaaaaattagccaggcatggtggcatgtacttatagtcccagccactggggaggctgaagtgggaggatcaccttagcccagggaggtcga

SEQ ID NO: 60684 - DNA, 201 bp, Homo sapiens
cttgatgtgttcaccaccctagaaactccaaaccccattgtttaggggggtttttgttttgagacaggttctcactctcacgcaggttgtagtgcagcggygcaatctcggctcactgtaaccttcagttcacagcaacctccggctcccaggctcaagcagtccttccatcttagcctcccgagtagctgggactgcagg

SEQ ID NO: 60685 - DNA, 201 bp, Homo sapiens
ggggtttcaccgtgttagccaggatggtctcgatctcctggcctcgtgatccacttgccttggcctcccaaagtgctgggattacaggcgtgaaccaccgygcccggccaggacaggtttttttgtttttgttttttgtttttttttcttttgagacagagtctcgctctgtcacccaggctggagtgcagtggggcgatc

SEQ ID NO: 60686 - DNA, 201 bp, Homo sapiens
ccctcccgacaccttgatgtgttcaccaccctagaaactccaaaccccattgtttaggggggtttttgttttgagacaggttctcactctcacgcaggttktagtgcagcggcgcaatctcggctcactgtaaccttcagttcacagcaacctccggctcccaggctcaagcagtccttccatcttagcctcccgagtagc

SEQ ID NO: 60687 - DNA, 201 bp, Homo sapiens
agtccttccatcttagcctcccgagtagctgggactgcaggcatatgccaccgtgtctggctaatattttcgtatttttggtatagacggggtctcaccaygttgcccaggctggtcttaacctcctgagctcaagcgatctgcccgcctcggcctttccaaagtgctgggattaccggtatgagccactgtacctggtaa

SEQ ID NO: 60688 - DNA, 201 bp, Homo sapiens
agtcttgctctgtcacccaggctggggtgcagtgatgtgatcatggctcactggagtcttgacctcccaggctcaagcaatccccctgcctcagtctctcragtagctggaactacaggtaccactacactcagctaatttttgtattttttatagagacagggtcttcctatgttgcccaggctggtttcaaactcctgg

SEQ ID NO: 60689 - DNA, 201 bp, Homo sapiens
tgcctttacagagaggtaggacacagagatcagtaaataaaggtggtctgaaaagggccaagggtctgaggagaacttcccagggcacataagaccctgtmacagcctgtccgactggcactggctgccttcactcactcacccctccatgcctctgcacttgctttgtcgcccaggctggagtgcagtggcgcgatctcg

SEQ ID NO: 60690 - DNA, 201 bp, Homo sapiens
accctgtaacagcctgtccgactggcactggctgccttcactcactcacccctccatgcctctgcacttgctttgtcgcccaggctggagtgcagtggcgygatctcggctcactgcgagctccgcctcctgggttcatgccattctcctgcttcagcctccagtgtagctgggactacaggcgcccgccaccatgcctgt

SEQ ID NO: 60691 - DNA, 201 bp, Homo sapiens
aacccataagtcccagtccaaagctcatctgtgacaaggtattacttcgttctcatgctgctgtgaagaaatacccaagactgggtaatttataaaggacrgaggtttttttttttttttgagatggagtctcgctctgtcgcccgggctggagtgcagtggtgcaatctgggctcactgcaagctccgcctcctgggttc

SEQ ID NO: 60692 - DNA, 201 bp, Homo sapiens
caccatgcctggctaatttttgtatttttagtagagatgaggtttcaccatgttggccaggctggtctcgaacccctgacctcaagtgatccacccacctyggcctcctaaagcgctgggagtacaggtgtgagccactgcacccggcctgaggaggttttaactaataacctaggagatgagactgggcaaatattagaa

SEQ ID NO: 60693 - DNA, 201 bp, Homo sapiens
gttactcgggaggctgaggccggagaattgcttgaacccgggaggcagaggttgcagtgagccgagatggtgccacagcactccagcctggacaagaagarcaagactccatctcaaaaaatatatatatttattttcttcccattttaaatctggaatactgctttgtgtcttaagactcagcccgagtgtcactttcaa

SEQ ID NO: 60694 - DNA, 201 bp, Homo sapiens
gggtcttgctctgttgtcccagctggagcacagtggctgtaagaagggagagagatgaaccgtgtgtgtgtgtgtgtgtgtgtgtgtgtgtgtgtgtgtgkgtgtgtgtcagggtcttgctctgttgtcccagctggagcacagtggtgtgatccagccgccttagcctcccaaagtgctgggactacctaatttttcttt

SEQ ID NO: 60695 - DNA, 201 bp, Homo sapiens
agacgttctttgcaaaccgttttctgtggcttcaggattctaacaagttggtaaactctttaatgtgtcctgaatgtctgaggccactctgtcatagacamattacctaagagtaggagtcccaggttcttggtctagctttgtcacctagtcgagttcccagcaatgctctggttctttccatctttacatctgtaaaat

SEQ ID NO: 60696 - DNA, 201 bp, Homo sapiens
catgcaccaccatgcctggctaattttgtatttttagtagagacaggtttcaccatgttggttaggctgttctcaaactcctgacctcaggtgatcccccwgcctcagcctcccaaagtgctgggattacaggcgtgagccactgcacccggcctacttttttcaatgaatgtttattgaacacttaacactttggattat

SEQ ID NO: 60697 - DNA, 201 bp, Homo sapiens
tcagcccgagtgtcactttcaaacttttctccctccaccctggatgaatatctccctttctgctttcttctttcccttatcacactgatttgtaactcttygcctctgtgtctcccctagctgcaggaagggcacagtcttgtacctctggatccagtgtaggcctgcaagggtctcaggtgcaggatgtggatgggagag

SEQ ID NO: 60698 - DNA, 201 bp, Homo sapiens
aagataaaacaaaataacaagtgttgacaaagatagggagaaactggaacccttgtacactgtggtgggaatgtcaaatggtgcatctgctatggaaaacrttatggcggtttctcagaaagttaaagaatacaactatcgtatgttctagcagtcatgcttgtgggtatatacccaaaataatcaggaggaggatttact

SEQ ID NO: 60699 - DNA, 201 bp, Homo sapiens
aggcatgcaccaccatgcctggctaattttgtatttttagtagagacaggtttcaccatgttggttaggctgttctcaaactcctgacctcaggtgatccmccagcctcagcctcccaaagtgctgggattacaggcgtgagccactgcacccggcctacttttttcaatgaatgtttattgaacacttaacactttggat

SEQ ID NO: 60700 - DNA, 201 bp, Homo sapiens
aattctgaccgtaactacccagaattactgcagactccacaggttaaggactcagtcccataagacagtgcccacttgacacaccagttataagttccaarttgcctcgtgtacttctgaccaaccagctgtaaactggggtttgccatgaccaccttttcaggtttaataatttgctagaatgattcaaaactcaggaaa

SEQ ID NO: 60701 - DNA, 201 bp, Homo sapiens
gcctcctaagtaggtgggattacaggcatgcaccaccatgcctggctaattttgtatttttagtagagacaggtttcaccatgttggttaggctgttctcraactcctgacctcaggtgatcccccagcctcagcctcccaaagtgctgggattacaggcgtgagccactgcacccggcctacttttttcaatgaatgttt

SEQ ID NO: 60702 - DNA, 201 bp, Homo sapiens
agcctcctaagtaggtgggattacaggcatgcaccaccatgcctggctaattttgtatttttagtagagacaggtttcaccatgttggttaggctgttctyaaactcctgacctcaggtgatcccccagcctcagcctcccaaagtgctgggattacaggcgtgagccactgcacccggcctacttttttcaatgaatgtt

SEQ ID NO: 60703 - DNA, 201 bp, Homo sapiens
tactgtagatacttcatataaatggaatcatacaatatgtatgtctttgtgactggcttatttcgtttaatgtaatgtccacagatttatccacattgtarcatgtgacaggatttccatcccctttaaggctgaataatattccattatatgtatatatcacaatttttttttttctttttgagacaagtcttgctctgt

SEQ ID NO: 60704 - DNA, 201 bp, Homo sapiens
ggagcccaggagtttgaggctgcagtgacccatgataaacggcactgtaatccatcctgggcaacagagctaaaccctgtctcaaaaaaaaaaaaaaaaaatagtgggctgggcacggtggctcacacctgtaatcccagcactttggaaggccgaggtgggcagatcacctgaggtcaggagtttgagaccagcctggcc

SEQ ID NO: 60705 - DNA, 201 bp, Homo sapiens
tttgaagttgatagcttgcttgctggagagagggtgaacaggctcttccttcaagaaagctccctggctttgacctggcgcggtagctcatacctataatyccagcactttgaccgggcacggtggctcacacctataatcccagcactttgggaggctgaggcaggcggatcactggaggtcaggagttcgagaccagcc

SEQ ID NO: 60706 - DNA, 201 bp, Homo sapiens
cctttcttccctctccagcttatcacacagactttcagccaccacaatcagctggcacagaagacccggcgggagaagagagcccggcaggaggccgagcrgcgggagaaggcggagcgggcggccagactggccaaggaagccaagtcagagacctcagggccccagatcaaggagctaactgatgaagaggcagagagg

SEQ ID NO: 60707 - DNA, 201 bp, Homo sapiens
cttggggcaggcatgggactggcccaggcacacaggtcccggggcatcaggagaaaggctgggtcttgggaccttgtcctccccagttggcctactgttayacattaaaacgatttgcccagctccttctgtgtcctctcttgcctctggcctttctctggggcacaggcctcttacggctgctgctgggaactgggagtt

SEQ ID NO: 60708 - DNA, 201 bp, Homo sapiens
ggaagagaggaggtggaggcgggcctgggcagccgcgcgcgtgcgtgtttccggctccgctgcggaaggcggacgactagagtcgttgggcccggcgcgamccgcaggagcgtagagagcgcgggactagagtgcagagctccgggacgtggatcggagccggcgcgatgggcggagagcaggaggaggagcggttcgacg

SEQ ID NO: 60709 - DNA, 201 bp, Homo sapiens; identical to SEQ ID NO: 43246

SEQ ID NO: 60710 - DNA, 201 bp, Homo sapiens; identical to SEQ ID NO: 43270

SEQ ID NO: 60711 - DNA, 201 bp, Homo sapiens
actgcaggtggaagaactacagttcccagcagctattgcaagctcaacctccgtgcacactcaccccaggcctcacatccggcatgcgccgtgctcgctcrcagaactacactttccaactctccccacacgacccgtgacactctgtggaccgcgagcacggagcagggtttctacagctgctccccactttctcggacc

SEQ ID NO: 60712 - DNA, 201 bp, Homo sapiens
gaggagacccctgtcctcgaggagatcccaggctggtggagcaggagagtagagcagggcctgccttagtgggaaggctggagggtgggggtgacttgtcwgtatactcttgtcagggggtccttggaggaggcagggccttgggtgctaggtgggcccctacaccttcctgcttcccccgccttttctccccaggaggac

SEQ ID NO: 60713 - DNA, 201 bp, Homo sapiens
cagggaagtagtcgctttgtgttaaaattctgcccttaatgtgtacacttttatagcctagaagatgaatgccgccttaaacgaatgagtcaggaagcccytttctgtccggcccctccactccccaccacacgggttgttcctttttcccttggaagagcccactggactgcaggtggaagaactacagttcccagcagc

SEQ ID NO: 60714 - DNA, 201 bp, Homo sapiens
agtagctgggttaaggactgggaagtaagagtgttcgaattaagattagagtgagagtttataggggagtgaaggtgagattacatttccaagtgaagtasggtttggtgtttaagttgggggtagagtttaaattgccatggggtgggcgaatttaaggttaaatttgagtggtgggttttgggttagggtggggatggg

SEQ ID NO: 60715 - DNA, 201 bp, Homo sapiens
tgaaggaaggagagaagagcatggaaaattagggagaactgggagtagctgggttaaggactgggaagtaagagtgttcgaattaagattagagtgagagyttataggggagtgaaggtgagattacatttccaagtgaagtagggtttggtgtttaagttgggggtagagtttaaattgccatggggtgggcgaatttaa

SEQ ID NO: 60716 - DNA, 201 bp, Homo sapiens
aggaggcagggccttgggtgctaggtgggcccctacaccttcctgcttcccccgccttttctccccaggaggacacacgggctcagcggcagcggctgcaraagcaactgactgagcatctgcgccaaagctggggcctgcttggggcccccatacaagcccgggacctgggagaactgctgcaggcctggggtgctgggg

SEQ ID NO: 60717 - DNA, 201 bp, Homo sapiens
gtgagcctgacctccgagacctgcttctcttcttggctgagcgtctgcccaccgatgcctctgaggatgcagaccagcctgcaggtactgggtgtctgggrtgtgggcgggggcggtgaggggagaggagggccttctaggggctgtagggctgagagaggtagaggtggtaaaaaggttgatgggtaggggtggcggtat

SEQ ID NO: 60718 - DNA, 201 bp, Homo sapiens
atccatcccagtcacccctgacacagtgacacagtccctgtctggtacacatgaggaccctccactgctagccagcctgccccaggcaggggctcatggcygccatggtgtctgccagatcttgtctgatacgaaggagcttcagaaggaaatcaactccctatctgggaagctggaccggacgtttgcggtgactgatga

SEQ ID NO: 60719 - DNA, 201 bp, Homo sapiens
ggtggtggagggacgatagagtaactaccgtgaaaactttcatttagatataggggactgggtggctagagttgttaaatttgggccttgcttatgcagtytctgtctcttagcaacaggtctcagagctccatccatcccttcgctctcaggttcacccagctctcaggagttgtcacattgttctctctggggctcttg

SEQ ID NO: 60720 - DNA, 201 bp, Homo sapiens
gtgggctctggcctcagccctctgctgcctcttgccatgtctgcccggttccgcctggccatgagcctggctcaggcctgcatggtgagtggccctcctcytaatgcacacatcctctttcttcctcttttacaaagtaaccaagttcctttgcaacacttgcctttcctctgcaacacttgcctttcctctgcaacactt

SEQ ID NO: 60721 - DNA, 201 bp, Homo sapiens
tctgtctgaactgtaggcatcctccctgccccgaccctggtactagtgtttccaaaaggctgcagggctcagcctgatccctgttgcctgactattcctgygatcaagctggtccccttcttcagggcagttcctccagatgtgcagaccttgcgcgccttcaccactgagctggttgtagaggctgtggtccgctgcctg

SEQ ID NO: 60722 - DNA, 201 bp, Homo sapiens
cgtcgcagaggattggccagggtgaggcagaagagtgcccgaggtgaccgctgggcactggccactgccactgtcttgtgcttgctgtgctggtttcttcrcttaggggtccctaggcctgatgccccactgctttcaccttccacagctgggggcccggggcacagcccccattcgggaccagggcctgccccattggct

SEQ ID NO: 60723 - DNA, 201 bp, Homo sapiens
gatgctttgggtagagggaacaccacacgaggcctggccatgggacagagcaggctgttggagttggtgggaggggcccagagtggctgtgatgggggctrgtgagcaggagctgggaaaggggctgtgtgtgctgagggggcatgtgttcacattgcctcagatcgagacagagctgggcaagaagaccctcagcaacct

SEQ ID NO: 60724 - DNA, 201 bp, Homo sapiens
aagagccgcgcggtggagctgctgcccgatgggactgccaaccttgccaagctgcaggtggggttggggctgtagctgggcggagaggggcagggtggggyggggtggggttggagggcccagcctgtgtgacatgtacccatcccccaccagcttgtggtggagaatagtgcccagcgggtcatccacttggcgggtcag

SEQ ID NO: 60725 - DNA, 201 bp, Homo sapiens
ggtgtctgggatgtgggcgggggcggtgaggggagaggagggccttctaggggctgtagggctgagagaggtagaggtggtaaaaaggttgatgggtaggrgtggcggtatgtgccttcaggagagctaggcaggaggattaggcatcagagaggggctacagggcagggggcagggggctgaggttgagctgaccccggt

SEQ ID NO: 60726 - DNA, 201 bp, Homo sapiens
ggcagaagagtgcccgaggtgaccgctgggcactggccactgccactgtcttgtgcttgctgtgctggtttcttcgcttaggggtccctaggcctgatgcyccactgctttcaccttccacagctgggggcccggggcacagcccccattcgggaccagggcctgccccattggctggactgggctctggggtggtgtcta

SEQ ID NO: 60727 - DNA, 201 bp, Homo sapiens
ggtccctaggcctgatgccccactgctttcaccttccacagctgggggcccggggcacagcccccattcgggaccagggcctgccccattggctggactgrgctctggggtggtgtctatatggagaaactgtgtcagggagggacagggtattggggcaattgtggctgcttcctacctgatcctgtccctctgtttgaa

SEQ ID NO: 60728 - DNA, 201 bp, Homo sapiens
ccctctgtttgaaggaaggagagaagagcatggaaaattagggagaactgggagtagctgggttaaggactgggaagtaagagtgttcgaattaagattasagtgagagtttataggggagtgaaggtgagattacatttccaagtgaagtagggtttggtgtttaagttgggggtagagtttaaattgccatggggtggg

SEQ ID NO: 60729 - DNA, 201 bp, Homo sapiens
cctgcccgagaatttttaaatttttcgtagagatggggtctcgcttttgtagagatgttgcccaggctggtcttaagctcctggcctcaagcaatcttccygccttggcctcctgagtagttgggactacaggcgtgcaccactgtgcctggtaaagagccattctgatgaaacactcacccattcccagtatagagctga

SEQ ID NO: 60730 - DNA, 201 bp, Homo sapiens
ctgatgacccttacccctgggccctgcccctgccttccaggatgcttccactccacgatgctgatgcaggaccgtcgcagaggattggccagggtgaggcrgaagagtgcccgaggtgaccgctgggcactggccactgccactgtcttgtgcttgctgtgctggtttcttcgcttaggggtccctaggcctgatgcccca

SEQ ID NO: 60731 - DNA, 201 bp, Homo sapiens
actcctggcctcaagagattctcctgcctctgcctcactagtagctaggactataggcacatgccaccctgcccgagaatttttaaatttttcgtagagayggggtctcgcttttgtagagatgttgcccaggctggtcttaagctcctggcctcaagcaatcttcccgccttggcctcctgagtagttgggactacaggc

SEQ ID NO: 60732 - DNA, 201 bp, Homo sapiens
aacagatgaaatatttaccaaatatatacctgcagcaaacagtcaaactaaaataagaaaaacgatgtcattttccagtagtatatggaattcgaagtatrtaggaaaaacctaatatatgtgcaatatctctatggaaaaaagatcaaatattatcaattattattatttttagagacagggtcttgctctgtcacccag

SEQ ID NO: 60733 - DNA, 201 bp, Homo sapiens
tgctcattctctaggatagttcttatccagaatgtggtttcaggaattcttttttttagtttgaaaatgaatgtgaaacattttctttggtgtcttttttkaaaaaaaaaaaaacccttattgctattttttcgtgtttttgttttgttttgttttttgtttgttttaccattaagtaatacacatcccagaatttggcac

SEQ ID NO: 60734 - DNA, 201 bp, Homo sapiens
caaatttgagagacttttttgaatctcacacatgtattttcctcaagattcttttaagcctcttctgaatgacttgtctgagatagtgaagacccacattractagaatcagctggggaactttaaaaaatacagtgcctgggtcccagtccctagcttttgatctaattcatgtaggggtgggatccaggaattaccatg

SEQ ID NO: 60735 - DNA, 201 bp, Homo sapiens
aagtaatacacatcccagaatttggcactctgtgttaactgtggaggcaaataaaatttagttttaatctgtggtgagctgaatgcactacaacaccttcsaagtaatctgatggtttcattctgtcgagcctcatgctgcctacaaaacaccacaatttacctggtgttttcaacattttaaggaatgaagatacaagta

SEQ ID NO: 60736 - DNA, 201 bp, Homo sapiens
taaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttctt

SEQ ID NO: 60737 - DNA, 201 bp, Homo sapiens; identical to SEQ ID NO: 19508

SEQ ID NO: 60738 - DNA, 201 bp, Homo sapiens
tacttttgctcattctctaggatagttcttatccagaatgtggtttcaggaattcttttttttagtttgaaaatgaatgtgaaacattttctttggtgtctttttttaaaaaaaaaaaaacccttattgctattttttcgtgtttttgttttgttttgttttttgtttgttttaccattaagtaatacacatcccagaatt

SEQ ID NO: 60739 - DNA, 201 bp, Homo sapiens
aaatagggcacattgagtatctgtaaagataactgcatggatcaaaacacatcaaaagctgggcacagtggctcatacctataatcccagcactttgggartctgaggcaggtgtgttgcttgagtccaggagtttgagaccagcctgggaaacatggtaagaccccctctctaccaaaaaaaaaaaaaaaaaaaaaaaaa

SEQ ID NO: 60740 - DNA, 201 bp, Homo sapiens
gaagacgttcccactggccaaaatagggcacattgagtatctgtaaagataactgcatggatcaaaacacatcaaaagctgggcacagtggctcatacctrtaatcccagcactttgggaatctgaggcaggtgtgttgcttgagtccaggagtttgagaccagcctgggaaacatggtaagaccccctctctaccaaaaa

SEQ ID NO: 60741 - DNA, 201 bp, Homo sapiens
aactggggaggctgggcacgactgctcatgcctgtaaaacccagcactttgggagaccaaggcaagcagatcacttgagtcctgaagttcaagaccagcckgggcaatatggcaaaactctagctttatagaaaatacaaaaattaaccaggcgtggtagcacatgcctgtagtcccagctacttgggaggctgagacggg

SEQ ID NO: 60742 - DNA, 201 bp, Homo sapiens
gcttgcacccaggaggtgaaggttgcagtgagctgagatcgcgccattgggctccagcctgggcaacaagagtgaaactccatctcaaaaaatttaaaaawaaataaaataaataaataattgatttgattcaggttaaatattattgtcagtaatacttcatacattgtttttggcttttcttgtgtatttgtttgcaaa

SEQ ID NO: 60743 - DNA, 201 bp, Homo sapiens
taggaactctgagtaggtacagaagaaatagtaaacacagtttatcttcagggtttccatgcaggagaaaaacataaaagaacatgtccacaagtagactrgccgggaacatgtgcatattctaagggagtgtctgtctcctgaacgtgccctttggaaattgacagaaaaggctttatttttcttagttagagaacatgg

SEQ ID NO: 60744 - DNA, 201 bp, Homo sapiens
ggatactcataagcctggagagatgccttatgtttgccaggtattgcctttttctccagggagttttagcagttttgccctcaggaagaatacaaagaatytactaatgaatattgttgaccacctactgcatacactcagtttaggaactctgagtaggtacagaagaaatagtaaacacagtttatcttcagggtttcc

SEQ ID NO: 60745 - DNA, 201 bp, Homo sapiens
gtgctgggattacaggcatgagccaccgtgcccggcctattattattaagtcttagcttttgactacatgtctttttaatttttaagaatttgtgattaartaaacatggataaagcatttatgctgcctagggaggtgtgattgttgtcatgaaggaaaagcatttgtgagattgggttgtgaatgaatggcttatttca

SEQ ID NO: 60746 - DNA, 201 bp, Homo sapiens
tgagaatgcccttgaagcagtaaaatttattattctatttttatttttttgaggcggagttttgctctgtcgcccagggtggagtgcagtggcactatctsggctcactgcaatctcttcctccctggttgtatttttagtagagacagtgtttcgccatgttggccaggctggtctcgaactccggacctcaggcgatcc

SEQ ID NO: 60747 - DNA, 201 bp, Homo sapiens
tgtgttggtggtgtatctcaaactaaaggaggtaacagaatggactcttgggacgaacctgatttagttagagtttccactcccatcttgaactagtggtrtaatgtaggaaagcagttctcaaagtgtggacagatgacccatggggatctcctcttaccctttcagggtagcctcaaggtcataactattttcaaaata

SEQ ID NO: 60748 - DNA, 201 bp, Homo sapiens
cttgtgttagtggaaaggagaaagtttgaggaagaaataggattgagagaaggatgctttaaggagcttaaccatgtttaggagtcggagcctgtcggggktggggaagattgaagacagggaaaacaaattgacaaaatcttggaatacatggcatgatgaggttggatgagccttaggaaggtacaagagatctatcct

SEQ ID NO: 60749 - DNA, 201 bp, Homo sapiens
ttcttcttacagccaagtgcaagatctgtgaatgggcgtttgaaagtgagccactatttctccagcatatgaaggatactcataagcctggagagatgccwtatgtttgccaggtattgcctttttctccagggagttttagcagttttgccctcaggaagaatacaaagaatttactaatgaatattgttgaccacctac

SEQ ID NO: 60750 - DNA, 201 bp, Homo sapiens
ggaggctgggacaggtagatcacctgaggtcaggagttcgagaccaacctggccaacatgaaattaccaaaaattgtctcagaagtttgacaaaattgttmatttgtgtcataaaattttgtcaaaattttttctcataagcttgacaaaatggacaatttcaaagagagtaggaggtattggaggccagctgattagcag

SEQ ID NO: 60751 - DNA, 201 bp, Homo sapiens
ggaggtaggttaccaatggagtcaaagttctgatttcatatttggtataaagcaatatctcctattcttaggcccatatcttatttgaatgtttttcttayagcatggcggacaccgacctgttcatggaatgtgaggaggaggagttggagccatggcagaaaatcagtgatgtcattgaggactctgtagttgaagatt

SEQ ID NO: 60752 - DNA, 201 bp, Homo sapiens
ggattacaggcgtcagccaccgcgcccggccgggttttacttctgtaggcatttacccaactagaggaaagggaaacggagggggcagggagggctgctcsttggcaaacgattaattttgagacactattgctcagggtctgagagcttgaactctgaattcgaactgttagcacaatcgttctcaacttcggggtgcat

SEQ ID NO: 60753 - DNA, 201 bp, Homo sapiens
agttgtaattctgaacccttggaaatggaggaaggctagaggatatgataaaggagtccaaggaggtaggttaccaatggagtcaaagttctgatttcatrtttggtataaagcaatatctcctattcttaggcccatatcttatttgaatgtttttcttatagcatggcggacaccgacctgttcatggaatgtgaggag

SEQ ID NO: 60754 - DNA, 201 bp, Homo sapiens
gtgctttcttagtctttagaatctatactcctcttggaaacctctgatgatcatccatcagtttggggaaataatctttccagtaaaggcagggagaatgkgttataggtgagctcactgaccaagatctggtactttgtctctcttttaaagccccaggtacccagtttgttaagccgacagttggagttccacaagtgt

SEQ ID NO: 60755 - DNA, 201 bp, Homo sapiens
agaatcgcttgcacccaggaggtgaaggttgcagtgagctgagatcgcgccattgggctccagcctgggcaacaagagtgaaactccatctcaaaaaattwaaaaaaaaataaaataaataaataattgatttgattcaggttaaatattattgtcagtaatacttcatacattgtttttggcttttcttgtgtatttgtt

SEQ ID NO: 60756 - DNA, 201 bp, Homo sapiens
ctgttctcgagcttatgccaaccacatgatcaagtaagttggtttttaaccagtgttttagcttgagagttcagattctttttttcttcttcttcttcttytttttttttttttttgaagacagggtctcactctgtcccctaggctggagtgcaatagcatgatcttggctcactgcaacctctgcctcctgggttcaag

SEQ ID NO: 60757 - DNA, 201 bp, Homo sapiens
atgtggtttcagattccaaaatgttaactgtcctttaagaaactactatttggcctagcgtggtggctcactcctgtaatcccagcactttgggaggccarggtggaaggattgtgtgagcccaggagttggagttgagcctggtcagcatagtgagaccctgtctctatttattaaaaaaaaaaaaaaaaaaaaaaaaga

SEQ ID NO: 60758 - DNA, 201 bp, Homo sapiens
gatgtggtttcagattccaaaatgttaactgtcctttaagaaactactatttggcctagcgtggtggctcactcctgtaatcccagcactttgggaggccraggtggaaggattgtgtgagcccaggagttggagttgagcctggtcagcatagtgagaccctgtctctatttattaaaaaaaaaaaaaaaaaaaaaaaag

SEQ ID NO: 60759 - DNA, 201 bp, Homo sapiens
ttttttcatcccccagcacactataatatagtgaactggaaaagtcccttccagaaacagcttggccagctttgtgaacctttgacatctgaaaacaaccraggatccatctgggcttctcttccccagctttttgcctgatgccattttattgacagacaatggactttgaagtcagcctttgcctttgagaaagttcaa

SEQ ID NO: 60760 - DNA, 201 bp, Homo sapiens
agtaaaaaagtggattgatgtggtttcagattccaaaatgttaactgtcctttaagaaactactatttggcctagcgtggtggctcactcctgtaatcccrgcactttgggaggccaaggtggaaggattgtgtgagcccaggagttggagttgagcctggtcagcatagtgagaccctgtctctatttattaaaaaaaaa

SEQ ID NO: 60761 - DNA, 201 bp, Homo sapiens
ttaacagtaaaaaagtggattgatgtggtttcagattccaaaatgttaactgtcctttaagaaactactatttggcctagcgtggtggctcactcctgtartcccagcactttgggaggccaaggtggaaggattgtgtgagcccaggagttggagttgagcctggtcagcatagtgagaccctgtctctatttattaaaa

SEQ ID NO: 60762 - DNA, 201 bp, Homo sapiens
tttaacagtaaaaaagtggattgatgtggtttcagattccaaaatgttaactgtcctttaagaaactactatttggcctagcgtggtggctcactcctgtratcccagcactttgggaggccaaggtggaaggattgtgtgagcccaggagttggagttgagcctggtcagcatagtgagaccctgtctctatttattaaa

SEQ ID NO: 60763 - DNA, 201 bp, Homo sapiens
agatatttcttgaaaatgaagtgagcttgtcacttttaggaaaacaactgacagtatttattaccagtgataaaatttgggtgaaaattagaatttttaaraagttgacagctggagtttgacagcttcctagtacttaaaagactttccttatgatatcagtggttaaggactgcaatattttaaaatgttgtttaatga

SEQ ID NO: 60764 - DNA, 201 bp, Homo sapiens
tggccctagggttcttttcataagtttgtctaatgctgattcttagtcttttttgagacagaatctcaccctgtcacacaggctggaatgcagtgacgcartcacagctcagtgcaacttaagcctcctgggttcaggcagttctcctgcctcatccttccaagtagctgggactacaggcatgttggccaggctggtctc

SEQ ID NO: 60765 - DNA, 201 bp, Homo sapiens
cttcctccctggttgtatttttagtagagacagtgtttcgccatgttggccaggctggtctcgaactccggacctcaggcgatccacctgcctcggcgtcycaaagtgctgggattacaggcatgagccaccgtgcccggcctattattattaagtcttagcttttgactacatgtctttttaatttttaagaatttgtga

SEQ ID NO: 60766 - DNA, 201 bp, Homo sapiens
aatcaggttgggattgtgctgaacgtacagcaaggccaaacggttagaccaattacactagttccaggtaaggaaaaatgtctatccatttggaataaacyggcatccagaagatttgtttttattgttctaaatatcctaagtcatttagtaagtacatttaaagaaaatctaaaaatataaaaatattaatgatttaag

SEQ ID NO: 60767 - DNA, 201 bp, Homo sapiens; identical to SEQ ID NO: 24236

SEQ ID NO: 60768 - DNA, 201 bp, Homo sapiens
agagggtagagttgagagatattcagaagatttgtgatatttatgatgtagagatggattaggtgaaggtagcaatgcagtagttaagaatagtgcctaarattctgtcttgggcagttgggtgaatgagggaactatttgctgaaatagaaacaatagagaaagtatatttgtgaggggggagatcatgagcttggatat

SEQ ID NO: 60769 - DNA, 201 bp, Homo sapiens
ataaggggttaatatccagaatatataaagaatttgtgcagttcaacaacaaaaaaactcccaaacaacctttttaaaaaatagacaaaggactcgctggkcgtggtggttcatgcctgtaatcccagcactttgagaggccaaggcaggtggatcacgaggtcaggagtccaagaccagcctgaccaataatggtgaaac

SEQ ID NO: 60770 - DNA, 201 bp, Homo sapiens
aggccaaggtggaaggattgtgtgagcccaggagttggagttgagcctggtcagcatagtgagaccctgtctctatttattaaaaaaaaaaaaaaaaaaaraaaagaaagaaactaccgtttgttgagttttagtatttaccaaacacagttatctgaaaaggttattaaaatacttctcccttttccgactagattttca

SEQ ID NO: 60771 - DNA, 201 bp, Homo sapiens; identical to SEQ ID NO: 24242

SEQ ID NO: 60772 - DNA, 201 bp, Homo sapiens
gaggagaaatcacatgaacagttggatttatgaaacaggaaactttttggctatagagacccacaataagatggaaagggaagattagagcagtatccttyagtgtcatctgtccctgtctccaagtgactatgcctccccttccccacagtttctgtgagccagcagccagtctcggctccagtgcccatcgctgcccat

SEQ ID NO: 60773 - DNA, 201 bp, Homo sapiens
ccagtattgaggcctgttcaggtcatgcagaatgccaatcatgtgactagttcccctgtggcctcacaaccaatatttatcactacgcaggtgagtaggaytctgaattccaaggttgctagaggagagaaagactataaacctctgaaaactctgacttagggtctttggcgtcattagaagtggttctaagtcttgtct

SEQ ID NO: 60774 - DNA, 201 bp, Homo sapiens; identical to SEQ ID NO: 24244

SEQ ID NO: 60775 - DNA, 201 bp, Homo sapiens; identical to SEQ ID NO: 24245

SEQ ID NO: 60776 - DNA, 201 bp, Homo sapiens
aggaaaaaagatacaggttcgtactgtatgcatcaggagcatacctacttggcctcactcattcactgttgagatgtgctggacctaattagaaaccttcygacctgaagtttatataaaactgggaaagctggtcactgcgaacagcgtatttgtatgtagtaagttgaatcccagggcactgtctttggagggcttatt

SEQ ID NO: 60777 - DNA, 201 bp, Homo sapiens
caacagaaaggtgggaagaatgatatggttgacattgatctgctttctcctcaaaaaagaaaatttattaggaacctttaagggattttgtctctttttttccctcccccacttcagaagagaaatgtttatcactgcaacaaatgccggctgcagtttctctttgccaaggacaaaattgaacacaagcttcaacaccat

SEQ ID NO: 60778 - DNA, 201 bp, Homo sapiens
gaattcactgggaagccactaaaggggttttaagccctggagtgatgtgttcagctttagttaaggctttatactgcctgcactgcagagaatggattaarggagattgagactacagttagggaaactagctagaaggcctttttcagtagtttaggtgagagatgatagtggctattggcttttgaaataaaaagaggg

SEQ ID NO: 60779 - DNA, 201 bp, Homo sapiens
gcatttgtgagattgggttgtgaatgaatggcttatttcatggagtagcatttttacttgaaagaacgactagcagactatggtttttcacacttagtatytggcagatatttcttgaaaatgaagtgagcttgtcacttttaggaaaacaactgacagtatttattaccagtgataaaatttgggtgaaaattagaattt

SEQ ID NO: 60780 - DNA, 201 bp, Homo sapiens
aatgaaatatgttatttggaagatgggcataactcagtaaatctaggctttgcaaatgaccaatgcatgatgttgcaaaatcaagcaaaggcaaaagatcytttgaaaattccagacatagcaatggattttaacagtaaaaaagtggattgatgtggtttcagattccaaaatgttaactgtcctttaagaaactactat

SEQ ID NO: 60781 - DNA, 201 bp, Homo sapiens
ctttttgccatactgtataattaaaaatatgtagcagttaaaagtcttaccaaaattggccggtgcactggctcacacctgtaattctagcactttgggaractgaagtggattgacaaaaggattgcttgaggccaggagtttccgaccagcctgggcaacatggcgagaccctgtccctacaaaaaaaaatttttttta

SEQ ID NO: 60782 - DNA, 201 bp, Homo sapiens
ggatagtcctagctactcaggaggctgcggtgagctatgatcatgctccagcctgagcaacagtgagattctgtctcttaaaaaaaaaaaaaaaaaaaaaagcccaggcacggtggctcacacctataatcccagcactttgggaggctgggacaggtagatcacctgaggtcaggagttcgagaccaacctggccaacat

SEQ ID NO: 60783 - DNA, 201 bp, Homo sapiens
ggaggcggaggttgcagtaagctgagatcacaccattgcactacagcttgggcagcaagagtgaaacgctgtctcaaaaaaaaaaaaagagggccgggcgyggagcctcatgcatgtaatcccagcactttgggaggccgaggcgggtggatcacgaggtcaggatatcgagaccatcccagacaacatggtgaaactcca

SEQ ID NO: 60784 - DNA, 201 bp, Homo sapiens
caatggattttaacagtaaaaaagtggattgatgtggtttcagattccaaaatgttaactgtcctttaagaaactactatttggcctagcgtggtggctcrctcctgtaatcccagcactttgggaggccaaggtggaaggattgtgtgagcccaggagttggagttgagcctggtcagcatagtgagaccctgtctctat

SEQ ID NO: 60785 - DNA, 201 bp, Homo sapiens
agaatttcttatttatccatgtcctcatagcacctaatgtacctgtagacagtgtttctaaatggagttgcagacctctttgagaataaatatgaaatgtktgaatcctcttcctagaaaaatctacattttactcttttgcaaataatttcagagaaagcctggattcctagaggcctgttccatagaccccagattaag

SEQ ID NO: 60786 - DNA, 201 bp, Homo sapiens
taatctctttgcctaatttataaattaaactttatcataggtatatatatatatatatatatatgaaaaaacacggtatgtatagggttcaatactatctsaggtttcatgtatgcactgggggtcttggaacgtatatttcccattggcaaagggcgtctactgtaaagtttaaaaaaacaggcaaaattaattttaaca

SEQ ID NO: 60787 - DNA, 201 bp, Homo sapiens
caaaatggagaataagatgagtgcatgtgtgcttaatagtcacatacatatgcacacaaacatatgtaccctattacactcatagtctcctttgcacagtrgtgactgctgattgtctaccacaactgtatttccaaataggggcatggaaattgtctcttagcctaagcttacagagctttgttatcctactaaagaaaa

SEQ ID NO: 60788 - DNA, 201 bp, Homo sapiens
gaatacatggcatgatgaggttggatgagccttaggaaggtacaagagatctatccttccataatttggaaaacaagcagcagaagttacagttgttcatrcctatttcctcaaagtaggagattgtgttaggtgttaaggagggtgatggtgctcagagggacagttaggacagccaccatggagaatcaattcattttc

SEQ ID NO: 60789 - DNA, 201 bp, Homo sapiens
ataattatccttttatatattatatatttttaattgttaatctctttgcctaatttataaattaaactttatcataggtatatatatatatatatatatatgaaaaaacacggtatgtatagggttcaatactatctcaggtttcatgtatgcactgggggtcttggaacgtatatttcccattggcaaagggcgtctact

SEQ ID NO: 60790 - DNA, 201 bp, Homo sapiens
cttgaacccgggaggcgaaggttgcagtgagctgagatcgcaccattgcactccaccctggcgacagagcaagactccgtctcaaaaaaaaaaaaaagatstaacagaattaatcagaaatccttaataacattcaatacctactttatttaaaaattttctgagttgtccccagaatatcagtggatcattatatttaat

SEQ ID NO: 60791 - DNA, 201 bp, Homo sapiens
tataattatccttttatatattatatatttttaattgttaatctctttgcctaatttataaattaaactttatcataggtatatatatatatatatatatatgaaaaaacacggtatgtatagggttcaatactatctcaggtttcatgtatgcactgggggtcttggaacgtatatttcccattggcaaagggcgtctac

SEQ ID NO: 60792 - DNA, 201 bp, Homo sapiens
taaaatacaaaaagttagccgtgtgtggtggcacgcgcctctaatcccagctattcgggaggcttaggcaggagaattacttgaacccgggaggcgaaggktgcagtgagctgagatcgcaccattgcactccaccctggcgacagagcaagactccgtctcaaaaaaaaaaaaaagatctaacagaattaatcagaaatc

SEQ ID NO: 60793 - DNA, 201 bp, Homo sapiens
gcgggtggatcacgaggtcaggatatcgagaccatcccagacaacatggtgaaactccatctctactaaaatacaaaaagttagccgtgtgtggtggcacrcgcctctaatcccagctattcgggaggcttaggcaggagaattacttgaacccgggaggcgaaggttgcagtgagctgagatcgcaccattgcactccac

SEQ ID NO: 60794 - DNA, 201 bp, Homo sapiens
gcttaaagaatcttgcatttctcagatttaactcactaggaagagaaaccattccttagattctgtgtgcttgctgaattaatgtttgttgatgaatattmtttttaaaaaattaagggggattagctaacaaattatcttctaataaaataggttttacctagttaaaatatggaaaaagacttaacatattttgttctg

SEQ ID NO: 60795 - DNA, 201 bp, Homo sapiens
tgatacacagtgcaatctggtagctttttagcagggtttgttgtctgaaaatcctacattttggggacccatgaggcagtaatgagaattctttttttttytcccccacaggagtgtcatgggccggcagacatgcctggagtgcagcttcgagatcccagacttccctaatcatttccctacttacgtacactgctctct

SEQ ID NO: 60796 - DNA, 201 bp, Homo sapiens
gtagcctgtcagtctctgggttcccagtggttgcttaaagaatcttgcatttctcagatttaactcactaggaagagaaaccattccttagattctgtgtrcttgctgaattaatgtttgttgatgaatattctttttaaaaaattaagggggattagctaacaaattatcttctaataaaataggttttacctagttaaa

SEQ ID NO: 60797 - DNA, 201 bp, Homo sapiens
agcaggcagatcacctgaagtcaggaattcgagaccagcccggccaacatggcgaagccccatctctactaaaaatgcaaaaattagctgggtgtggtggygggcacctgtaatcccagctactcgggaggctgagacaggagaatcgcttgaacccgggaggcggaggttgcagtgagctgagatcatgccattgcactc

SEQ ID NO: 60798 - DNA, 201 bp, Homo sapiens
actgtgttgtccaggctggactcgaactcctaggctcaagtgatccacctgcttcagcctctcaaatagctgggactacgggtgcataccactgccctagkttggataatccttttaaaggctttttttttaaagcaccagaattgtgattgcctgtttcatcctctggaaatagaaccttgtaagacacttgaattgtca

SEQ ID NO: 60799 - DNA, 201 bp, Homo sapiens
gaatctactagtaagtttggaaactcttaaactcaaggggaatataccttgctgttcactcattgaatggcgctggggggagcccattatatttatttacrtgtgggtaacagtgtagaggaagtacttttcatatttgtagccagttctttacttcattcaccttgtttttttttacaagcctgacttttattttgttca

SEQ ID NO: 60800 - DNA, 201 bp, Homo sapiens
ggggaatggaggggagcagataatgtttgttctgtgattttaccattatatttctaaaaggctaccaattttttatgttttctgtactttctctttgtgckttattacagattcatgaaccatatgaaacaccacgtagaactcgatcagcagaacggtgaggtagatggtcacactatctgccagcactgttaccgccag

SEQ ID NO: 60801 - DNA, 201 bp, Homo sapiens
aaaaaaaacaaaaaccttaacaaaaaaatcacatacaaattattcttagcttatgggccaaacagaaactggtagctgggctggatttgatctgtgtgctrtggtttgctgacccctggcctagagttagaacagtaaaaggaagcctcaaacatagtgatcttgagcccagggaggtcaaggctgcagtgagctgtggtc

SEQ ID NO: 60802 - DNA, 201 bp, Homo sapiens; identical to SEQ ID NO: 24228

SEQ ID NO: 60803 - DNA, 201 bp, Homo sapiens; identical to SEQ ID NO: 24230

SEQ ID NO: 60804 - DNA, 201 bp, Homo sapiens
ttctttcaaaccatatatttgtacctgttgatcagcttctcttcaactctctactcccctactcttcccagcctctggtaaccaccattctactctctctycatgagatctacttttttttttagctcccacatatgagtgggaacatgtgatatttgtctttttgtgcttggcttacttcacttagggacttccagttct

SEQ ID NO: 60805 - DNA, 201 bp, Homo sapiens
ggaggatgctgaattaggttagagttgacgatagaataaccaatttaaaatgtcttatagataaaatctagaatgaagctttggtaagaagtctgagctaygtacataagattatcagcaacatatatgttaaggtggagccatttaaagaaagaacagaagggacctatgatttactgattgttgaaaatcaaaataaag

SEQ ID NO: 60806 - DNA, 201 bp, Homo sapiens
cactatttctccagcatatgaaggatactcataagcctggagagatgccttatgtttgccaggtattgcctttttctccagggagttttagcagttttgcyctcaggaagaatacaaagaatttactaatgaatattgttgaccacctactgcatacactcagtttaggaactctgagtaggtacagaagaaatagtaaac

SEQ ID NO: 60807 - DNA, 201 bp, Homo sapiens
tttagtaatgattctctgatacggaagtgatttctgtagatggtgctattccttctaagttagtgctgactcggtactggtgtttcaagtgagagagcagyagattcttgctattgataatttcttggagagaaaatgtcaacccaaaattcctgttaagatttttttgtttggttggttggttgtttttgtttctttaat

SEQ ID NO: 60808 - DNA, 201 bp, Homo sapiens
tctctaaaccactgttttgaccttatctgtaaaataaaaactttagagctggttgattacaaatcctagagctggttaatgcctttgccataatatcaatrtggtaacattttgatagattctttggtattcttgtttgtgatattaagccatattcacaaaaacttgtcttttttttttttttgagatggagtctcgctc

SEQ ID NO: 60809 - DNA, 201 bp, Homo sapiens
atttaatgttataaatttcttacagtataactaattatggttttcagttcctattgtatttagccctctatttctgggctttaagggtatggaagtaaacytaaaagaatgaaggaaggctgggcgcagtggctcacgcctataatcctagcactttgggaggcttgaggcgggcagatcgcctgaggtcagaagtttgag

SEQ ID NO: 60810 - DNA, 201 bp, Homo sapiens
gtgagcagaacatttgaggtcaggagttcaagaccagcctgaccaacatggtgaaaccccatctctactaaaaatacaaaaaaattaggcgagtgtggtgrcatttacctgtagtcccagctacttgggaggctgaggcaggagaatcgcttgaacctgagaggtggaggttgcagtgagctgagatcacgttactgcact

SEQ ID NO: 60811 - DNA, 201 bp, Homo sapiens
ttaaaatcccagttcagtgggctccgtgatgtaacttaattaaccaggagatgtgagacgaagaagggattgtgtttaaatggtggactaagggttaagtrggaggagaaatcacatgaacagttggatttatgaaacaggaaactttttggctatagagacccacaataagatggaaagggaagattagagcagtatcct

SEQ ID NO: 60812 - DNA, 201 bp, Homo sapiens
ttgggaggccgaggtgagcagaacatttgaggtcaggagttcaagaccagcctgaccaacatggtgaaaccccatctctactaaaaatacaaaaaaattargcgagtgtggtggcatttacctgtagtcccagctacttgggaggctgaggcaggagaatcgcttgaacctgagaggtggaggttgcagtgagctgagatc

SEQ ID NO: 60813 - DNA, 201 bp, Homo sapiens
ccaaggcaggcggatcacctgaggtcaggagttcgagaccagcctggctaacatagtgaaaccctgtttctactaaaaatataaaaaactagccgggcatrgtggcatgtgcctgtaatcccagctactcgggaggctgaagcaggagaattgcttgaacctgggaggcggaggttacagtgagccgagatcacgccactg

SEQ ID NO: 60814 - DNA, 201 bp, Homo sapiens
ataacctgaaagactctgagcagccagtcattcaaaaacattaataaagtgtttgttgtatcagagctttatactcagaaatagaaaaataaaataaaatmcagctgctgtagtttgttcttacagaaactttagtaaggagaaagccacttacaaaaagtgtaactgaatcagctccaagaaattatgtgtgtaattgtg

SEQ ID NO: 60815 - DNA, 201 bp, Homo sapiens
atgattatgaataccactagtggtaataataaacctttgagtcctagaggtttgctagtgctatgtaagcaaagattaaaatcccagttcagtgggctccrtgatgtaacttaattaaccaggagatgtgagacgaagaagggattgtgtttaaatggtggactaagggttaagtaggaggagaaatcacatgaacagttg

SEQ ID NO: 60816 - DNA, 201 bp, Homo sapiens
caaaagctgggcacagtggctcatacctataatcccagcactttgggaatctgaggcaggtgtgttgcttgagtccaggagtttgagaccagcctgggaarcatggtaagaccccctctctaccaaaaaaaaaaaaaaaaaaaaaaaaaaattagccagacatggtggctcttggttatcccaagagttagttagctcttt

SEQ ID NO: 60817 - DNA, 201 bp, Homo sapiens
gattctccaaaagcccagctacgccggacaatagaatgttgtcggaccaatttatgtaaccagtatttgcaacccacatgccccctgttgtcataggtccrttttttgatggcagcattcgatggctggttttgctcatttctatggctgtctgcataattgctatgatcatcttctccagctgcttttgttacaaacatt

SEQ ID NO: 60818 - DNA, 201 bp, Homo sapiens
cagaaacgtatggcacccaaggaaagcccgcaattgctcatcgagacctaaagagcaaaaacatcctcatcaagaaaaatgggagttgctgcattgctgayctgggccttgctgttaaattcaacagtgacacaaatgaagttgatgtgcccttgaataccagggtgggcaccaaacgctacctggctccagaagtgctgg

SEQ ID NO: 60819 - DNA, 201 bp, Homo sapiens
ctctctatgacttcctgaaatgtgctacgctggacaccagagccctgcttaaattggcttattcagctgcctgtggtctgtgccacctgcacacagaaacktatggcacccaaggaaagcccgcaattgctcatcgagacctaaagagcaaaaacatcctcatcaagaaaaatgggagttgctgcattgctgacctgggcc

SEQ ID NO: 60820 - DNA, 201 bp, Homo sapiens
tctctctatgacttcctgaaatgtgctacgctggacaccagagccctgcttaaattggcttattcagctgcctgtggtctgtgccacctgcacacagaaaygtatggcacccaaggaaagcccgcaattgctcatcgagacctaaagagcaaaaacatcctcatcaagaaaaatgggagttgctgcattgctgacctgggc

SEQ ID NO: 60821 - DNA, 201 bp, Homo sapiens
gcagtatgtggggaccgagggcgcgtccagctcgcccactgagggcttcctcctgaaacctgtgttcctgcagaggtaagaggccctgagatgcatgctcygttccttccttcctgggcccagggagtgtcccctttgtcctgacgggggctggaccatggcacactgtctgggagcacttagtaggtgcctgctgtgtgc

SEQ ID NO: 60822 - DNA, 201 bp, Homo sapiens
gtctcgctctgtcgcccaggctggagtgcagtggcgtgatctcggctcactgcaacctctgcctcctgggttcacgccattctcctgcctcagcctctccsagtagctgggactacaggcgcccgccaccacgcccagctaattttttttttgtatttttagtagagacggggtttcaccgtggtctcgatctcctgacct

SEQ ID NO: 60823 - DNA, 201 bp, Homo sapiens
aggagactcactgaggtttggagtgggtaagggacccacctaagtggcagaggtgtcactagaactcagaccctctgactcagattcttggaagtcacatscttaccatactgctgccccctcttaggaaacatggtggggctggcctggtttccttccgggagcccagtgctaagggctgggctgcaatgcagccagaag

SEQ ID NO: 60824 - DNA, 201 bp, Homo sapiens
cacctggctcggtacgtggagcagtatgtggggaccgagggcgcgtccagctcgcccactgagggcttcctcctgaaacctgtgttcctgcagaggtaagrggccctgagatgcatgctccgttccttccttcctgggcccagggagtgtcccctttgtcctgacgggggctggaccatggcacactgtctgggagcactt

SEQ ID NO: 60825 - DNA, 201 bp, Homo sapiens
ggtgacctgtgcctgtagtcccagctacttgggaggctgagacaggagaattgattgaacccaggaagcagaggttgcaatgagcaaagattgtaccactrcactctagcctgggcaacagagcaagctgtctcaaaaaaacgaaaacaaaaaaaaatgaccagcctgggcaacatagtgagacctcgtcagaaactagcc

SEQ ID NO: 60826 - DNA, 201 bp, Homo sapiens
ctggagtacaatggcacaatctctgctcacagcaacctctgcctcctggtttcaagcaattctcctgcctcagcctcctgagtagctgagattacaggtgygcaccaccacgcctggctaatttttgtatttttagtagagagggggtttcaccatgttgggcaggctggtctcgaactcctgacctcaggtgatccgcct

SEQ ID NO: 60827 - DNA, 201 bp, Homo sapiens
acacccagctactttttgtattttgagtagagacagagtttcgccatgttggtcaggctggtctcaaactcctggcctcaagtgatccgcctgcctcagcstctcaaaatgctgggattgcaagtgtgagccacggcgcccaggccctgggttttgttttctaatacatctcgtaagtctcctttcacctctgattccctc

SEQ ID NO: 60828 - DNA, 201 bp, Homo sapiens
ctcgaacccctgacctcaagtgatcccccacctcagcctcccaaagtgttgagattacaggcgttagccactgtgcctggccttttttacatttttaaaayagagacagggtttcaccatgttgtccaggctggactcaagtgatcctcctgccttggcctcccaaagttttgggattacaggtgtgacccaccacgcctg

SEQ ID NO: 60829 - DNA, 201 bp, Homo sapiens
ttaaattgacaacatggaaaaaaccttaacccacttatcctgagggagggtgggaatagtgatttcatctgcgttggttttagtagtagcaaaaacccagsccccactgaatgtcaacacaaggaaactggtcacgtaaatataaacagcagacgtcccagacgagctgggtgtggttccaggacatgggtcctgcctggt

SEQ ID NO: 60830 - DNA, 201 bp, Homo sapiens
tcttgaactcctgacctcgtgatccgccatccttggcctcccaaagtgctgggattacaggttccagccaccgcgcctggcttttttttttttttttttttgagatggggttttgcttttgtttcccaggctggagtgcggtggtgcattgtcggctcaccacaaccccctgggttcaagcaattcttcctcctcagcctc

SEQ ID NO: 60831 - DNA, 201 bp, Homo sapiens
ccatgttgtccaggctggactcaagtgatcctcctgccttggcctcccaaagttttgggattacaggtgtgacccaccacgcctggccagtattctctgtygcttagtttttctagtttgactgttttgaagtatctttttccccccccaattttatcacaaagcctgccagctactgacaagtagggagtggcccatagg

SEQ ID NO: 60832 - DNA, 201 bp, Homo sapiens
aaaccgggctgctgagagttggttgagaatgcagacacctggccaccatgcaggattcccattcatcagggcccgcccggcatcggcacagtttctttgctgtttttattttttgagactgggtctcactgttgcccaggctggagtgcagcggcatcatcacagctcactgcagcctctacttctctgggctcaagcaat

SEQ ID NO: 60833 - DNA, 201 bp, Homo sapiens
gtcaacaagtcgattcttgtgtttgtatcttcttggctcatggagcaggcggtgaccccttctccgagccaggccctggggtttattcagaggccctgctytcagggttcctgcacagtcaaggtggggggtccgatgagaaacagatgggcagatgcgggtggcgcatgggagagggcagagagaggatggagcaggcca

SEQ ID NO: 60834 - DNA, 201 bp, Homo sapiens
accccttaacgtgcagctcctaacttaagcagcccctcgacattcaaagggagccccctggctgttctctgggggaagtcccgctagttgtcaacaagtcrattcttgtgtttgtatcttcttggctcatggagcaggcggtgaccccttctccgagccaggccctggggtttattcagaggccctgctctcagggttcct

SEQ ID NO: 60835 - DNA, 201 bp, Homo sapiens
caaaccgggctgctgagagttggttgagaatgcagacacctggccaccatgcaggattcccattcatcagggcccgcccggcatcggcacagtttctttgytgtttttattttttgagactgggtctcactgttgcccaggctggagtgcagcggcatcatcacagctcactgcagcctctacttctctgggctcaagcaa

SEQ ID NO: 60836 - DNA, 201 bp, Homo sapiens
accccctgggttcaagcaattcttcctcctcagcctcccaagtagctgggtctataggtgcacaccaccacacctggctaatttttgtatttttagtggasacggggttttgcaatgttggccaggctcgtctcaaactcctgacttcaagggatctgtccacctcaacctcccaaagtgctagaattacaggtgtgagcc

SEQ ID NO: 60837 - DNA, 201 bp, Homo sapiens
ggatcagagggtgcatgcggagcttggaaatgcctccttggaatggtggggggctcgcagtgagcctacagctgcctctgaaacagaccttggctccatgmtgcttccctacatacccacaccctgctcgttccgaccccttctgccatcaaacctgtgcaccatggagaaacagacgcagccccctgtgagcctgagcag

SEQ ID NO: 60838 - DNA, 201 bp, Homo sapiens
ccaaattcatgtattttagccctagccccagcgcctcagaacgtgactgtatttggagatggagcctttgaagaggtgatttaactgaggccgttagggtrggccctaatccagtctgattggtgtccttataagagaggagattgggacacacatcagggacatgcgtgcacagagagaagaccacatgaggacacagac

SEQ ID NO: 60839 - DNA, 201 bp, Homo sapiens
tgccccctctgttcgtggacactgctgggtccccaccatactcctggacgggacctgcccatggccggggctcaggccatgctgggcagcaagatccacamgtgtgcagacaggaccctgcgggcaggtgctctttcctgagagtcatcctgtccccttcacggagggctgcctgagtgtcccggcccagggcacagcact

SEQ ID NO: 60840 - DNA, 201 bp, Homo sapiens
ccttcctttgcagctgttttgaatgtagttttccttttctatttatttgcacattaaagttaataattgaatattgacatcaagccgtgagggtgtgttgstcttcctgtgagagccttgctgacttcctgccaccaggtcagtgggctggacccatgagagcaaggggtggctgggtgtgcctacctgggaccaggggag

SEQ ID NO: 60841 - DNA, 201 bp, Homo sapiens
ctcttccacgagcaccctgacctcattgttggattcaacgcttttcttcccctcggatatagaatagacattcccaagaatggcaagttaaacatacagtygcctctgacaagccaggtatgccactacagtggttcgggtgatctcagccttcaccgagtatgtcttgctactcaggttgggccacgtgtctctcctgta

SEQ ID NO: 60842 - DNA, 201 bp, Homo sapiens
gatttgattcgcccattctggacatttcagatgggtggaatgtcaccatatgtggcctttgtgtctggctcctctcactcagcatcatgttttcaaggttyatccatgtcgtaccgtggatcagtgctcattccttttcctggctgaatcatattctgttagatggatgagccacattctgtttatccgtattctgttgat

SEQ ID NO: 60843 - DNA, 201 bp, Homo sapiens
gctgctgtgtgagggccgcagggagaagggcagcgaccccgccatggagctgcggctgaagcagcccagtaaggctccaaagcctgccgggaggccccggsgggtgcctggggttaggggtcacagctcatgatctgacatgtcctgttacttttctttctggcttttcattttaagagaattctgtgatttcaaatggga

SEQ ID NO: 60844 - DNA, 201 bp, Homo sapiens
ttctgttcctgtcaactccatctacttggtttttagttactgtttttgagcaatgattgtgcttttctaaaatcctgtttattaattgacgtgattgatawaattattgattcccatgcatttgtaaggagcaatacaccacctgggtaccctccagctggttcctttaccagtaacatctgtagtcagtatcctcaccag

SEQ ID NO: 60845 - DNA, 201 bp, Homo sapiens
ctgtggagggttgtgcgtccgccacagtgaagatactgaacggctccaggactgtcaagttctggccttgaccttttatctccatcccaaaaccctgcctyagccggagtctgttccaaacccctggcaactacttatctgttctctagacaatgttacagtaatggaactgtacaggaggaaccctctgggagaaacctt

SEQ ID NO: 60846 - DNA, 201 bp, Homo sapiens
tgctgcccttggggtaaggcacagagaggtgtgtcccgctgatggcaactttccgtttcctgggtcactcgtaccagtgctgtgcgaggccgcactctgtrtcctccctggggctcaggggcgtctctccatcagctgggagttcaaatctcggtgggctcacgttgcatttccctgatggcaaatgtggctggggccctg

SEQ ID NO: 60847 - DNA, 201 bp, Homo sapiens
ccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctt

SEQ ID NO: 60848 - DNA, 201 bp, Homo sapiens
tctgttccaaacccctggcaactacttatctgttctctagacaatgttacagtaatggaactgtacaggaggaaccctctgggagaaaccttccccccccsccccccagcaaaattccctggagattcacctgataaatacttttaaaaattctaacacttgggccgggtgcggtggctcgtgtgtaatcccagcactttg

SEQ ID NO: 60849 - DNA, 201 bp, Homo sapiens
ggtcaagctgagcccatcagaaggcctttccctggtggtctcaggcatgcacgtgttggggtgatcttttcagtgggttttctttcttgggctgctgaagktctgtaaacgccctgaagaacagcccagagcaggatggtgttactctagtctcagccaaaacggggactcctggggtctgtttgtgacgtgggtggtggg

SEQ ID NO: 60850 - DNA, 201 bp, Homo sapiens
aagttgaatcaaccctggggacaggtgctgtgtgagcccttttgcattaacttaaaaaaaatatgtgtgtgtgtgtgtgtgtgtgtgtgtgtgtgtgtgtrtatatacacataaacatttttctaatgtaaaataaagcacagatccaagaaaccacatggccaacaaatggcttgaatctttattaagcagtcacccatg

SEQ ID NO: 60851 - DNA, 201 bp, Homo sapiens
cctatccgtccaggcccatgcctgcccacccaccccacacgaccaccctctgtactccttggggccccacccacttcctggctttcaccatcattttctcytcatctcctgccccctgtctgcatcccaagctccacacctgcttccgggtagcagaagccccagctctgctgtgtcccctggctgacatacctggagggt

SEQ ID NO: 60852 - DNA, 201 bp, Homo sapiens
cctgaagatgtctccgctgtgctggggaggggaccctgtggcaagggacagagagtggcctccaagagccaagggggacctcagagccaccactaccaccrggacccaaattctgcccaagtccacttgggcccagaaaaggcccccgagcagcagataaggacacagcccagctgacaccttgatctcagcctcatttga

SEQ ID NO: 60853 - DNA, 201 bp, Homo sapiens
tgtgtgaattgctgcacggatcgcgtgcacgggctgcgtgaattgcacggatcacatgcacgaactgaattgctgcatggacgcgtgcaggggctgtgtgrattgcacggatcgcatgcacaaactgtgaattgctgcatggacgcgtgcagggactgtgtgaattgctgcacagatggcgtgcatgggctgtgaattgct

SEQ ID NO: 60854 - DNA, 201 bp, Homo sapiens
caccagccaagcgcaggccgcgcagcatccagagaccctccctctgcaggccacaggctctccttgaggcctggtgggtggggttgcctccctccctgctyccccaccaggctctcttctgtgccccctctccaaagagcagaccactcctcctgagcaagcggttgtgtcccagggcaggaggggaaccaagccacctct

SEQ ID NO: 60855 - DNA, 201 bp, Homo sapiens
atggattgcgtgcatgggctgtgtgaattgctgcacggatcgcgtgcacgggctgcgtgaattgcacggatcacatgcacgaactgaattgctgcatggaygcgtgcaggggctgtgtgaattgcacggatcgcatgcacaaactgtgaattgctgcatggacgcgtgcagggactgtgtgaattgctgcacagatggcgt

SEQ ID NO: 60856 - DNA, 201 bp, Homo sapiens
aattagccaggcatggtggcgggtgcctataatcccagctgctcgggaggctgaagcaggagaatcgcttgaatccaggaagcagaggttgcagtgagccsaaatggcaccattgcaccttcagcctgggcaacaagagcgaacctccatctctaaataaaaaatattttggccaggtgcagtggctcatgcctataatcc

SEQ ID NO: 60857 - DNA, 201 bp, Homo sapiens
tatttgcccaaaggaactgaaaacttgggtccacacaaaaacctgcacaagagatatacgcagccttattcaccagtgcccaaactcagacacaaccaagrcgtccttcagcgggcaaacggataaaccatgtcacctccagacaacaggatataaaacgaaatgagccatgaagctgtgaagacatgaaggggccaggcg

SEQ ID NO: 60858 - DNA, 201 bp, Homo sapiens
ccaaaccgggctgctgagagttggttgagaatgcagacacctggccaccatgcaggattcccattcatcagggcccgcccggcatcggcacagtttctttkctgtttttattttttgagactgggtctcactgttgcccaggctggagtgcagcggcatcatcacagctcactgcagcctctacttctctgggctcaagca

SEQ ID NO: 60859 - DNA, 201 bp, Homo sapiens
tttcattttaagagaattctgtgatttcaaatgggaaattgcaaacaggaagttgccagcataagacagaggtctcacgtacccctcgcccaggctcccckggccgtggcacctgtcctgggtgtagcaccctctcctgactggggaacatttgtttctcatgggctttctcgtggagccgtcatggcccagctccacagt

SEQ ID NO: 60860 - DNA, 201 bp, Homo sapiens
aggagaatcacttgaacccgggaggcaaaggttgcagtgagccgggatcataccactgcactccagcctgggagacagagcaagactccatctcaaaacaraaagaacaaatcccgccaccaaggagaaattgttttagaatcgtggctgctctgcgtcttgtatttctgcttttctcagctgagactttctagaattgtc

SEQ ID NO: 60861 - DNA, 201 bp, Homo sapiens
actaaaaatagaaaaattagccagcgtggtcgcacggcacctgtgatcccagctactcaggagaatcacttgaacccgggaggcaaaggttgcagtgagcygggatcataccactgcactccagcctgggagacagagcaagactccatctcaaaacaaaaagaacaaatcccgccaccaaggagaaattgttttagaatc

SEQ ID NO: 60862 - DNA, 201 bp, Homo sapiens
gggaggaggtggaggaaccgggaagccggccacattggctctgtaaggccatcacgccctccctctgacgtgcacagagcccactgcacagactaggctgsgagctggctgggcctgggtcctggacccccagtcaagtcccagaggaagacaggccagccctgggatgcttcagggaggatgccctggcttgtccctggt

SEQ ID NO: 60863 - DNA, 201 bp, Homo sapiens
gggtaggccctaatccagtctgattggtgtccttataagagaggagattgggacacacatcagggacatgcgtgcacagagagaagaccacatgaggacamagacagtggccacccacaagccaaggagagagtccttagagaaaaccaaacctcctggcaccttgaccttggcctcctggcctccaggcctccagaactg

SEQ ID NO: 60864 - DNA, 201 bp, Homo sapiens
aaaaaaaaaaaaattctgctgcttctctgtgcaagaccctctctgccatcagcctgttgtctcctgaaagccaaggagcgagtctcagggttttttttttkccttttttgagaaggagtctcgctctgtcacccaggctggagttcagtggcgcaatctcggctccctgcaacctccacctcctgggttcaagagattctc

SEQ ID NO: 60865 - DNA, 201 bp, Homo sapiens
tgcaggggacttgggcaatgcaggtgggctggtggcgagggacatctgtgtcgtgagtggggcttagacgtcctcttcacccagacgtggagtctctaacrcttggaattttttttagcagcagaacccattttttttcttttttttgaaacagaatcttgcgctgtcacccaggctggagtgcagtggctcaatctcagc

SEQ ID NO: 60866 - DNA, 201 bp, Homo sapiens
ttggctcctggggcatgcagcgtcattcacggcatttcctcttggtgcaggtactgaacgacacctgggtctccttcccttcctggtctgaggactccacrttcgtcagctccaagaagacaccgtacgaggagcagcttcaccgctgtgaggacgagcgcttcgaggtgtgtgtgctgctgtggccgggtcccccggcat

SEQ ID NO: 60867 - DNA, 201 bp, Homo sapiens
ctggagtgcagtggtgtgatctgggctcactgcagcctccgcctcccgggtgcaagtgattcttgtgcctctgcctcctgagtagctgggactgcaggcaygcaccaccactccaagttcgtttttgtatttttagtacagacagggtttcaccatgttgaccagtctggtctcgaactcttgacctcaggtgatctgcct

SEQ ID NO: 60868 - DNA, 201 bp, Homo sapiens
ctggagtgcagcggcatcatcacagctcactgcagcctctacttctctgggctcaagcaatcctcccacctcagcctcctgagtgactgggactacaggcrctcactccgacgcccagctaagggctaagaggagacggggtttcaccatgttgcccaggtgggtcttggaactcctggcctcaagtgatccacccacctc

SEQ ID NO: 60869 - DNA, 201 bp, Homo sapiens
cagcctgtgaattatgtgaaggccgggaggaggtcatctgaaatcagacaggtcattgtggcctcagatggggacagggctggcccctagcacaggggaaygctgagagagtgcatggacatgggagggggtgctggcgtggttttgcatactcccacggggttctggtcagccgggagcagtttctgcattcacctggtg

SEQ ID NO: 60870 - DNA, 201 bp, Homo sapiens
tagagacaaaagcctgcagagactcaacatttggcttctccagggtcttcccagtgccaccctcttcctgtccgcttcttgttgctgtcttggctctcagracaaaacagggaaaggattctgagattgtcgtagccaggggcacatcccccttgcctttctgatgctgtggcactcttgcctgttacccaaagccctacc

SEQ ID NO: 60871 - DNA, 201 bp, Homo sapiens
gggcagcctggagagaggacacccagggcccagcacatggtgttggggaagtgacgcaggggacgccagggggctggcagtctgtcccctcccccccccccaggctgggcacccctcatgggccatggcttcggggacagcaaccttgcttgtgacaccaggagattggaccagatggtttatggaaagcattgattaatg

SEQ ID NO: 60872 - DNA, 201 bp, Homo sapiens
tcactgcagcctccgcctcccaggttcaagcaattctctgcctcagcctctgagtagctgggattacaggcacccaccaccatgtccggttatttttttttgtatttttagtggagacgaggtttcaccatcttgaccaggctggtcttaaaactcctgaccttgtgatccacctgcctcgggcttccaaagtgatgggat

SEQ ID NO: 60873 - DNA, 201 bp, Homo sapiens
cctttgtttttttttagcatcttaatgaattcatggacttaaaatatatttgatgcgtttcaataccgtttctagtccttttaaaggtgaggggccaggcrtggtggctcatgcctataatcccagtactttgggaggccgagggggaaggatcacttgcatccaggagtttaagaccaaggccgggcctggtggctcacg

SEQ ID NO: 60874 - DNA, 201 bp, Homo sapiens
aaacacatgagatgattttgcaggcccagaatcaaggaagattacagatagatgggaaaccctgggatcatgcccttgtttttataggagactcactgagrtttggagtgggtaagggacccacctaagtggcagaggtgtcactagaactcagaccctctgactcagattcttggaagtcacatgcttaccatactgctg

SEQ ID NO: 60875 - DNA, 201 bp, Homo sapiens
cccaggaggttgaggctgcagtgagctttgattgtgccacagcactcaagtctgggtgacagagcaagaccctatctcttaaatacacacaccccccccccaaaaaaatcctctggtctctgaggtcccaggctcctctctgaggcctcttgagttccccagtggctgaccccgtcctgccttcctttccatagttagacg

SEQ ID NO: 60876 - DNA, 201 bp, Homo sapiens
gtggaggtccaggtgaggccctggccccagtctgtgccacgcataccagggagcgcctgagggcagcagcatggggctcccaccagccaagcgcaggccgygcagcatccagagaccctccctctgcaggccacaggctctccttgaggcctggtgggtggggttgcctccctccctgctcccccaccaggctctcttctg

SEQ ID NO: 60877 - DNA, 201 bp, Homo sapiens
tgacagagcgagagtctgtctcaaaaaataaaagacacaaaggggcctcaaatgcatctaactaagtgaaagaagccagcctggaaaggctgcacactgcrtgattccaactatagaacactctggaaaaggcaaaagtatagaggcagtgaaaagatctgtggttgccagggggcagatgggaggaagtaatccataggt

SEQ ID NO: 60878 - DNA, 201 bp, Homo sapiens
gaggctgcggtgggaggatctcttgagcccacgagtttgaggttgcagtaagctgagatcatgccactgcccttgagcctgggcaacagagtaagacactmtctctaaaaagaaaataccaaaccaaacaaaacacaggcagtgtgcagactggctgtggcttgccactccctggcctgaagcctggcctcttccagtcag

SEQ ID NO: 60879 - DNA, 201 bp, Homo sapiens
taaaaggagtagcagtgtatttacagccaagcatttaggggaaaggaacagcctgcactcaggccaccttcagctcattcctgggtttgctttggaacatwtttttccgtgtcttttctgtgtgtttctcacacccgggcagggtttgctggtctggcctggtctgttttgttcaggtctggtctggtctagttttggtct

SEQ ID NO: 60880 - DNA, 201 bp, Homo sapiens
ccgcgtggcagccagggtggatcgggttgagcattcccttcagagcagtcacgatttgcgtttatcccagcagtagcctcaggcatctctgcagctttttygttggtctctttccttcctacgtttccatcggcttgtgggttttccttgtgagcagggttggcatagggttcttaaatacggggaacgacggagcccaca

SEQ ID NO: 60881 - DNA, 201 bp, Homo sapiens
agctgttcttgtttccatgtttcagcagtagagactcgtatggggaagggcgtttggggaagggtctgtatggagcaaggtccagaattgaagcgggcctctgcgtgtgcttgacacgaggcctggttgggttaggagcgttcaccaccatgtggcgttcctccgcgtgttcaacctgcggtcaagtgctcagctgggctg

SEQ ID NO: 60882 - DNA, 201 bp, Homo sapiens
gagacaggagaattgattgaacccaggaagcagaggttgcaatgagcaaagattgtaccactgcactctagcctgggcaacagagcaagctgtctcaaaamaacgaaaacaaaaaaaaatgaccagcctgggcaacatagtgagacctcgtcagaaactagccagaagtggtggcgtgtacctgtacctactttggaggtt

SEQ ID NO: 60883 - DNA, 201 bp, Homo sapiens
tctactaaaaataaaaaaattagccagacatggtgacctgtgcctgtagtcccagctacttgggaggctgagacaggagaattgattgaacccaggaagcmgaggttgcaatgagcaaagattgtaccactgcactctagcctgggcaacagagcaagctgtctcaaaaaaacgaaaacaaaaaaaaatgaccagcctggg

SEQ ID NO: 60884 - DNA, 201 bp, Homo sapiens
ctcccaacgtgctgagattatgggcgtgagccaccatgcctggccatgattcttttttttaatggttcttgcacatggtgggtgcacatattaacatgatyagtccattcagtccttagcccttttcccatttaccccagggatagtagttgacagcacttgtggctgtagcgttcaccccaagataactttgccatgaag

SEQ ID NO: 60885 - DNA, 201 bp, Homo sapiens
gtcacttgggcagtctgagcctctgtttccttgctgtaaaatggggatagtaaatgtaccgacctatgtggggttcctgagagctgcaggtgggcgctacytgcagggcccttcaaatacaatagaatctcacaaataaaaggaaaagacgattttttcggcagaaggaaatgatgtaagtcacaaacttggatctttcct

SEQ ID NO: 60886 - DNA, 201 bp, Homo sapiens
ttgacctctgggctctagctgtcctctcacctcagccttccaagtagctgggaccacaggtgtgcaccaccacacctttttgtagagatgaggtttcatcrtgttgcccaggctggtctcgaactcctgggctcaaacaatcctcccgcctcagcctcccaaagtgttgggattacaggcgtgagtccctgcacccagctc

SEQ ID NO: 60887 - DNA, 201 bp, Homo sapiens
aaacctggccccaaggcccccaccagtgccctggcaaacatcagccacttccccttgctgcctgtttctctgtccactgcaccttgtgtttctgtggtgcyggcatgcacacggcgagatgccccaccagtggccgccacatgagcccccgcacgggaagacccaactcagctgtctccctcctgaaacccccagcccttc

SEQ ID NO: 60888 - DNA, 201 bp, Homo sapiens
ctgaggactccacgttcgtcagctccaagaagacaccgtacgaggagcagcttcaccgctgtgaggacgagcgcttcgaggtgtgtgtgctgctgtggccrggtcccccggcatgtgcctgttccccttctccatgggacatgcatcctgatcctcctccactgccccagtctcgtttggaggagcaggaattgcagcaca

SEQ ID NO: 60889 - DNA, 201 bp, Homo sapiens
ctgcatcttttgggaatcagtttacacctgttccagcatatacaaaaaatagccaagcgtggtggctcgtgcctgtaatcccagctacatagaaggctgargcaagagaatcacttgaacccaggagacggaggttgcactgagctgagatcgcaccattgcgctccagcctgggtgacagagtgagacctccgtctcaaa

SEQ ID NO: 60890 - DNA, 201 bp, Homo sapiens
tctccatgggacatgcatcctgatcctcctccactgccccagtctcgtttggaggagcaggaattgcagcacattccaacagctcctggaagcttcctgcygggtcttgctggcctttgggctggctaccagatggcacttttctttctgtttaaaaattttgtttgggctgggcgtagtggcagacacctgtaatcccaa

SEQ ID NO: 60891 - DNA, 201 bp, Homo sapiens
gaggacctgctctcagagtttggacagttcctgcccgaagccaagcggtctctggtgagtgccgagagcccctgcccagcctcgggggcctcagcgaggayggagggccccagccagcttgacccatgtccgggccaagcctatgtaccctccaggccacactagggtcccccagaagctacgcaggttgcagatacccag

SEQ ID NO: 60892 - DNA, 201 bp, Homo sapiens
ttcatcgtgaactccgaggactacatgtaccgtcgcgggaccctctgccgggccaagcaggtgccaggggaggcctgggctgccccgacatgcccctcctsaccccaagtcctggggccctgggggtccagccctcagctgccctgacacccggcctcttcaacaggtgcagcccctggtcctgctccgccaccaccagca

SEQ ID NO: 60893 - DNA, 201 bp, Homo sapiens
gagcgtggcaagccagaccggaggccgccctgtttccttctgccttgatcccatggctggggatgcccagggtcctctgtgggcccccagactggctttcyttggtcagaagtgctgcaggggctgggaaaggctgtgctggtcccaggagagcagacaaagagcagatctccgaggtggccctgccctgaggggtcccct

SEQ ID NO: 60894 - DNA, 201 bp, Homo sapiens
caggcactttgtacacatcctggttttctaagaagggaacttgccatcaagattcctgtaccaggcccacggccgtctcgggcagagccacctgggccccrggtgcagccggagaccccgccgagcccctcctcccagtattcccatccccgcatgcttctagggagcgcctcttttccgttcttgaggaatttctgttct

SEQ ID NO: 60895 - DNA, 201 bp, Homo sapiens
cagtggctgaccccgtcctgccttcctttccatagttagacgttgtcctggagacgaacctggccacaatccgtgtgttggaaagtgtgcagaagaagctrtctcggatggcgccggaagaccaggagaagttccggctggacgactccctgggaggcacgtcggaggtgatccagcgccgtgccatttatcgcatctatg

SEQ ID NO: 60896 - DNA, 201 bp, Homo sapiens
gcagtgatggactttggcttaggtagtgggtggcagcagccttcatttctttcttgccgactgtgccaggcaccggtgttagcaacacagaaagagtaatrcatcatctgacctcactcctgaacctgactctgctgcggcattattctgattttaccagtggggaaactgaggcacaagaggttgcatttgcctgggctg

SEQ ID NO: 60897 - DNA, 201 bp, Homo sapiens
gagcgggagaagctgctgtgtgagggccgcagggagaagggcagcgaccccgccatggagctgcggctgaagcagcccagtaaggctccaaagcctgccgrgaggccccggggggtgcctggggttaggggtcacagctcatgatctgacatgtcctgttacttttctttctggcttttcattttaagagaattctgtgat

SEQ ID NO: 60898 - DNA, 201 bp, Homo sapiens
gtggccactccccaggtgagggaaacacgcacggggcagcctggagagaggacacccagggcccagcacatggtgttggggaagtgacgcaggggacgccrgggggctggcagtctgtcccctcccccccccccaggctgggcacccctcatgggccatggcttcggggacagcaaccttgcttgtgacaccaggagattg

SEQ ID NO: 60899 - DNA, 201 bp, Homo sapiens
gaccccagccagtattccctcagagccggcacgaccctgctgtggggcggcgggcccagtcgtgttcctgcagtgggcaccctaggcgtatgtgtatacaygcacagatatttattcctttcgcttttagtggttgttatttctgtagcagccaagtcctgcggctccctggggctgagatctccctttgtggaactccga

SEQ ID NO: 60900 - DNA, 201 bp, Homo sapiens
ggccgtggcacctgtcctgggtgtagcaccctctcctgactggggaacatttgtttctcatgggctttctcgtggagccgtcatggcccagctccacagtrccctttttctttctttttttttttttttgagatggagtcttgcgctgttgcgcaggctggagtatagtggcaggatctcggcccactgcaacctccactt

SEQ ID NO: 60901 - DNA, 201 bp, Homo sapiens
aatgggtccctgcccatcaccatccacagcagtggccactccccaggtgagggaaacacgcacggggcagcctggagagaggacacccagggcccagcacrtggtgttggggaagtgacgcaggggacgccagggggctggcagtctgtcccctcccccccccccaggctgggcacccctcatgggccatggcttcgggga

SEQ ID NO: 60902 - DNA, 201 bp, Homo sapiens
aatcaaccctggggacaggtgctgtgtgagcccttttgcattaacttaaaaaaaatatgtgtgtgtgtgtgtgtgtgtgtgtgtgtgtgtgtgtatatatwcacataaacatttttctaatgtaaaataaagcacagatccaagaaaccacatggccaacaaatggcttgaatctttattaagcagtcacccatgtgccca

SEQ ID NO: 60903 - DNA, 201 bp, Homo sapiens
tgtttttgactttttgaagagcctctaaactgttttctacagtgaccgcaccattttacattcctatcagcaatggactgcggtttctgtctctccacatsttggccaacatttgttcttttccaggtttttttttttttttttttgccttttgtttttagtagccatcagtgtgtgaagttttattgcattaaggtttgt

SEQ ID NO: 60904 - DNA, 201 bp, Homo sapiens
ggctcaggggcgtctctccatcagctgggagttcaaatctcggtgggctcacgttgcatttccctgatggcaaatgtggctggggccctgtcctttcatgrccgttgggacatcttttctcatggaaagctatccacggtgtttgcgcctgtttccgttgcgtctgccttgttggtgactgggaggatttctgtgtctggc

SEQ ID NO: 60905 - DNA, 201 bp, Homo sapiens
gagagttggttgagaatgcagacacctggccaccatgcaggattcccattcatcagggcccgcccggcatcggcacagtttctttgctgtttttattttttgagactgggtctcactgttgcccaggctggagtgcagcggcatcatcacagctcactgcagcctctacttctctgggctcaagcaatcctcccacctcag

SEQ ID NO: 60906 - DNA, 201 bp, Homo sapiens
gtggaattcctgggtcacatgttaattctgtttttgactttttgaagagcctctaaactgttttctacagtgaccgcaccattttacattcctatcagcartggactgcggtttctgtctctccacatgttggccaacatttgttcttttccaggtttttttttttttttttttgccttttgtttttagtagccatcagtg

SEQ ID NO: 60907 - DNA, 201 bp, Homo sapiens
cctccatctctaaataaaaaatattttggccaggtgcagtggctcatgcctataatcctagtgctttgggaggctgaggcaggtgggtcacctgaggtcargagtttgagaccagcctggccaacacgacgaaactccgcctctactaaaaatacacaaaattagccgggcatagtggcaggcgcctgtaatccctgctgc

SEQ ID NO: 60908 - DNA, 201 bp, Homo sapiens
ccattcaactgggttaatgtccctgcccagccagggaatgagaggaggtggcaccatgtttgctgctggagtgtaatggcgcgatcttggctcactgcaayctccacctcccgggttcaagcgattctcctgtctcagcctcctgagtaactgggattactggcacgcaccaccacgcccagctaatttttgtatttttag

SEQ ID NO: 60909 - DNA, 201 bp, Homo sapiens
cagcgggcaaacggataaaccatgtcacctccagacaacaggatataaaacgaaatgagccatgaagctgtgaagacatgaaggggccaggcgtggtggckcacacctataattccagcaccttgggaggctgaggcaggaggatcacctgaggtcaggagtttgagaccagcctggccaacatggtgaaaccctgtctgt

SEQ ID NO: 60910 - DNA, 201 bp, Homo sapiens
ctgtaggggaggggccatagcttcctcccagtgacccatgtgctccctgtacacccaagcgtctctggcagttctgaccacacccccaccggagggtcagrgctcccagggagcgtggcaagccagaccggaggccgccctgtttccttctgccttgatcccatggctggggatgcccagggtcctctgtgggcccccaga

SEQ ID NO: 60911 - DNA, 201 bp, Homo sapiens
ttgtaaatgtcattggcaccctgtaggcaccctgctcgggacaagcatcctcgacctgttagccgatggctggagcctgggaggcaggccccgaaccagccacgagccccactctgctcccagcaagtgacgacatcatcccccagaaacgttttgtcattcatagaaaagacttcaaaacctggccccaaggcccccacc

SEQ ID NO: 60912 - DNA, 201 bp, Homo sapiens
tcgctgtgttacacaggctggagtgcagtggtgtgatctcagctcactgtaacctcagcctcctgggttcaagtgattcttctgcctcagcctcctgagtrgctgggactacaggcgcacaccaccacacccagctaatttttatatttttagtagagatgggttttcaccatgttggccaggctggtcttgaactcctga

SEQ ID NO: 60913 - DNA, 201 bp, Homo sapiens
agtagagatagggtttcaccatcttggctaggctggtcttgaactcctgacctcaggtgatccgcctaccttggcctcccaaagtgctgggattacaggcstgagctaccgcacctggccttgccttctgtgtttgagagcacctgctccccacaccctcatcggaaatcctagcctcttctgtctgtgtagtcagatgag

SEQ ID NO: 60914 - DNA, 201 bp, Homo sapiens
ccaggaggttgaggctgcagtgagctttgattgtgccacagcactcaagtctgggtgacagagcaagaccctatctcttaaatacacacaccccccccccmaaaaaatcctctggtctctgaggtcccaggctcctctctgaggcctcttgagttccccagtggctgaccccgtcctgccttcctttccatagttagacgt

SEQ ID NO: 60915 - DNA, 201 bp, Homo sapiens
ctcaaaaaaacgaaaacaaaaaaaaatgaccagcctgggcaacatagtgagacctcgtcagaaactagccagaagtggtggcgtgtacctgtacctacttyggaggttgaggtggctggatcgcttgagttttcgaggcagaggttgcagtgagccctgatctcaccactgcactcagcctgggtaacagagtgagaacct

SEQ ID NO: 60916 - DNA, 201 bp, Homo sapiens
tgggtgccagggaggaggtggaggaaccgggaagccggccacattggctctgtaaggccatcacgccctccctctgacgtgcacagagcccactgcacagrctaggctgggagctggctgggcctgggtcctggacccccagtcaagtcccagaggaagacaggccagccctgggatgcttcagggaggatgccctggctt

SEQ ID NO: 60917 - DNA, 201 bp, Homo sapiens
gtgaagtggagctggaggagtactacccggccttcctggacatggtgcggagcctgctggagggcagcatcgaccccacgcagtacgaggacaccctacgygagatgttcaccatccatgcctacgtgggcttcaccatggacaagctggtgcagaacattgcgcggcaggtgagccgggccggggtggggccggccctga

SEQ ID NO: 60918 - DNA, 201 bp, Homo sapiens
ggctctcagaagtaacctttccctgtctctaatacagcttggctccgtgctgagttttttctgttcctgtgcagacagtggctgggcctggtgtttttcayaatctgtttccagtgtcgggcctggcagtaactcattgtcgccttgtcaggagaattcgcacaaccacggggacggtgcagaggacttcaagcagcaggt

SEQ ID NO: 60919 - DNA, 201 bp, Homo sapiens
atggcctgaggtgagagtgagtgggtgtgcttgaggaacagccaaggagaacggcagggtcaggagctgaaggagagaagggggagagggagccaggagcrtgagaaccactggatggttctgggaggcggttctgctgctgtgctgagaatgaggggtcaggaggcccctgggagaccagggaggggccccaagtgatgg

SEQ ID NO: 60920 - DNA, 201 bp, Homo sapiens
accagtggaaggctgagcgctgcatggccgacgagaactgcttcaaggtgagaggaggcctggggctgggaacacgccgggaggcccggccgctcactccrctctggactcagtcctgggtggaccctggttcagcggctgggacaccggccctgctgcagagcccatgaggtacctttgacctgcaggaagcatcagggc

SEQ ID NO: 60921 - DNA, 201 bp, Homo sapiens
cataaaatcctgtaaaattctaattagttgtggggttttttgtttgttttttcttagagtctggctctgttacccaggctggagtgcagtggcacggactyggctcattgcaacctccacctcctgggctcaagccatcctccaacttcagcctcccaagtagcggaggctacttggggctagaacatgggcgcacatcac

SEQ ID NO: 60922 - DNA, 201 bp, Homo sapiens
ttctgtgccaagaatcccaagtgactggggctggggaccacttctccaggcctctctccccgaccatgagagcccctggccctggcccctgcacaccagtrggcccagaataaccgccacccttgccatcctgcaacagctggactcaagtttccaggaagtggagatgtgtttctagaagtttcctgtggaacctggagg

SEQ ID NO: 60923 - DNA, 201 bp, Homo sapiens
agtttcctgtggaacctggaggctcctgatgcctttgactccaggctgggcgattccgatgctgacccgtcctcctgggctccccacccccgctccccaartgtcacacaggcactttgtacacatcctggttttctaagaagggaacttgccatcaagattcctgtaccaggcccacggccgtctcgggcagagccacct

SEQ ID NO: 60924 - DNA, 201 bp, Homo sapiens
accaggcccacggccgtctcgggcagagccacctgggccccgggtgcagccggagaccccgccgagcccctcctcccagtattcccatccccgcatgcttytagggagcgcctcttttccgttcttgaggaatttctgttctggggcttgtccttcctttgcagctgttttgaatgtagttttccttttctatttatttgc

SEQ ID NO: 60925 - DNA, 201 bp, Homo sapiens; identical to SEQ ID NO: 33755

SEQ ID NO: 60926 - DNA, 201 bp, Homo sapiens; identical to SEQ ID NO: 33757

SEQ ID NO: 60927 - DNA, 201 bp, Homo sapiens
gcagccttgacctcccaggctcaaatgatcctcccacctcagcctcctgagtaactggaaccacaagtccatactaccatgcccaagttgttgttttttttactttttttgtagacatgaagtctcactgtgttcccgaggctggtctcacactcctggcctcaagcgatcctcccaccttggccttccaaagtgctgaga

SEQ ID NO: 60928 - DNA, 201 bp, Homo sapiens
gccactgtaagcctgcttcaagctaacccacccctttttaaaagtgtgtttaagtcaagtgctgtctttattctaggcccagtttttagacgttgagtccrgtgggtctgagtgcactcaataaagatcctcctgtatacaccccaaggtctctcttttcctcctgtttccacaacactacatgtgatgctgacagagggt

SEQ ID NO: 60929 - DNA, 201 bp, Homo sapiens
ttcctgtgagagccttgctgacttcctgccaccaggtcagtgggctggacccatgagagcaaggggtggctgggtgtgcctacctgggaccaggggagtcraagcccctccttgaaccaagatcatctcacaccctgcacctgccccgccacgacatgggagtgtcttctagaatattctttccccattccatttgcacat

SEQ ID NO: 60930 - DNA, 201 bp, Homo sapiens
tgcagccttgacctcccaggctcaaatgatcctcccacctcagcctcctgagtaactggaaccacaagtccatactaccatgcccaagttgttgttttttttactttttttgtagacatgaagtctcactgtgttcccgaggctggtctcacactcctggcctcaagcgatcctcccaccttggccttccaaagtgctgag

SEQ ID NO: 60931 - DNA, 201 bp, Homo sapiens
tggctgaccccgtcctgccttcctttccatagttagacgttgtcctggagacgaacctggccacaatccgtgtgttggaaagtgtgcagaagaagctgtcycggatggcgccggaagaccaggagaagttccggctggacgactccctgggaggcacgtcggaggtgatccagcgccgtgccatttatcgcatctatggcg

SEQ ID NO: 60932 - DNA, 201 bp, Homo sapiens
aataaccgccacccttgccatcctgcaacagctggactcaagtttccaggaagtggagatgtgtttctagaagtttcctgtggaacctggaggctcctgaygcctttgactccaggctgggcgattccgatgctgacccgtcctcctgggctccccacccccgctccccaagtgtcacacaggcactttgtacacatcctg

SEQ ID NO: 60933 - DNA, 201 bp, Homo sapiens
aatagatatggaaacacctacacaagcagcctctgcctcccaaattgatctgtttggaagatttaaatcaagagtggatgtcagggaggtatcctcctaaygcagaattttgtgtgaagtctaaataaccacctcagcagttgctgaggtcttggcttgaggctttcccagcgagcataccaggcaggcttgcccttgtat

SEQ ID NO: 60934 - DNA, 201 bp, Homo sapiens
ggatcgctgcagccttgacctcccaggctcaaatgatcctcccacctcagcctcctgagtaactggaaccacaagtccatactaccatgcccaagttgttgttttttttactttttttgtagacatgaagtctcactgtgttcccgaggctggtctcacactcctggcctcaagcgatcctcccaccttggccttccaaag

SEQ ID NO: 60935 - DNA, 201 bp, Homo sapiens
aattgcttgagccagagaggccgaggctgcagtgagccgagatcacaccactgcactccaccctggacaacagaatgagaccctgtctcctaaaaagtttmtttaatgtaaaaattaaatttatttttattttatttatttatttattttgcttgctctgtttcccaggctggaagtgcagtggcgtaatcatggatcgct

SEQ ID NO: 60936 - DNA, 201 bp, Homo sapiens
gtgaagagtgaatgcccggactggagggagacgctgccagagctggtggggccaggccagaggcgggtggctgtggcaggaccctggaccacctcaggtcrggctaggatggcacctatgggaccagtgggggctgctggtgggtgttcagatctgggggcatttcttgttgcttccatttgctttctgtggacccctggg

SEQ ID NO: 60937 - DNA, 201 bp, Homo sapiens
tctactaaaaatacaaagctgggcgtggtggagggcgcctgtaatcccagctactcaggaggctgaggcaggagaattgcttgaaccggggaggtggaggwtgcagtgagccgagatcatgccactgcactccagcctgggtgacagagcaagacttggtctcaaaaagaaagaaaatagctattacccttataatgatag

SEQ ID NO: 60938 - DNA, 201 bp, Homo sapiens
ttactggggttggtcacgatgtattatctttttatatattgtctggtttgattcgctaaaatttttctaaggatttatgtatttatgtttatgagggctgytgacctctagtgatctttttccctcttgtaatgatgccatatagttttggtatcaggtagtggttgcctcattgaatgagtttggaaatgtcttttcctc

SEQ ID NO: 60939 - DNA, 201 bp, Homo sapiens
tgattagcgtaggccccaaagtcagtaccatggaacctccactttccctgctcaccagccctgtgggcctgggggaagggaggtcacttaactcccagtgrgttcaaagtcatccttggtgaaccaggataagaacacctcataatgtggttgtaaggataaaaggagataacccacaaaattcacatggtaacttgtatt

SEQ ID NO: 60940 - DNA, 201 bp, Homo sapiens
ccagatctatttcctcaactcaggaagaccacggggctccatctggatcccttcttcctgtgctgtggtcttgagattttctcctggcagaaagctggggrccatcttattgccaacctcatttactttgcttctctcagggatccctgtcctttgttgcctgatgtccagtatcttgattgctttatatatcttgcccat

SEQ ID NO: 60941 - DNA, 201 bp, Homo sapiens
gtctcaaaaagaaagaaaatagctattacccttataatgatagctgtggttattgtatatcctatagacctactaggctatattatacaatacagctgttmtttggcatggcagctcaagcccccagcccaaatttggaagcttcttcaaggaaaatggtgaaataacataagagtggaggatgctcaatttttaactgct

SEQ ID NO: 60942 - DNA, 201 bp, Homo sapiens
gatttgcaaacagctcacattggaagctgcaaacacacttaatccagttgtggccaactcagagcctttgatagatgttttctttccacggggcagggccrggttggcttttataactgagcaatgaggctcataaaagccctggtcacaatgcactgtgggctgccctgggtttgatccagcctgacctttgtgatttgt

SEQ ID NO: 60943 - DNA, 201 bp, Homo sapiens
ctacttaaacacgtattcagctccttttacttgcttcatcctccacccaggcagattaggcttcagtgtccctctccccatcgtgtttattgagcacttaytagaggccagctcaggaagaggaagcacagctcagagctcaagagcctggactcattaggcaaatcatgttcacaccctacctgttccgcttaagtgctg

SEQ ID NO: 60944 - DNA, 201 bp, Homo sapiens
gtgtcattccgagtttacagtgaagtgcaggctgttgacggtggtggggctgggatttgaatccaggtccctctgcctccaaaatccatctccaaaacccwtgttcctcacttgagtcacaggatgggaacattcaagacagtcaggtggggggtggcgagacaggcgtgggtggaggagagaagtttccctggaagaaag

SEQ ID NO: 60945 - DNA, 201 bp, Homo sapiens
aaggaggatcacctgaacctgaggaggtcgaggctgcattgaaccaagatagcgcaactgtaccctagcctgggtgacagagctagaccctgtctgaaatwaaaaaaaaaaaaattacctttgtaatgagccctgccctactttaaaaacaaaaaaacaaaaaacaaaaaaaaacttccttaaacaatgtgttattagccg

SEQ ID NO: 60946 - DNA, 201 bp, Homo sapiens
aggctggattgagaggccataaatagatcttgcctttaagttttcatcagggtttgtaagtggggagtatcagaagcaagtgaacaacccaggaaatcacyggtgaatggagggttgaaggcagtctaggtgctcagcgtctgtctccttgtgtcccaattcctgccataacagctacagctttccccattccatgctttt

SEQ ID NO: 60947 - DNA, 201 bp, Homo sapiens
cagttttttattttaacctctattcgaacagatttcatgtttttaaacaaatgttacaagtaaagcacaatcttcctaacaatctgggtagtaggtattayttccactgttttacagatgaggaaattgaggcttaaggaggttaagagccttttctaagaacacatagctgttgaacggggaagtggggattcaaaccca

SEQ ID NO: 60948 - DNA, 201 bp, Homo sapiens
aacagagaggctgtgcacgggaccctcattaaccaagtcagtatcaacatgagtttctggtcacctggggctacagttcccaagccctgctcatctcctakagaaccatgtccgcaattgtcatggcttctgcttttatggaaacccctgaactagatcaaaacaagaccccatgaagctaacaccttgcttctttaagaa

SEQ ID NO: 60949 - DNA, 201 bp, Homo sapiens
ttggatcttgtcattatatcttccatatctacttaatatgttcagtcttttctctggcttcttgaacatatgaaatacagttagtgcagcagttataatgytcttctccactaattctatcatctgtatcatttctgagttggttttgatcatttattttctccccactttgaagtatatttttccttcttcctcctatta

SEQ ID NO: 60950 - DNA, 201 bp, Homo sapiens
cccagccccacagactccagtggcttcctgagcagaagggaggagtggacagagccccctggctgcttccccacgcacccatccaggctgccttccggcaygactccctgccgcagactgaagggactcctgaagcgcagacttcaaggaggatcagtccaccctgaaggtggccaagcctggaagccccacccttccctg

SEQ ID NO: 60951 - DNA, 201 bp, Homo sapiens
ccaccaagtggtggtagcgcctgtgctgtgggattacagtaaggcttagtgttaatggatgtaaagcctgtggaaaagcacaatggaattgaagtatctcratgacaccaccttctcttccctttcagaatgatatcccaggacctgggttctacaatgttattcaccagtcaccggtgtccaacagtgtctcattgtcca

SEQ ID NO: 60952 - DNA, 201 bp, Homo sapiens
ggctgcacagattcgcggtgggtggggagctgccaggctccttttctgatctcccagcaggctttgactgacgctgtttagtctttctgtacattaacccygccagataccgagaggttacaaagcctccaaggcctgtacaactgtggcctctccagagaagtggttctcagccttgactgcacactgtaatcacctggg

SEQ ID NO: 60953 - DNA, 201 bp, Homo sapiens
ctggatgccctagtcattgcagtattacaataaaaagaaataacaggcatacaaattggaaaagaagaaataaaatgttttattcacatacaacatgattrtatatgtagaaattcctaatcgacaaaaaagctactagaactgaaaaaaaaagtttagcaaagttgcaggatacagcattaatatatataaattacttat

SEQ ID NO: 60954 - DNA, 201 bp, Homo sapiens
ttggggtggggaggaatactcaggtcattggtcaaccatccacattggtgagatccccagtgtcccagctcatgtgctccctttggttttgctagtgttcrccaactagtgttctggttcgttagtgtggcttaggaattattgctgagacaggaaacctcattttgagatccccctaggctccagcgctttttctttcga

SEQ ID NO: 60955 - DNA, 201 bp, Homo sapiens
ggttccacactcctctgtcatttaaccttcacacatcacctcgttctgacatcaagggtgcgtcacagccacagtgaggcctcgcctgggcagagcaactytgggtgccccactgggtccctcccacaggggcaggcaagcctaatgggaacccgaggcaaaaggaaacatcagtaatacgaatcctgtctttaaaactgt

SEQ ID NO: 60956 - DNA, 201 bp, Homo sapiens
aaattttttttttaatttgcagggtgtggtggtacatacctgtagtctcagctactcgggagactgagatgggaggatcactgagcccagcaggtcaaggytacagtgagctgtgattgtgattgtgccactgcattccagcctggacaagagagcaagaccctatctcaaaaaaaaaaaaaaaaagatagttgttgattg

SEQ ID NO: 60957 - DNA, 201 bp, Homo sapiens
catcggattttatttccaagagagactttagtaattcgtgttccagcatgttccagttgccaagctttatgaaagctctcaagtttgaaactcctgcaccraactattacaatgtaagaactctgcctatgcttgctaaatatagatcgaattaatggtttactaaaataaaaggaagaggggatcttggggacatcgtat

SEQ ID NO: 60958 - DNA, 201 bp, Homo sapiens
ttgtagtgagccgagatcgcactactggacttcagcctgggcgacagaatgagactccatctcaaaatcaccaccaccacaacaacaatgtgttatcataytcctgtgtcacccaccacccccccttccctaaatcttgccgcatctcttttcctctctaacctggaaagttctgcgtggttcctgaccggtccttattta

SEQ ID NO: 60959 - DNA, 201 bp, Homo sapiens
actggacttcagcctgggcgacagaatgagactccatctcaaaatcaccaccaccacaacaacaatgtgttatcatattcctgtgtcacccaccacccccscttccctaaatcttgccgcatctcttttcctctctaacctggaaagttctgcgtggttcctgaccggtccttatttaatctttgggatttctgggacctg

SEQ ID NO: 60960 - DNA, 201 bp, Homo sapiens
aattaaccaatgtgaaatgatctctacaaatgctgtgttttgctgtttcaggtgcttaggagaacatgcagtagaacttttcatcaaacaaatggaacacrtcacagaattttgctaacatggacaactctgcacagaaaaatgaacgcactggcaaacatcccagacgtgccagtgaagtacagaaaggtacatgtgtct

SEQ ID NO: 60961 - DNA, 201 bp, Homo sapiens
ttcttctctccctagtttctctgttttaactgtttggctctttcccattttctgtctggtttcccatttgtcaatttaatgataatatattgtccctctcyaggatatttgcagcccagcctccgataaaaacaatagcagccaccatttacttatccttactatgtgtacttttagactgccttttatctctaatcctca

SEQ ID NO: 60962 - DNA, 201 bp, Homo sapiens
cccagcatcttcccgaggtggaggcacctcccacagctcgtcttatgcccttgacacaaggttaatgtgtgtgctgtcttacctccaccacctgcctaggrgctccttgggcagtggtcattgctgtcctttccagaccccacaaacccctcaaaaatggatcaaatgaccccaactcaaatctgcgcatttcccatggag

SEQ ID NO: 60963 - DNA, 201 bp, Homo sapiens
gtgtgctgtcttacctccaccacctgcctaggggctccttgggcagtggtcattgctgtcctttccagaccccacaaacccctcaaaaatggatcaaatgmccccaactcaaatctgcgcatttcccatggagtcacgaccacacatccatccatgagcactgttgtgatacatctccttcctcccattcctaaaccctgt

SEQ ID NO: 60964 - DNA, 201 bp, Homo sapiens
agacttgaaaacaatggcggtgtgagtggtaaagggttatgcagagtctcttgatttccagcccggtgcttttccactcctgcctcctgcctccccaggaygatatttagtaggattctggaatgtcaatgttacagtggcctctaaagacctgctggtcttgggatggcaaatctgtggaatgtgggatgcttctttctc

SEQ ID NO: 60965 - DNA, 201 bp, Homo sapiens
atatacacggcctgccatttctggttagctccacatctccagcaatgcacactgagctctcactgtgtgccaggcctatcctgagtactgtgttttaggtrcgtcatctcatttatcctgacaaccctgacctcaaagtaggtcccatcatgattgccatgtgcagatgaagaaacagatccaggggtccccagctcacta

SEQ ID NO: 60966 - DNA, 201 bp, Homo sapiens
cctgacctcaaagtaggtcccatcatgattgccatgtgcagatgaagaaacagatccaggggtccccagctcactaccagtggagctagggctctgccccrgtgccgtgaccagtcctcttccagacagcttgctgctgtgcaggtcttggctgtgtctagaaactgtgccttccccactagactgccttagtgacatctt

SEQ ID NO: 60967 - DNA, 201 bp, Homo sapiens
atgttgtcaataattctattaaatatcaaatttttagtatagattgtccaccaaaaaaaagttgaaaattgctgctgtgaggattacagaataaagtaagraaaaatactgcatggaaaaggaccagtagagtgtaaaatcatttattcaatcctttactcattagtatatataaatggtataagttccttagggaaaaaa

SEQ ID NO: 60968 - DNA, 201 bp, Homo sapiens
ctgagaggaaaatcaaccaataggaacagacttaaaaatgacagattatagaattagtacaaagaaaccttaaagcagctactatgaatcttacaaatatycctaaggatgtaaaggaaactgaacatgatgaggctagaaatagaagacatagaaaaagagcccaaatgtaacctctagaaagaaaaaatacaatatttg

SEQ ID NO: 60969 - DNA, 201 bp, Homo sapiens
caaatgtaacctctagaaagaaaaaatacaatatttgaaataagaatgcaatggatgggatttgcagctgatgagacttcagaagatcagtgaacttggcygggcatggtggctcatgcctgtaatcccagcactttgggaggccaaggcaggtagatcacaaggtcaagagttcaagaccagcctggccaagatggtgaa

SEQ ID NO: 60970 - DNA, 201 bp, Homo sapiens
gaacatttaagatattaaatacatgtattaagaaagaagaaggcgctgggtgcggtggctcactcctgtaatcccagcaatttgggaggccaaggtgggcmgattacttgaggtcaggagttcgagaccagtctgaccaacatggtgaaaccctgtctctactaaaaatacaaaaaattagccaggtgtggtgggagtgcc

SEQ ID NO: 60971 - DNA, 201 bp, Homo sapiens
tcagtatgagatcgtggactacttaggcccccgcaagcatttcatctctagtgcatcattcgtgtccaataccagccggtggacagcggcgccgcctcagycaggcctgcctggcccaggtcagaggattgttttaaatgattgtaaaaaccaaatcttctggaactgtttgtcattcttgggtcatcaaatgccattgat

SEQ ID NO: 60972 - DNA, 201 bp, Homo sapiens
ctactagaactgaaaaaaaaagtttagcaaagttgcaggatacagcattaatatatataaattacttatatttctctataccagcaataaacaatgagaartttaaaaaattttaagaccatttttttgacataaaatatgaaatacttaggaatcagtttaagaaaatatatgcaatatttgtacactgataactgtaaa

SEQ ID NO: 60973 - DNA, 201 bp, Homo sapiens
gtggctcacacctgtaatcctagcactttggatggcagaggcaggcagattacctgaggtcaggagttcgagaccagcctggccaacatagtgaaaccccrtctctgctaaaaatacaaattacagatggtgggcgcctgtaatcccagctactgaggaggctaaggcaggagaatcacttgaacccaggcaggggcagcg

SEQ ID NO: 60974 - DNA, 201 bp, Homo sapiens
taattgatttttgtatattgaccttgattctggtgacctcactaaatccaactattacctcttatagggtgtccacagattattttgcaatttccccatayacaatcttgtaatctgtgaaaatgacaactttatttcttcctttctcatccatatattttatgtatttttaatatattttatgtaggcgtttgtattggc

SEQ ID NO: 60975 - DNA, 201 bp, Homo sapiens
agcttgtatggaattgataggtggagtgttctataaatgccaattaggtcaggttaggtaatagttttgttcaggtttcatatatctttactgatctatckacttgtttaaattatcgagggagatgttttgagatctctgactataattgtgaaattttctactttttctcgcagttttatcagtttctgcttcttatat

SEQ ID NO: 60976 - DNA, 201 bp, Homo sapiens
gaacactaatacattttttaataacagctttattaaagctagggcagtagatggttcttactaaaatggtataacactgaggggtggtaaatgaatagtgrctgctttggttattttttgagacagggtctcactttgtcacccaggctgaagaacagtggcacgaacatagcttactgcagccttgacctcttgggctca

SEQ ID NO: 60977 - DNA, 201 bp, Homo sapiens
cttttcttctaatgtgactttgggcaagtcacttaaccccccaccaaacttaagttttctcatctgtaaaaagtggggattatacctcactggattattayaaaaattgcataaggtattccatagaaggcatttaggactgtgcaggctcaataaatgatagctattattttaagttgttaatacgatatccctgtgcgt

SEQ ID NO: 60978 - DNA, 201 bp, Homo sapiens
ttgaaaaagataaagcagagtaaggggctagagagagatgggttggtgcttcttaagagagggtggtcagggaagtcatccctaagaaggtttgagcagaragtctcgtgaattttgtgacaggactgcaggacgatgcctgggtccggtgaggaaaggagctccccatgcagcaaggagatatgtggcaaaagccaggga

SEQ ID NO: 60979 - DNA, 201 bp, Homo sapiens
tgttgcccagggtagtcttgaacttctgtctcaagccatccttccccctcagcctctcaaagtgctgggattacgggtgtgggccaccatgcctggccaaytgagcaaatactgtatgtgaggaaatagactgaagattcagagttgaactttctactggggaagatcataaacaaataaagtaataaacatacaatataa

SEQ ID NO: 60980 - DNA, 201 bp, Homo sapiens
atatattctgagcacagctgtacacacaattgctaaaaggtgtctacctctagtattcattcattcattcattccaccaatatttatgaagaaaatactawttttaaaaattctcaatactattattattatttttgtagagacagggccttgctatgttgcccagggtagtcttgaacttctgtctcaagccatccttcc

SEQ ID NO: 60981 - DNA, 201 bp, Homo sapiens
tccgggtgcttgcggaattccagggctgagctaggtggagccccgagggcgggaagaagccaccatgggagttgcccctgcgtcggggcgtgtcctcggtrtttccacccgaaaagtggtgacaactggggcttgcctgctccaccgagctcctgccaggggcgtgggcgtccgacccttctggctcaggctccgcgagtg

SEQ ID NO: 60982 - DNA, 201 bp, Homo sapiens
gcgaccgggaggttgggctggccagattcagctgccgggaccggaccaggtaggaagcagttccggcggggggaccggtccctgaggtcgtggggaagagkacacggcgcaccatgtcctccgcatgggacgcccgcggagaccccccggcctccgggtgcttgcggaattccagggctgagctaggtggagccccgaggg

SEQ ID NO: 60983 - DNA, 201 bp, Homo sapiens
taatgattggtcaacaacttttcacgttaaagaaacagaggatgccattggctggagttacctcgcggacggcggaaggtggactcgcgaatgttaggccwgtgggtgccatagcgaccgggaggttgggctggccagattcagctgccgggaccggaccaggtaggaagcagttccggcggggggaccggtccctgaggt

SEQ ID NO: 60984 - DNA, 201 bp, Homo sapiens
actttgggaggccaggaggatcacttaagcccaggagtttgagaccagcctggacaatatagtgggaccccatctctacaaaaaaatttaaaaattagccrggcgtggtggcgagcgcccgtggtcccagctactcaggaggctgaggcgggaggatcgcttgaactcgggaggcggaggttgcagcgagtcgagatcgcg

SEQ ID NO: 60985 - DNA, 201 bp, Homo sapiens
ggagaggaacgagttggtgcattgtagaaactgcccgaaggccagcagggctggtgagagatttttctgggggcgtggttgggcctgcgatctgagggacrggccagggacagtttataaataacatatttgggggccggcgcggtggctcacacctgtaatctcaggactttgggaggccaggaggatcacttaagccca

SEQ ID NO: 60986 - DNA, 201 bp, Homo sapiens
ttcgccttttataaaatgcgtttagaccttgtgctggtcaccatctttttgacatctgtccttcagatccacaatattatgtgacaatgctgattcctttkgttgtctccttacagtgcgcccgattggacaccatcgtttctaaataccctgcagcgaatgcatacactatcccatcggattttatttccaagagagact

SEQ ID NO: 60987 - DNA, 201 bp, Homo sapiens
gtggtggcgagcgcccgtggtcccagctactcaggaggctgaggcgggaggatcgcttgaactcgggaggcggaggttgcagcgagtcgagatcgcgccaytgcactccagctgggcgacagagcaagaccctgtcaaaaaaaaaaaaaaaaaaaaaaaaagcttggatttcaccctaaatttaaaggcgagccattggag

SEQ ID NO: 60988 - DNA, 201 bp, Homo sapiens
tgttatagccagaagccttggatctcctttccagtcaggcagaaacctctcctttccccaggagaatgtccttcctttaaccttttttaaataactctctytttactgcctcctctgcacactctcttagctgttctataggcttaggcttttagaaacaaaagccaggaagtcttgcagctgcttctgccttttgatttg

SEQ ID NO: 60989 - DNA, 201 bp, Homo sapiens
gaaaagacagctgaatatcagagtgttgaggaaatatccaaaatccagtttctcaaattccagttctgttttctcctgtgtccctggagggaagagagggrcaggagctacacgggttcctgaggtcagtagacccctgaggtgaccccatctgcatgcaccttcccttaggactttgtccacatcagaactaatcctctt

SEQ ID NO: 60990 - DNA, 201 bp, Homo sapiens
acagagtcaggatgcacccccccacccaaaatttggtttggatgtcaagacttacggtgccacacacacgctcatgaagagtgtaggaaaaggcttatcayccacatagtgaggccttctgaggacagcagcacagccttcctaacctgatccaataatggcttgagagagcagggaaaggagcctggcttgggggttttc

SEQ ID NO: 60991 - DNA, 201 bp, Homo sapiens
tgttgtttaggttttactgctgcatatccaacacaatcctccattccttttaaatctcaagcttcagtaatcccagaatcagaaaaaaaaggattcaataktcaagccaagagatttcctcataagaaggtaatgacgttgtctcaggggttctttcgttttagtctggattttagccttgcgggacaggcacgttctgtc

SEQ ID NO: 60992 - DNA, 201 bp, Homo sapiens
ccccatccttgtgagaggaaatcacatgacttcaaataacacaagaggaaaagaagagtcgaatacatctagaattacctttggagggccgggcacggtgscttatgcctgtaatcccagcactttgggaagctgaggtgggagaattaattgcttgagccaggagtttcagatcagcccaggcaacatagcaaaacccaa

SEQ ID NO: 60993 - DNA, 201 bp, Homo sapiens
ttctctccctagtttctctgttttaactgtttggctctttcccattttctgtctggtttcccatttgtcaatttaatgataatatattgtccctctctagratatttgcagcccagcctccgataaaaacaatagcagccaccatttacttatccttactatgtgtacttttagactgccttttatctctaatcctcagaa

SEQ ID NO: 60994 - DNA, 201 bp, Homo sapiens
cactccaaagcctcttgctctttccacacactgcaccacacctgcctttgtggcccgcaaagctgtaaatttggcctgtgaaagtcagcaagtttctgaaraggccttagcaacacagaccaagctgaagacaggggaggatgtcagctaccgtggatgggccccattccccgtgatctagttctgaacactcaaattcag

SEQ ID NO: 60995 - DNA, 201 bp, Homo sapiens
gtttttagtctcatgttactggccaaaaaatgtaaagcccagccgtgagaggatggctggatatgaccaaagctcaggaggccaccattagggcagggaayggctgatcacgtcccctgaagaggccatggaggcagcgtgggcagtggattgattagcgtaggccccaaagtcagtaccatggaacctccactttccctg

SEQ ID NO: 60996 - DNA, 201 bp, Homo sapiens
tctcagcatttgtaagcattttagaaataaggatggaattttatggaaagggcaggggatccatcaatcaggctttccgtgtcctactctgtcactggctstgtgcctttaaaccagtcacttgacttttctgggcttcagtttcctcaactgaaacataaaatttgtattatataatttttgtggtctcctcaagttata

SEQ ID NO: 60997 - DNA, 201 bp, Homo sapiens
acagccaacttgaggagccacagggaattggctcaggactaagtctttcctcattccctgtgatgctggattcccctggtgctgacattgttctatttttstaacataaaatcttcgctggagtggcaggacattcagaagcagtcaagctctcatagctttataccgatggaagtttaagccctgactttcgagttggtg

SEQ ID NO: 60998 - DNA, 201 bp, Homo sapiens
ttcctcccattcctaaaccctgtgagctgctaacaggttgcgcctgtatcttccatccttggcacaggtcctgatgcacagtaggtttcaatcagtgtcckctaaattgcatttttgcccccatcccacgcagggcacttcaacaggctgctaataagctgctcagtcccactctgaaggtttgtgactcccaagggaggg

SEQ ID NO: 60999 - DNA, 201 bp, Homo sapiens
gtgactcccaagggagggtcctggctccatggaggcagtagcaggcaacatcgtgcgtggtgatggtgatggtgatgatgatgatggcgggccgcatcggygctgttccacccactttatgtgtattgaccccttcaatcctcacacttagaggcagcaaaggagacagtgggtagggcttccctagagcactagtaaatg

SEQ ID NO: 61000 - DNA, 201 bp, Homo sapiens
gccaccttccgggctttgctcctgctgttcccctacccgacgctctcaccaagtattcaaatccaaaacgtccttgaagacccagcgctccccagagcccycgcgagacttgggaccaaacatatctctcctttcctgccctcctggaacacctgtcggataccaagcctcccagcaatactgaaggtcctgaaacgagcc

SEQ ID NO: 61001 - DNA, 201 bp, Homo sapiens
gcaggcatttcgcgcaggcaagtggctgcgaggacggggagtaggcgggacagcccctggcaattggctgcgctgcaaagcttgcttgaagcataagggarcgacctggggctagagcttggcgctcacctggagcggggaccccctagcggccacaggaagaatggtgcggcgactcccctgccccctctcccgctgtcc

SEQ ID NO: 61002 - DNA, 201 bp, Homo sapiens
tcaaaaaacaaaaaaagtaaataaaatatatgtttggcattggcattgcagctggtgactcaaaattaacacagatttttaaaagtaaatacagggatttktgttaccctgtttaatatcctacacattttatattactctcacctaagaggctcaaatactcacagagcttatttatttctcgaatggttctagaacttc

SEQ ID NO: 61003 - DNA, 201 bp, Homo sapiens
aaaccttctgagaaatgactcggactcttcgtgcaacccggaggcacagcctccttcatcccttcccaattcagagctgccaagatgctgcagtgttttgmtttcaaaggtcgcgatttgatttgccagactgcctgccagtcagaagttggcaggcatttcgcgcaggcaagtggctgcgaggacggggagtaggcggga

SEQ ID NO: 61004 - DNA, 201 bp, Homo sapiens
gctcagccccagttcatgctctcctgccttgcatcatccatgggcaaaaccccaccttgtctatttatacagaagaacaaagccagcatccctggggttggccagagtccctgccagtgagccctgggatgtgggcacctccacagtctgcccctgctcctgctccctcccggggtggggggatcctgagaagcccccagc

SEQ ID NO: 61005 - DNA, 201 bp, Homo sapiens
tgaacccgggaggcagagcttgcagtgagtggagatctcgccactgcactccagcctgggagacagagcaagactctgtctcagaaaaaaaaaaaaaaaamaaaaaaaaaaaacactttcctagcggtgatctctgctgggccacccccactccctgacagaactccacagcaagtggagctgactgtccaatccgtttta

SEQ ID NO: 61006 - DNA, 201 bp, Homo sapiens
cgttgcacgaaggcggtggtgtgctggtcaaccaccatttaccctcctcgaagaaaagtgctgagatgtagcatctgcccgtttttgtgacataaatactsccaccgtggccaatttcaagccaccagcagcaacattttggaatttttaacagttgtcctcacaagctgccgctggccagctccagctgccgctgcctgg

SEQ ID NO: 61007 - DNA, 201 bp, Homo sapiens
ggtggtgtgctggtcaaccaccatttaccctcctcgaagaaaagtgctgagatgtagcatctgcccgtttttgtgacataaatactcccaccgtggccaayttcaagccaccagcagcaacattttggaatttttaacagttgtcctcacaagctgccgctggccagctccagctgccgctgcctggaggactctcttttt

SEQ ID NO: 61008 - DNA, 201 bp, Homo sapiens
cttcttgccatttgccttggactcaagccagtatgcaaagtggcagaattaaagtgtgttaaagcccaggaaagttgtgagcttcagcaaatgaaaacacragatgtccagttaaattagaatttcagataaatggcaactctgttagtacaagtatgtcccaaatattgcatgggatatactaaaatcatcatctgcagt

SEQ ID NO: 61009 - DNA, 201 bp, Homo sapiens
catgcccaactaatttttgtattttttttttttttagtagagatggggtttcaccatgttggccaggcttgtctcaaactcctgacctcgtaatccatccrcctcggcctcccaaagtgctgggattacaggcatgagccacagcttccagccaatctgacatattttttaaaaagttccttccagctgctgtgtggtgaa

SEQ ID NO: 61010 - DNA, 201 bp, Homo sapiens
ctctgttagtacaagtatgtcccaaatattgcatgggatatactaaaatcatcatctgcagtttatctgaaattctaatttaactgggcaggtaggatggmgccggcatttaggtcttgcattttgtctggaacccctagctcctcagacacatatgagtgctcagaaaattcttgcaaactgatggtcaggttcagagtg

SEQ ID NO: 61011 - DNA, 201 bp, Homo sapiens
catttattataccatttccttttttccttcataatattgataattaataattatttttctgactacaaaaatcctgcccaccttctatgatggattcaagsttttttttgagacggagtcttgctctgtttcccaggctggagagcagtggtgcaatctgcaggctccacctcctgggttcacaccattctcctgcctcag

SEQ ID NO: 61012 - DNA, 201 bp, Homo sapiens
cactatctactatttaaacctagaagagtcacagtgacacttcctgtgtcagctttcctagattcagggactctggaagctcaaaagcacccaaggcccawcaccttggacttacaaataaggaagcccagagaggtgacttgctcaagatcacttagcgtgtggcagcactgagactacaatttctgattcataacccgg

SEQ ID NO: 61013 - DNA, 201 bp, Homo sapiens
ttttaactgtttggctctttcccattttctgtctggtttcccatttgtcaatttaatgataatatattgtccctctctaggatatttgcagcccagcctcygataaaaacaatagcagccaccatttacttatccttactatgtgtacttttagactgccttttatctctaatcctcagaacaatgctgaaaggaagggtt

SEQ ID NO: 61014 - DNA, 201 bp, Homo sapiens
aatttctgattcataacccggtggggatttttttaatcctatgtaatctcatttgagaattagtttggtttcgtggttaagagcagactctgtggtcagartgcctcggttctggctctgacatttactagttatgtgggccttatctcttttggccccaacttctttaaaatggagattaagtgagctaatagtacatgt

SEQ ID NO: 61015 - DNA, 201 bp, Homo sapiens
aaacttccttaaacaatgtgttattagccgggtgcagtggctcacacctgtaatcccagcagtttgggaggccaaggtagacagatcacctgaggtcacargttcgagaccagcctggccaacatggtgaaaccccatctctactaaaaatacaaaaattagctgggagtggtggcgcacacctgtagacccaactactgc

SEQ ID NO: 61016 - DNA, 201 bp, Homo sapiens
tggagcatccttagcatttcacaccactcagccaacttctgtcaacatttacttccccctggtaactagcatgggaaatgcaatgaaagcccgatgagctsccgcagcagaaatgaacttggaagtgacctctcacttattcctctctcacatgcctgcatcattcagcacttgagcctcaagagcttgcctctttttgtc

SEQ ID NO: 61017 - DNA, 201 bp, Homo sapiens
gttttgttcaggtttcatatatctttactgatctatctacttgtttaaattatcgagggagatgttttgagatctctgactataattgtgaaattttctaytttttctcgcagttttatcagtttctgcttcttatattttcaatctctttttattgggtacatcagcatttaggactgttatgttctcttgaggagctga

SEQ ID NO: 61018 - DNA, 201 bp, Homo sapiens
cttccctttcagaatgatatcccaggacctgggttctacaatgttattcaccagtcaccggtgtccaacagtgtctcattgtccaagaaaggaacttgcaygtttccctcaatggtgagaaccacttctcttgagtaaagcattaactggtcagtaatttccttcattcattgcataattatatattggacatctggtcct

SEQ ID NO: 61019 - DNA, 201 bp, Homo sapiens
cctgacattggaattgatttttttttttaaccacacaaagggaccatttaagacacactaaatgtagctacatcttattggaattcgaatttggcagaatyggatactcaaggaacagaccagctttggagttaactccccattaccgaagaagctgagtttgtacatggcctcagtaggtccacagaacagccatgcctc

SEQ ID NO: 61020 - DNA, 201 bp, Homo sapiens
ctagcactttgggaggctgaggtggggggattgcttgagctcacaagttcaacaccagcctgggtaaaataatgaggcctcatttctacaaaaaaaaaaaagctgggcacagtggctcacgcctataatcccagcactttgggaggccgaggcaggcggatcacgaggtcaggagatcgagaccatcctggctaacatggt

SEQ ID NO: 61021 - DNA, 201 bp, Homo sapiens
ctcagctgtggattcttgacgtgacctcaagcacgtcacccttctgtgtcccagttgcctcatgaaagtggagactccctggaggcactgggcaaattaaygttgcaatgagtgaaatgctctttgaaacagcaaagcattataaacatgctaaatattatgattgttaccacctgagtcacaaacaatacttcctgcaac

SEQ ID NO: 61022 - DNA, 201 bp, Homo sapiens
ttattcaccagtcaccggtgtccaacagtgtctcattgtccaagaaaggaacttgcatgtttccctcaatggtgagaaccacttctcttgagtaaagcatkaactggtcagtaatttccttcattcattgcataattatatattggacatctggtcctttctctccaaaggcctatggttctaattaggagagtaactgcc

SEQ ID NO: 61023 - DNA, 201 bp, Homo sapiens
gcccaccctgcccagcgtccccaggacattcctcaggaggagaccgatcatgagtgtggcagctgacaacttggggggtggctctaccactctggcctggyatcctagccggactgctgccattgcctttgtcttgagctggagacattgctccctggagacttcaccccagccccacagactccagtggcttcctgagca

SEQ ID NO: 61024 - DNA, 201 bp, Homo sapiens
tttgcgggtgtagcattacacacttaaaaaaaaacactttccggctgggcgcagtggctcacgcctgtaatcccagcactttgggaggccgaggcgggcgkatcacgaggtcaggagatcgaggccatcctggttaacatggtgaaaccctgtctctactaaaaatacaaaaaaattagctgggcgtggtggtaggcacct

SEQ ID NO: 61025 - DNA, 201 bp, Homo sapiens
aaatagctattacccttataatgatagctgtggttattgtatatcctatagacctactaggctatattatacaatacagctgttatttggcatggcagctmaagcccccagcccaaatttggaagcttcttcaaggaaaatggtgaaataacataagagtggaggatgctcaatttttaactgctttatctggagaaatat

SEQ ID NO: 61026 - DNA, 201 bp, Homo sapiens
atctctgcgttttacctcattcccgtgtgaactggatgagaatttcatatcccccaccccaccgcctctttcagtaactttcacctttagcacctcctccrcttctgcatcccaagacttagagggaattaaaagtagctctcatcagagaaagatcagaatgaccagtaggaatgtgattatgggtgaggctgaccaaaa

SEQ ID NO: 61027 - DNA, 201 bp, Homo sapiens
aggaagtggaggctcagagagttgaaatgacttgcccagtgtcacacagccagtaaatggcagacacaagcccagaggggtctcactaacgagcccacgtyctccatcattccattgtcccttctggaacctccaagattcaggaatacacaagagctttcctgcaagtgtttcccctgccggccttggggaagggtgttg

SEQ ID NO: 61028 - DNA, 201 bp, Homo sapiens
acgtgacctcaagcacgtcacccttctgtgtcccagttgcctcatgaaagtggagactccctggaggcactgggcaaattaacgttgcaatgagtgaaatrctctttgaaacagcaaagcattataaacatgctaaatattatgattgttaccacctgagtcacaaacaatacttcctgcaacacctaggttttctctccg

SEQ ID NO: 61029 - DNA, 201 bp, Homo sapiens
atacaggtaggacataggtaccatgtgctctagatgggcacaatttaaaaatatatgttaataccattacatagtaaatctaccctcccaaatgggaagcyagccagtggttaatttgtgatgaaatcgtacaaagttaatattgttcacttattaacttgatatgacactagaccagggatgtttaaatgaaagaggttc

SEQ ID NO: 61030 - DNA, 201 bp, Homo sapiens
tcctgacatatgcttattttagtacataagagcaaatttggggggaatagtaagtcctgggttatatccacagggccatccttacaggcataccaaatagrtggctttaggccctactgtttcaagtgtgacgattgggaagaaactgagaagaaaggatgagagaagaaggaggaagtctgttaaaaaataaaaaactaa

SEQ ID NO: 61031 - DNA, 201 bp, Homo sapiens
gattgttaccacctgagtcacaaacaatacttcctgcaacacctaggttttctctccgagaacttctttgctaaataatggcactgcccattccttcttgrtgccaacaaagagactgaatcagaggacacgattggttgtctacaaggctttgcgtgcggtaactttccaaatgaaaagcctgactatctggaggagaag

SEQ ID NO: 61032 - DNA, 201 bp, Homo sapiens
agacatgcatgtatacatcgcagcctagacaaaggaacttttaacttcagtttctatagatgatccctttctgctttttaaccccatgtctgctcaaaacrgaaacgaaaacttacacctgtcttgcacagtgccctgaaaagtgagagccagccccaggctgggatttccctaacctctttggattttaacggcctaatg

SEQ ID NO: 61033 - DNA, 201 bp, Homo sapiens
agatgtattaacttgtacaactcaataaataacccaattaaatccaattgtttttgggttttgtggttttttgtttttttgtttttttttgttttttttttgagataggctgttgctctgttgtccattctggagtgcagtggtgctgtcatggctcagtgcagccttgatctcctgggcttaagcagttctcccacctca

SEQ ID NO: 61034 - DNA, 201 bp, Homo sapiens
ggcaggagtggctctagaaaagttagtaggtgctggagagaagttcataaatgccggcatttggccagattggaggccacaggcctggcaagtaaaccaasgggtgtgtagtgttggtgagtgagtgttactgtagccacattctgagactaattctattacgatactttataaaacattgcctctactgggacttttttg

SEQ ID NO: 61035 - DNA, 201 bp, Homo sapiens
ttgggaagaagttttttcattttcaaaatgtaagttgtaggtgttctaaaccaaaaaagagtctatgattgaatgggcttgctgttatcccagagccatgycgctcaaccctttcccctttagaatgggctctctgatccatgtcatgtagtggaggctgactgcttgggtaggaatgctggtcctccgcctgaattagct

SEQ ID NO: 61036 - DNA, 201 bp, Homo sapiens
tcattttcaaaatgtaagttgtaggtgttctaaaccaaaaaagagtctatgattgaatgggcttgctgttatcccagagccatgtcgctcaaccctttccyctttagaatgggctctctgatccatgtcatgtagtggaggctgactgcttgggtaggaatgctggtcctccgcctgaattagctggggaagttcagcttc

SEQ ID NO: 61037 - DNA, 201 bp, Homo sapiens
gaaagaagaaggcgctgggtgcggtggctcactcctgtaatcccagcaatttgggaggccaaggtgggcagattacttgaggtcaggagttcgagaccagyctgaccaacatggtgaaaccctgtctctactaaaaatacaaaaaattagccaggtgtggtgggagtgcctgtaatcccagctactggggaggctgaggca

SEQ ID NO: 61038 - DNA, 201 bp, Homo sapiens
aagagtctatgattgaatgggcttgctgttatcccagagccatgtcgctcaaccctttcccctttagaatgggctctctgatccatgtcatgtagtggagrctgactgcttgggtaggaatgctggtcctccgcctgaattagctggggaagttcagcttcctcatctgtaaagtagagataatcataagatccactgctc

SEQ ID NO: 61039 - DNA, 201 bp, Homo sapiens
caagccccctggagctttgtttgaagcaaactcgttgcttaggcagttcagatcatttaaccttagaaacaagatgtgagattttactcagaagaaaagcytaggctgagaagagcatctaaagcttcctatcacataaattacccaacagctgatgagtcaagggtaagtggcctggaacaggattgggtggaaatgcat

SEQ ID NO: 61040 - DNA, 201 bp, Homo sapiens
ctgcatgtagccacttcttattagaattcgagtttggcagagttggatactcaaggaacagatcagcgttggagttaacttcccattactgaagaggctgrggttgagctggggcttgaacccaggttaggctctgaacaacttaggctctggacaagaacactcccgcttctggtgctacacccccccaaatgctagtgg

SEQ ID NO: 61041 - DNA, 201 bp, Homo sapiens
ttactgaagaggctggggttgagctggggcttgaacccaggttaggctctgaacaacttaggctctggacaagaacactcccgcttctggtgctacacccmcccaaatgctagtgggggtccataaaccagacgctgaggaccgtcaccaccaagcacagagtgaagtaggggggccctaatgccttccttttggctcacc

SEQ ID NO: 61042 - DNA, 201 bp, Homo sapiens
ataatattgataattaataattatttttctgactacaaaaatcctgcccaccttctatgatggattcaagcttttttttgagacggagtcttgctctgttkcccaggctggagagcagtggtgcaatctgcaggctccacctcctgggttcacaccattctcctgcctcagcctcccaagttgctgggactacaggcaccc

SEQ ID NO: 61043 - DNA, 201 bp, Homo sapiens
ccagcatgttccagttgccaagctttatgaaagctctcaagtttgaaactcctgcaccaaactattacaatgtaagaactctgcctatgcttgctaaatayagatcgaattaatggtttactaaaataaaaggaagaggggatcttggggacatcgtattttaatgcagttgtcaagccagttagcatttgttgactaccc

SEQ ID NO: 61044 - DNA, 201 bp, Homo sapiens
cttcagatccacaatattatgtgacaatgctgattcctttggttgtctccttacagtgcgcccgattggacaccatcgtttctaaataccctgcagcgaaygcatacactatcccatcggattttatttccaagagagactttagtaattcgtgttccagcatgttccagttgccaagctttatgaaagctctcaagtttg

SEQ ID NO: 61045 - DNA, 201 bp, Homo sapiens
tcaccatctttttgacatctgtccttcagatccacaatattatgtgacaatgctgattcctttggttgtctccttacagtgcgcccgattggacaccatcrtttctaaataccctgcagcgaatgcatacactatcccatcggattttatttccaagagagactttagtaattcgtgttccagcatgttccagttgccaag

SEQ ID NO: 61046 - DNA, 201 bp, Homo sapiens
cgagtacaggtctgaacttgcgttttccaagggaagatcctcaaagcccgaggtcagtttatcattgttacctgccagagtttcgccttttataaaatgcrtttagaccttgtgctggtcaccatctttttgacatctgtccttcagatccacaatattatgtgacaatgctgattcctttggttgtctccttacagtgcg

SEQ ID NO: 61047 - DNA, 201 bp, Homo sapiens
gatgaataatttgagttagtttacagaagcgagtacaggtctgaacttgcgttttccaagggaagatcctcaaagcccgaggtcagtttatcattgttacctgccagagtttcgccttttataaaatgcgtttagaccttgtgctggtcaccatctttttgacatctgtccttcagatccacaatattatgtgacaatgct

SEQ ID NO: 61048 - DNA, 201 bp, Homo sapiens
tttaggttcttctagggaaaataaactttcatatcagaaaataggtgttttaacagtcgtgccctgctgtgccaattatgatcgctttgtattcactgacrcagaatggcatggatggttaagagatggactcaggaaggtttggtttagctctcatctgttgccactttctaactgtgcggccttcggcaagtcccttaa

SEQ ID NO: 61049 - DNA, 201 bp, Homo sapiens
agagatggactcaggaaggtttggtttagctctcatctgttgccactttctaactgtgcggccttcggcaagtcccttaacctttccagggcttagtttaytgatctgtaaaatggtgatgtatgttcacctcatcgtgttaatgcaaatattaaatgagataatgtatgcttcatgcccaggacagcaccagtcacacaa

SEQ ID NO: 61050 - DNA, 201 bp, Homo sapiens
tttttgccaagtcccaaacagaagatgaataatttgagttagtttacagaagcgagtacaggtctgaacttgcgttttccaagggaagatcctcaaagccygaggtcagtttatcattgttacctgccagagtttcgccttttataaaatgcgtttagaccttgtgctggtcaccatctttttgacatctgtccttcagat

SEQ ID NO: 61051 - DNA, 201 bp, Homo sapiens
gggacttgcacagttacccagcttgaaggcatcatttgcacttcagtgggcaccagtggatggctggggtggaaagctggggaatgatcaaagtcacctcrttccagccctgacaggcttccctctgtggatcctgttgctcctctgtgccaggctggtgatacagcttagattccagtggggaattcagaaaagaacagg

SEQ ID NO: 61052 - DNA, 201 bp, Homo sapiens
ggtgtgatctgatgctttttttttagatggagtcttgctctgtcgcccaggctggagtgcagtggcacgatcttggctcactgcaacctccgcctccccarttcaagtaattctcctgcctcagctgggattacaggcacatgccaccatgcccaactaatttttgtattttttttttttttagtagagatggggtttcac

SEQ ID NO: 61053 - DNA, 201 bp, Homo sapiens
gtttaggttttactgctgcatatccaacacaatcctccattccttttaaatctcaagcttcagtaatcccagaatcagaaaaaaaaggattcaatagtcargccaagagatttcctcataagaaggtaatgacgttgtctcaggggttctttcgttttagtctggattttagccttgcgggacaggcacgttctgtctggc

SEQ ID NO: 61054 - DNA, 201 bp, Homo sapiens
attatgatgcctgacattggaattgatttttttttttaaccacacaaagggaccatttaagacacactaaatgtagctacatcttattggaattcgaatttggcagaatcggatactcaaggaacagaccagctttggagttaactccccattaccgaagaagctgagtttgtacatggcctcagtaggtccacagaacag

SEQ ID NO: 61055 - DNA, 201 bp, Homo sapiens
acatcctctggaagcattgcccgaatgacttttccatgccgtatgtggtgctaggcacctggcacacagagacaggcagctcctgccgctctgatcacccrtgccaaggtgggcttctgcgaggggtttcctgggcacgtgcacgtgccggcatctgcctgctcagcttccagtaaactcaggtatacctggactaccatg

SEQ ID NO: 61056 - DNA, 201 bp, Homo sapiens
aatgcccagcacaggtcctgggatgcagtaagcatccaatcaatgtttatgacatcaaaggaataactttccagtagtatgcagctgttaatctagaaagkacctcttcccaagatagaattgtgtccttctgccaatagatacatttaggcgcatgttttttgttcattattgtcttaatatgaccctgaaaataataca

SEQ ID NO: 61057 - DNA, 201 bp, Homo sapiens
cttcctggcctccccttttatgatctggcatacctgctctgggcagccaagtggagaagtggcttctcacctcagaaatgtgcacattcgtataccccagstgccattaggggccactggggaggggcaggagatacagggcatgaccatacatcctgttccttcaacactgagctgccacgttcattttctcctatgcta

SEQ ID NO: 61058 - DNA, 201 bp, Homo sapiens
gcagtcttgcaggtctgccgtcataggttcatccacttagccctacttttcagatgaggaagtggaggctcagagagttgaaatgacttgcccagtgtcayacagccagtaaatggcagacacaagcccagaggggtctcactaacgagcccacgtcctccatcattccattgtcccttctggaacctccaagattcagga

SEQ ID NO: 61059 - DNA, 201 bp, Homo sapiens
gaaggtttgcttctgcaatcatgcctcttgcagaggggtgtggataaaattgtagtgcatgtgagatttcagcaaatccagattaaagttgaaaagatcartctgaagctgaataacaaaaccagcgctaattaggaggctcagccccagttcatgctctcctgccttgcatcatccatgggcaaaaccccaccttgtcta

SEQ ID NO: 61060 - DNA, 201 bp, Homo sapiens
atgctgctgacatctgcttctttaaaaatttaagcatatactgggaacatttttttttttttttttgagagggagtctcgctctgttgcccaggctggagwgcaacggtgcaatctcggctcactgcaaccttcgcctcctgggttcaagtgattctcctgcctcagcctccagaacagctgagaatacaggtgcacacca

SEQ ID NO: 61061 - DNA, 201 bp, Homo sapiens
ttctttaaaaatttaagcatatactgggaacatttttttttttttttttgagagggagtctcgctctgttgcccaggctggagagcaacggtgcaatctcrgctcactgcaaccttcgcctcctgggttcaagtgattctcctgcctcagcctccagaacagctgagaatacaggtgcacaccaccacacctggctaattt

SEQ ID NO: 61062 - DNA, 201 bp, Homo sapiens
ctgcactccagcctgggtgacagagtgagaccctgtctcaaaaaacaaaaaaagtaaataaaatatatgtttggcattggcattgcagctggtgactcaawattaacacagatttttaaaagtaaatacagggatttttgttaccctgtttaatatcctacacattttatattactctcacctaagaggctcaaatactca

SEQ ID NO: 61063 - DNA, 201 bp, Homo sapiens
ccgtgaccagtcctcttccagacagcttgctgctgtgcaggtcttggctgtgtctagaaactgtgccttccccactagactgccttagtgacatcttcccrttttatctttcccaaaggaaaaaccccatcctgaacttctctgctcagccttcgcctctgcctccgaagccacctttcccaggtcctggtcagtatgaga

SEQ ID NO: 61064 - DNA, 201 bp, Homo sapiens
taagtatagctaatatgtcagaaatgaagataaaatgaggccataagtaatatgcacttactctcaaaagatccaaaaaaaagagacaagggccaatatamcaagtaggaaattgataggtttaagcccagccatatcaagtgctacattaaatgtaaaagttctaaacactccaatcaaaaggcagagtttgattagatt

SEQ ID NO: 61065 - DNA, 201 bp, Homo sapiens
tttcatctctagtgcatcattcgtgtccaataccagccggtggacagcggcgccgcctcagccaggcctgcctggcccaggtcagaggattgttttaaatrattgtaaaaaccaaatcttctggaactgtttgtcattcttgggtcatcaaatgccattgatttataggttgtttcccaaataggttacagggatgagggt

SEQ ID NO: 61066 - DNA, 201 bp, Homo sapiens
aagttcaggtatgaggggaggaatgccctgtgtgatccatcccaaatttattaaagttctctgtattgggtttggaggcctcagtcctagctaatataaartataactttattacctggttttttgctttttgttccttttgttcatgaaactcctctggtaatatcaatatgttccctttgttcatgaaactctgttggt

SEQ ID NO: 61067 - DNA, 201 bp, Homo sapiens
ctaactgggtttacttctgaaaccagctcctccttagacttcacctgtgaccctaggcaaatcacttgacttctttagacacaggatttgcgggagggcargctacctctgtctgaggctgacagtgtgagttttctagtagatagcgcatgaaatgggaatagtattgcaagtgatacaaacatatataatatatataat

SEQ ID NO: 61068 - DNA, 201 bp, Homo sapiens
ttttacttgagatatgattcacataccacacatttcacctgcttaaagtgtacaattcagtggtttctttggtatattcagagttttgtgaccatcaccaygatctactttgagaacattgttgtcaccccaaaaagaaaccctgtacctattagccatcactccagattctctctatgcccccagctttaggcaatcatt

SEQ ID NO: 61069 - DNA, 201 bp, Homo sapiens
actttctttctttctcccctttccctgccaaaaacaaaaaaccaacatacaaccttaccttgtagtatctctggccatatctcttaagggggccggcagtyggtatctttttcattataggcaagaagagaggcggaggcgatccttccaggattacactgggcagaagatcacccttgaggctgtcttgaacactacctg

SEQ ID NO: 61070 - DNA, 201 bp, Homo sapiens
ccctcacttcagatgccagccccaatattgaatcctcagattacctacacttttgtctcacttggctacaatttttgggattcccagcacttccccccaargttggtaatttgctagagtgactcacagaactcagaaaaatgctatagttactattagtttattttaaaggataaaaatgagcagtcagatgaagaagta

SEQ ID NO: 61071 - DNA, 201 bp, Homo sapiens
cgagtacaaagcctctgtccccatggagttggggtgtgtcaccctcttggcacatggatgtgttcaccaactctccaaactccattgcttaggggtttatrtggaggatctgttatatagacatggttgattaaattattggccttcagtgatagagctcagtctccagcccctctccccttcccggaagtcagagggtag

SEQ ID NO: 61072 - DNA, 201 bp, Homo sapiens
ggagtgcagtggcacaatctcggcttactgcaagctccacctcctgggttcacgccattctcctgtctcagcctcccaagtagctgggactacaggcaccygccaccatgcctggctaattttttgtatttttagtagagtcagggtttcaccgtgttagccaggatggtctcgatctcctgacctcatgatctgcctgcc

SEQ ID NO: 61073 - DNA, 201 bp, Homo sapiens
tcctggttgtgttagtgtactatagttttccaaaatgtcaccattggagaaaactggataaagtgtacataaaacctctgtattctttctttctttttttyttttgagacggagtcttgctctgttgcccaggctggagtgcagtggcacaatctcggcttactgcaagctccacctcctgggttcacgccattctcctgt

SEQ ID NO: 61074 - DNA, 201 bp, Homo sapiens
agcatcctggttgtgttagtgtactatagttttccaaaatgtcaccattggagaaaactggataaagtgtacataaaacctctgtattctttctttctttyttttttttgagacggagtcttgctctgttgcccaggctggagtgcagtggcacaatctcggcttactgcaagctccacctcctgggttcacgccattctc

SEQ ID NO: 61075 - DNA, 201 bp, Homo sapiens
atacaattccatcacactgctacctgactgataacagttgtaaaacatcattgattatgagaagcactccaatttcagagagattaaagtgagaggaaaaraaagtgcatcttagaatcaatgaaacacaataaatgtcagtttactgacatgagccaggagtggtggcatgcacctgtaattccagctacttgggaggct

SEQ ID NO: 61076 - DNA, 201 bp, Homo sapiens
agatcctacaggtgggaaatggcagagctaggattagaagccacatctttcactccaaagcatgttcactttctatacctatactgttattttttttttttaaagcttttttagagatgggtcttgctatgttatccaggctggattcaactcctggcctcaggccacgctccagcctcagcctctggagtagctaggact

SEQ ID NO: 61077 - DNA, 201 bp, Homo sapiens
tcttagaatcaatgaaacacaataaatgtcagtttactgacatgagccaggagtggtggcatgcacctgtaattccagctacttgggaggctgaagtagtragatcacttgaggccaagagttcggggccaggctgggcaacatagcaagaccccactgatggcgatggaggcctgtctagagtggctgctgcaaagatgc

SEQ ID NO: 61078 - DNA, 201 bp, Homo sapiens
aggatttgtgcacatgctgttttctttttagtctgtgctgctataacaaaatacctgagattgggtaatttataaagaacagaaatttatttctcacagtwctggaggctgggaaatctaagatcaagttgtcagcagatttggtgtctagtgaagactactctgtttccaagatggcaccttcctgctgcatcctctgga

SEQ ID NO: 61079 - DNA, 201 bp, Homo sapiens
ctttactgggatccctgcttcatcgtagctcctctccagtctgttcttcacattgtagctagcataagatttttgtttttgtttttgttttttaattcttytttaaaaattgagctggggtctcactatgttgcccaggctggtctcaaactcctgggcttaagtgatactcccacttcagcctcccagagtcctggggtt

SEQ ID NO: 61080 - DNA, 201 bp, Homo sapiens
ctccttcttcttctatatcctttagaccagaatgtgttcccccctctttctctacctgtgcttggcatatagtgaggctcagttcactcatttaaaaaaaactgagtacttgtagtataccagaccccaggaacacaaaatcaaatgagaaatggtccttggtttcatgtttgaatgaatggatccagacgttgctcatcc

SEQ ID NO: 61081 - DNA, 201 bp, Homo sapiens
ctggctgggtttgcacaccttggggtggtgctgccatgccagcttcctaccatcttggccccctctggactttgggtgccagtgagcacaggagggaggcyaaaggggtgctgagggtggctcagcatgggcctgcaggtgcccctgggcacagaacaactgggcgtcatggacaacatgattgatggtgacaagaggcag

SEQ ID NO: 61082 - DNA, 201 bp, Homo sapiens
gcacaccttggggtggtgctgccatgccagcttcctaccatcttggccccctctggactttgggtgccagtgagcacaggagggaggccaaaggggtgctragggtggctcagcatgggcctgcaggtgcccctgggcacagaacaactgggcgtcatggacaacatgattgatggtgacaagaggcagacaggctcctgg

SEQ ID NO: 61083 - DNA, 201 bp, Homo sapiens
agcaattgacttccttacagtgtatcttagtttctctgcccataaagagggaagattattaagtctcagcctgaaaggactgagttagaaaataactctgrtctgatcaggtcttaacatctttggctcaggtaggtagattctaatttgagctggtttcccagatgtcatgttctcagaatacttcagccaccactgagt

SEQ ID NO: 61084 - DNA, 201 bp, Homo sapiens
ggtcaactgaggtttgaaaatattaaagggaaaattctagaaacaattcataagctttaagttgcagttgcagtgtgatgaaatcttgtgctgtcttgccrcattccatctgggacttgaatcatccctttgtccatccacactgtgtacgctacccacccattagtcccttagtagccttctcagtgatcagatcgactg

SEQ ID NO: 61085 - DNA, 201 bp, Homo sapiens
agtcccttagtagccttctcagtgatcagatcgactgctgttgcagtgcttgtgttccaagtaacccttattttacttaatggccccaaagtgtaatactratgctggcaattttgatatgccagagagaagccataaagggcttcctttaagtcaaaaggtaaaagttctcaacttaataagggaaaaacagggacccct

SEQ ID NO: 61086 - DNA, 201 bp, Homo sapiens
ttgctctctctttaggatttgtgcacatgctgttttctttttagtctgtgctgctataacaaaatacctgagattgggtaatttataaagaacagaaattyatttctcacagttctggaggctgggaaatctaagatcaagttgtcagcagatttggtgtctagtgaagactactctgtttccaagatggcaccttcctgc

SEQ ID NO: 61087 - DNA, 201 bp, Homo sapiens
ttctcaacttaataagggaaaaacagggacccctagaggggggactgaggaagggggagaatggttgaaaaatttaactttgagtactatgctgagtactwctgtaacgggatgattaatatcccaaacctcagcatcatgcagtgtacacagataacaaacttgaacatatgtacccccggaatctaaaataaaggttaa

SEQ ID NO: 61088 - DNA, 201 bp, Homo sapiens
atgatttgcaaagatttttatgtaacatacttgaaatgacaaagttatttaaatggagaacaaattatttaatggttcacaaggattaagaaggggaaggmagtagcaatatgaaggatccttgtggtgagggacctgttctgtatcttaactgtggcagtgtatacatgaatctacacatgtggtaaaattacgtggaac

SEQ ID NO: 61089 - DNA, 201 bp, Homo sapiens
aattagagtggcgtgtaataaaaatgagtgttgttgcacttagtccatggaattgtggaacggttaggctgtttggatgagtcagggcatagtacaatacytgaggtatagtgggtgggtgttcagtaaatctcactgaatgaatgaatgaattatagcctcagttctaccattaactggcttcttggcaagtctcctagt

SEQ ID NO: 61090 - DNA, 201 bp, Homo sapiens
cctcagcctcccaaagtgctgggattacaagcgtaagccaccatgcccggccgagatggatttttttatgaggaagtgatagtacactaaaccttcatggmcaaaaaaagtatctcaaaatagttgtctcccttttgttctgattccatgtggaagcaatttctgatcactaatgatcactaatgtaattgttcaggtatt

SEQ ID NO: 61091 - DNA, 201 bp, Homo sapiens
ttattgggcatatctttctgacgtcatgagagtgcgataccaggattggtggacggagctggcgaccgccctaggcgcgctgggtcttgtgggtggaaacrcgctggctgactggggtcggcgtttagttcagcgcagcgactcggggacctggagctgacgcctagtacgtatgaggaagaacggggtgggtggctgcct

SEQ ID NO: 61092 - DNA, 201 bp, Homo sapiens
caaggaaaggattttggacagacaggaaaaggatgtttgctataagtgttttattaaatgttattaaaatattatttgatttatttttgagacaaagtctygctctgtcacctaggctggagtgcagtggtgccatcacagcttactgtagccttgacttcctgggctcaagccatcctcccacctcagcctcctgagtat

SEQ ID NO: 61093 - DNA, 201 bp, Homo sapiens
tcagcctcctaagtagctagagctacaggcacgtgccaccatgcctggccaggttttttttttttgtattttttgtagagactgggttttggcatgtttcycaggctggtcttgaactcctgagctcaggcaatctgcccgcctcagccttccaaagttctgggattacaggcatgagccactgtgcccggccactttgag

SEQ ID NO: 61094 - DNA, 201 bp, Homo sapiens
ggttttgtagtgaatccctggataatcttctgatgaacttgtggtctgtgctttactggcctctttcattaatcatatgccatcgtaggtctttctgaatyggtgttatgttatgaagaagtaagtgccttggggaccaagctgcccactgattatagtaaactttagatatgtttgattcagaatataattttcttttga

SEQ ID NO: 61095 - DNA, 201 bp, Homo sapiens
ttggcatgtttctcaggctggtcttgaactcctgagctcaggcaatctgcccgcctcagccttccaaagttctgggattacaggcatgagccactgtgccyggccactttgagcattattttaagaatgtttgttggttgattgggtataaaaagcagtctcaatttgcagttttaagtttcacgcttttcagtaaaaatt

SEQ ID NO: 61096 - DNA, 201 bp, Homo sapiens
ggaccctgttactcacttgagggtatgagggctgtgggtgtgggccgaccacaggagaaataagagcatacactgagtcctgttctaccagagacagcacrggagataggcatgaaagaactattattcaacaatatttaagtgcttaatatgtgctaggtttgggagatataagagcgaaccagacaaaaatgatcccag

SEQ ID NO: 61097 - DNA, 201 bp, Homo sapiens
gggtttcaccatgttggccaggctggtcttgaactcctggcctcaagtaatccgcctgccttggcctcccaaagtgctgggattacaggcgtgagccatcrcacccagcccatgaatttttttaaaaaagcctttggacagagaggcttctcgtcagattaacctccccaggaatcccattgtctggccttgccctgttat

SEQ ID NO: 61098 - DNA, 201 bp, Homo sapiens
aaaactggaggcagggagaccagtgagggagttattactctagatgaaacatgatgggagcctaaactagaatgatggcaatgaggacaaaaagagagacrtgggtgactgacacatttgttgaattgagtgttaagtgggaagtatgatttggtttgtagtctggtagaagccacagagtattggaattgattgtcatgg

SEQ ID NO: 61099 - DNA, 201 bp, Homo sapiens
tgagggagttattactctagatgaaacatgatgggagcctaaactagaatgatggcaatgaggacaaaaagagagacgtgggtgactgacacatttgttgmattgagtgttaagtgggaagtatgatttggtttgtagtctggtagaagccacagagtattggaattgattgtcatgggggttgcttaagctgcaactcac

SEQ ID NO: 61100 - DNA, 201 bp, Homo sapiens
ctagaatgatggcaatgaggacaaaaagagagacgtgggtgactgacacatttgttgaattgagtgttaagtgggaagtatgatttggtttgtagtctggkagaagccacagagtattggaattgattgtcatgggggttgcttaagctgcaactcacagccacttgaaactcatctctacaaatagataggtgaaagcaa

SEQ ID NO: 61101 - DNA, 201 bp, Homo sapiens
ttgtttgtttgttttggagacagggtcttgctctgtcacccaggctggagtacagtggtgcagtccgctcactgcaacctcaatcttgcaggcttaagtgwtcctcctgcctcagcctctcgagttgctgggactacaaacacaagccaccatgcctggctattttttttttttttttaagtaaaaggaatctgtactgtt

SEQ ID NO: 61102 - DNA, 201 bp, Homo sapiens
gaaaagcctcatgcagcagtacacacctgtagtcccagctacttgggaggataaggtgggaggattgctcgaggccagaagtttaaggctgcggtgcgctrtgattatgcctgtgaatagccactgcattccactctgaacaacatagtgagacccaatctctaaaaagaaattttttttgttaaaaaaaaaagaaaaatg

SEQ ID NO: 61103 - DNA, 201 bp, Homo sapiens
ttgatacattttatcaaattgccttccagaaaatacttatctgtccctagcagtgtatcagagcacctgtctcactgaattccatctcctatatctactayttatggcagagcaattcataaaacagatattattgtggtccagaaagaaacagtgcatttgtagcatgctacacagacaataaaaactattctgtaggtt

SEQ ID NO: 61104 - DNA, 201 bp, Homo sapiens
gctgggactacaaacacaagccaccatgcctggctattttttttttttttttaagtaaaaggaatctgtactgttagaaattagaattgtgattacccttkggggaggcaggtaactagaagggagcatgagatgggcttctgagatgctggcaatgttctgtttgtttgtttgtttgtttgttttgagacagagtctcgc

SEQ ID NO: 61105 - DNA, 201 bp, Homo sapiens
gagcaaaagcactgagccacatggataagagaaaatagacttctttggccagagcatattgtgtgagtaaagatgaggctggaaaagtagtttagagacaractgtgaaagaccttgaatgccaaggtaaagaatttggagctgattttctagaaagcctttgaaggtcttttaaacctatgagtgacctggtaagggttg

SEQ ID NO: 61106 - DNA, 201 bp, Homo sapiens
attgttaatttagggctatttcacatcattgcatttactgcctgtctcgttctgtcaaaaactttctttctttctcccctttccctgccaaaaacaaaaamccaacatacaaccttaccttgtagtatctctggccatatctcttaagggggccggcagtcggtatctttttcattataggcaagaagagaggcggaggcg

SEQ ID NO: 61107 - DNA, 201 bp, Homo sapiens
gtctttcagcctgatccctagttggagctataatgagagagattgccagcttctcattttcaggttgacctcaattgtcaccccttctccctagtcttccrtctaccctactgtgtgatttttctacaataactggtagcagatttgtgccctggttgaagttgtggggttttaagcccctatttatcattagcatagagg

SEQ ID NO: 61108 - DNA, 201 bp, Homo sapiens
gagcagtctttgattgtcaggaatatgttccaaaatagatcttaaaaaattaataagccccattgttaatggagggcagtaaaaacctgcatcctcatatsctttgccatttcgagaacagtaccagtgttccccacagccctgagaccagctgctagtctggctgtggttgagtgagcagtgtcatgttgaggtggtaga

SEQ ID NO: 61109 - DNA, 201 bp, Homo sapiens
acaaaattgtggtcatactagctatagtttatacctttttttcatttcacttatcaaaagcatttcctagtatccttaagtgttcaaaaacttgatttaaragcaacataatattctaccctatggctgtatgatgatatatttaattatttttgtattactggatattttttattacttccaacctaaatttttggccac

SEQ ID NO: 61110 - DNA, 201 bp, Homo sapiens
aatatttcctgagccagctagcccatttcaggagacttggggaaagattcacttgctgagaagagagactacttcctttttctataccttttctacttttyttctgcaggccactttgcaaaagattgtttcatgcaaccaggtgggactaaatactctctgatacctgatgaggaagaggaaaaggaagaggcaaagtca

SEQ ID NO: 61111 - DNA, 201 bp, Homo sapiens
taagttctttgcctattttgcataagcttgtttattttgttgttgttgttgatatgtaggaattttttatatgttctggatatcaatcccatcagatatayggtttgcaaatactttcttctaatctgtggattgtttttttactctgttgatagtgtcccttttttccctatcagatttagactttttaaaatagtggta

SEQ ID NO: 61112 - DNA, 201 bp, Homo sapiens
taccatatgattttctgctgtaccatatatagaagaacaagaaataggaatgtcattctttggctgcagtgttggctctgtcctgctgtccagagaacttsttctggtgcctatatagagaaaggttgccagtcctgagcccactcagggacacattctctgcctattcagatacagcagagagcgttgcccagtgttgcc

SEQ ID NO: 61113 - DNA, 201 bp, Homo sapiens
agctaaggccttttggtaataagccattaatgtctcaactttaataatcctgtaccccgttataactatttttatgtttccttttggtctatgtccatatraggcatagtttcacattatttcatagtgtatatattatttaattataaaaatatataaatttttatgattggaaataatgcatgctcatcatagaaaaat

SEQ ID NO: 61114 - DNA, 201 bp, Homo sapiens
agaaaccaggagccttgtgccttgagactcctggaaagactcaatagtgagaatatagcctcccaccccattaacttcgctcccatgggagatggcttccsctcatgcaacaggcaggtttgggagttagaggtcaaaagcagctgcctgaatgagttgttgtttccttatcactcctggtccctttgcaagtgaaccctg

SEQ ID NO: 61115 - DNA, 201 bp, Homo sapiens
ttacagtatgttgttatgttattattgttaatctatttctgtgcttaatttataaattaagcttcacagccaggcatggtggctcacacatgtaatttcarcactttgggaggcgaggtaggtggatcgcttgagctcaggagtttgagaccagcctgggtaacatggtgaaaccccatctccacagaaatacaaaaattt

SEQ ID NO: 61116 - DNA, 201 bp, Homo sapiens
taactctggtctgatcaggtcttaacatctttggctcaggtaggtagattctaatttgagctggtttcccagatgtcatgttctcagaatacttcagccamcactgagttgaagaccccttcctactattcaaacctaagctagattttctttcccctctcatagtattatccaatataactttctgtgatgatgaaaata

SEQ ID NO: 61117 - DNA, 201 bp, Homo sapiens
cactgagccgtcttcccccagtggggtgtggtggaggaggggacttgatccctcaggctcagtggtgtgaacagacgggggttggggaagccctagtcgaygtatgtggaccacttgggatatgcagtaatcctggtcagagatgtcagtgaggactgagatatgggtggaactgcagagaattggacagattctagaggt

SEQ ID NO: 61118 - DNA, 201 bp, Homo sapiens
tgtagaagatttgaaagtcactgtggagtgtgggagaatgaggttactagagaaatgtaggatgcaaggaaaaaaaaaatttttttccagcatatccagcrgtttagtgcatgcatggagaaaacctttctgggtatggcaaggacatcgcttgctcaagacacattctaacctctaatatgtcttctcttcctgaaaaat

SEQ ID NO: 61119 - DNA, 201 bp, Homo sapiens
gtttaaaaatcttttgaatggaccatcaagcgactataccataattgacctaattgttatcctttgttgtttctaaattttcctgtcttaaaaatacattraatattttgatgtaaatcacttttcctgaagcatatagtttttcctatgtataaagttattttcttaggacaggttcccagaagcaattaggggtcaaat

SEQ ID NO: 61120 - DNA, 201 bp, Homo sapiens
tgaaaagagagtggtaggagaggaagttagatcagaaggaacccagatcactggggccttataggtgattgggaggatttcatctttcacttgagtgagakggatgttattagaggttttgagcagaggaatgacatgatctgacttccttttaagagaattattctggctgctatgtagaaacttagatggtcagaaagc

SEQ ID NO: 61121 - DNA, 201 bp, Homo sapiens
agaggttatggagatgaggatgaactaacaaagaagacaggaaaggaacagccaaggaagtttgtagaaaagtaagagaatgtaaaatgtggtagaaatamcatgaatgtgttctaggtaagatggtctgtatccatcttgactgaccaagtaaataagacccaataattgaccactagatttggccacgtggaggttact

SEQ ID NO: 61122 - DNA, 201 bp, Homo sapiens
tgggataatactagaacaagggtttggatgtcctgaaaggattttctttcatttctgtttcaagtgaagctgtcaatttaatggatggtcattgtaaatcrggaatacttaccaaaatcaggacatcaagtcatcctctgaaagtgaaaggaagcagtgggggttgaggagagaagaaagtatttacctgtgaaaacacaa

SEQ ID NO: 61123 - DNA, 201 bp, Homo sapiens
gatgccattatttctatgtggtactccagtaaatagactttctgttttagggaagaagaatagtgttccctcaagtatattaggttcaacattaatttccwtcataactttcattagcaatagaggaaagagatgaattttaaccagtagaggacagttgcagccaaaaacaagtcaagatgaagggcttcccctttatgg

SEQ ID NO: 61124 - DNA, 201 bp, Homo sapiens
aattgaaacttaaaacagctacatgactagtgactatctattaggcagtgcaaccctatacaattataaagttcttttttttttcctactgtcttctgccrtccagcactaaactatgaaattttgagaacagatttttcaacattatactttcagagtttcttgcttatgatagaagctcaaatatatttagcagtggat

SEQ ID NO: 61125 - DNA, 201 bp, Homo sapiens
ggcctcccaaagtgctgggattatagatgtgagccaccgcacccagccaagagaattcttttgactgaattgagttataggaggaatatagataaatttgktggttctacagtcatttgttggtacaactctgttacagcatttatcctggtctgtcttgtattattattacttgtatgtgtctctctccactactagatc

SEQ ID NO: 61126 - DNA, 201 bp, Homo sapiens
tgttatatactcttttttttttttctttctgagacagagtctctgttgcccagggtggagttgcccagggtggagtgcagtggcatgatctcggctcgctrcaacctccacctcccatgttcaagtggttctcctgtctcagtctcccgagtagctgggattacaggtgcccaccacaatgcccagctaatttttgtattt

SEQ ID NO: 61127 - DNA, 201 bp, Homo sapiens
ataaagtatagtggttttgccgctttagccttggtcgactcactttacatttctgagttgcagtttttccatctgtaaaatgggaataataactcatgaaktttgactctacagactattattgtaagataaggatgcaaaaagcttgataaactaaagcactgtttaggtgtaaggcagtattattactctcctcacttc

SEQ ID NO: 61128 - DNA, 201 bp, Homo sapiens
gaaggatatgatgatgtgcaagacaaaggcatgcttacaagagttccacactctacaaagggaggaaaaaaatgtccctaaaaatgatttgaatcccatcyccatcattcatattttgcaatcttgagcgagtttacttagcttctcttgtgtcctcatttttaaaatggcaatgataattgcctgttttatgggatagtc

SEQ ID NO: 61129 - DNA, 201 bp, Homo sapiens
ctactccattggagatgccaaggaagaattgttatttcatcttctcttaaaactttgacttgtctcctgtagatgcttggccaggctgtcagaacatcctrggagttaatgagagaaaaatacatatagctcccactaagtgcctataatgtgtcaggcactatagttagtgcttatcttgtttaaacctcatagcatcct

SEQ ID NO: 61130 - DNA, 201 bp, Homo sapiens
tatgagtataatcttgtgaggtggctgtaaagttagagatgatgaatattcaagggtagcaagtacaggcttattatttgatggcagttatttcccctggyaccaggatctaatagaaaccagaatagcagtcaggagttctaaatcttttactcctattctttgaccttggatatgtgagtcactgtttctagatagact

SEQ ID NO: 61131 - DNA, 201 bp, Homo sapiens
tgcctgtctcgttctgtcaaaaactttctttctttctcccctttccctgccaaaaacaaaaaaccaacatacaaccttaccttgtagtatctctggccatrtctcttaagggggccggcagtcggtatctttttcattataggcaagaagagaggcggaggcgatccttccaggattacactgggcagaagatcacccttg

SEQ ID NO: 61132 - DNA, 201 bp, Homo sapiens
gtgaaaattgaatttggaactgagttaaatgtggaaagaaggagggtgtgagtcatccagttttgctgccagtcatggcagtaaatttctccagtcaatarctccctggtttggtggcttgctgcagtgatagccataactttcctggattgtggcaaaggtggtattattttgtgggttaggtgttgttcctggaagttc

SEQ ID NO: 61133 - DNA, 201 bp, Homo sapiens
agggtgtgagtcatccagttttgctgccagtcatggcagtaaatttctccagtcaatagctccctggtttggtggcttgctgcagtgatagccataacttycctggattgtggcaaaggtggtattattttgtgggttaggtgttgttcctggaagttctgccaaagtcttttattgcaatacatcccttactgcttaagt

SEQ ID NO: 61134 - DNA, 201 bp, Homo sapiens
ctgcagtgatagccataactttcctggattgtggcaaaggtggtattattttgtgggttaggtgttgttcctggaagttctgccaaagtcttttattgcartacatcccttactgcttaagtgggttctgttgtctgcaactgtccctgaccaggttagaggtactgccagagagttaaatataaagacagagttaaaggg

SEQ ID NO: 61135 - DNA, 201 bp, Homo sapiens
gctgggcatggtggtgtgtgcctgtaatcccagctactcgggaggctgaggcaggagaatcgcttgaacctgggaggaggttgcagtgagctaagatcgcrccattgcactctagcctgggtgacaagaacaaaactctgtctcaaaaaaaaaaaaagaaaaaaaagggtggtttagtggcaagtgtgtgtggcccttgga

SEQ ID NO: 61136 - DNA, 201 bp, Homo sapiens
agggattgaaagcaggtttataaagtaccttatatataaacatcaatcaatagcatactgaattgatgaattaacaatttaaatggggtaaaattaaatayttcactattttagtagacaatttccatgtgtgttacactgtgctaggcactggagatttggggaggaaggatatgatgatgtgcaagacaaaggcatgct

SEQ ID NO: 61137 - DNA, 201 bp, Homo sapiens
atattagctattataagactttgaagggatcttaggaataattgactgaaagtgtagtgtcgagtggtagaataagtgctgatcctggggtcttataccartgttgctaactgtgagcagcctttgtcaaatcacttggcttcattttcagtggcctaagagtaataggtttaattatttccataattcctttaagttttt

SEQ ID NO: 61138 - DNA, 201 bp, Homo sapiens
aaagcaagaagcatctatcttacatggtcactctagaatttggtgggagggaggaaagttggaccaccagtttgacatttgaaagtgtcccggccgggtgsggtggttcacacctgtaatcctaacactttgggaggccgaggcgagcagatcacttgaggtcaggagtttgagaccaacctggccaacatggtgaaacca

SEQ ID NO: 61139 - DNA, 201 bp, Homo sapiens
cctgaatgagttgttgtttccttatcactcctggtccctttgcaagtgaaccctgcagctcacccattcattcacccaacttccttcattcagcaggaggycctattaccctctccagctgccactgccagagctggattcctgtaaaggagtccaggctagagccacagagactgttgtggaggtgagttcggctgtagt

SEQ ID NO: 61140 - DNA, 201 bp, Homo sapiens
agtttgatgtatccttttcagtgttctctgtgtatactaaatatacacaagtgtgtgtaacatacacagtttatatcatgtgcatatatatataaatacamatgtatatgttatacgcactggaacctacaatacatattatgtcttggttcttttacttaacatgttttagctatttttttcttgttggcacttaaagat

SEQ ID NO: 61141 - DNA, 201 bp, Homo sapiens
tctcctctatagccacagtgtaattaccaacattatgaaattaacattgcattacttctttgatcctcaggccccacctcttgatgctcgagctctgactrcccattctgggctgctccagtgtgtgccttcatcaccttattcttccctatattgcagttctctttgtagatttcctcctcacccagcttagactctgac

SEQ ID NO: 61142 - DNA, 201 bp, Homo sapiens
ctcgatctcctgacctcatgatccacctgccttggcctcccagagtgctgggattacaggcatgagccaccgcgcccagccagtagatgttattcttatcyccagtttacatttgaagggaacaggcctcagtgagttcagatgacttgcccacggatgcagaatagtaaatggcagagccagaactcaggtccaggtcta

SEQ ID NO: 61143 - DNA, 201 bp, Homo sapiens
ctatcttaatgttatatactcttttttttttttctttctgagacagagtctctgttgcccagggtggagttgcccagggtggagtgcagtggcatgatctyggctcgctacaacctccacctcccatgttcaagtggttctcctgtctcagtctcccgagtagctgggattacaggtgcccaccacaatgcccagctaatt

SEQ ID NO: 61144 - DNA, 201 bp, Homo sapiens
gaagttgagagagcagaagcttggttcatcttctggctctcagtcttcccccaccccaactcccaactttgcttttgaactacaaccttttttttttttttgagacggagtttccatcttgttgcccaggctggagtgcaatggcacaatcttggctgaccccaacctctgcctccgggttcaagcaattctcctgcctca

SEQ ID NO: 61145 - DNA, 201 bp, Homo sapiens
ttgattaagggagatagggagtcctagaatgaggatgtggggagcaggtgactttcattttagataggatggtaaggccaggcctttctttttttttttttgagacggagtttcactcttgttgcccaggctggagtgcaatggtgcgatctcagctcactgcaacctctgcctcctgggttcaagcaattcttatgcctc

SEQ ID NO: 61146 - DNA, 201 bp, Homo sapiens
ggggctttatttttgattttctttttgttttttgagatggagtgtcattctgtctcccaagctggagtgcagtggtgtgatctcggctcattgcagcttcygcctcccaggttccagcaattctcctgcctcagcctcctgagtagctgggactacaggcgcaagccaccatgcccggctaatttttgtatttttttagta

SEQ ID NO: 61147 - DNA, 201 bp, Homo sapiens
ggatgccatgggtacctcaaactttggctggagtcagtcaaatccagacttgaggctcttctgtgctatttactagctgttaatttggggctttatttttkattttctttttgttttttgagatggagtgtcattctgtctcccaagctggagtgcagtggtgtgatctcggctcattgcagcttccgcctcccaggttcc

SEQ ID NO: 61148 - DNA, 201 bp, Homo sapiens
agtgagctgtatacttatgacagacatttatatatatatatatattatattatatatatatatattataatatatatatataatataatatatatatatawaatataatatatatatatatattagttctcacactgctataagaactacctgagactgggtaatttataaagaaaagaggtttaattgacttatagttcc

SEQ ID NO: 61149 - DNA, 201 bp, Homo sapiens
ctttcagcctgatccctagttggagctataatgagagagattgccagcttctcattttcaggttgacctcaattgtcaccccttctccctagtcttccgtmtaccctactgtgtgatttttctacaataactggtagcagatttgtgccctggttgaagttgtggggttttaagcccctatttatcattagcatagagggg

SEQ ID NO: 61150 - DNA, 201 bp, Homo sapiens
tatgaaaaatcaagtgagctgtatacttatgacagacatttatatatatatatatattatattatatatatatatattataatatatatatataatataawatatatatatataatataatatatatatatatattagttctcacactgctataagaactacctgagactgggtaatttataaagaaaagaggtttaattg

SEQ ID NO: 61151 - DNA, 201 bp, Homo sapiens
aaggtttaattaaagattttaacattttaaaaaaaggcaaccataagaatactagaagaaaatctagaagaatatttcactacatgaaaattaaaaacttmactgcaaaaatcattgtaatcagagttaagtttggaaaaagaatttgtagtacatatgataaagagctaatacaaagggggtattaggaaaaggtgccaa

SEQ ID NO: 61152 - DNA, 201 bp, Homo sapiens
ttacccttgggggaggcaggtaactagaagggagcatgagatgggcttctgagatgctggcaatgttctgtttgtttgtttgtttgtttgttttgagacasagtctcgctctgtcgcccaggctggagtgcagtggcgcaatctcggctcactgcaagctctgcttcccaggttcatgccattctcctgcctcagcctccc

SEQ ID NO: 61153 - DNA, 201 bp, Homo sapiens
gtgggagaatgaggttactagagaaatgtaggatgcaaggaaaaaaaaaatttttttccagcatatccagcagtttagtgcatgcatggagaaaacctttytgggtatggcaaggacatcgcttgctcaagacacattctaacctctaatatgtcttctcttcctgaaaaatctggaaaactaaaaaccattttcttgact

SEQ ID NO: 61154 - DNA, 201 bp, Homo sapiens
tttcttaattttttttctgattgctccttgctactgtatagaaacacaactgattttagcatgttcgttttgtattctgcaactttgctaaattcacttaytcgttctaacaggatttttttgtggactctttagggttttctacatagaagatcatgccatctgtaaacagaaataattttcttgcagatttagtttttt

SEQ ID NO: 61155 - DNA, 201 bp, Homo sapiens
tactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaactacctgagactgggtaatttata

SEQ ID NO: 61156 - DNA, 201 bp, Homo sapiens
gaactcctgacctcaagcgatccacccaccttggccttccaaagtgctgggatacaggcgtgagccaccatgcccggccataattttcttttctttttttwaaaaaatattttgtggagatggggtgtcgctgtgttgcccaggctggcctcgaacttctggtctcaagcattccttccacctcagccttccaaagtgctg

SEQ ID NO: 61157 - DNA, 201 bp, Homo sapiens
ttgtctttgttcaggctgcaaaacagcttttgcatcaaagttgaggtctaggagaaggccacctccttgagcccttcttgctagctagagtccatgttccrgcatgccaggactctccagtgatttgtttttatcttccctcctcctgagccttcatctttgagagagaacaaagtggaaatagtgccaaactctgtgtta

SEQ ID NO: 61158 - DNA, 201 bp, Homo sapiens
ctgacctcaagcgatccacccaccttggccttccaaagtgctgggatacaggcgtgagccaccatgcccggccataattttcttttcttttttttaaaaartattttgtggagatggggtgtcgctgtgttgcccaggctggcctcgaacttctggtctcaagcattccttccacctcagccttccaaagtgctggaatta

SEQ ID NO: 61159 - DNA, 201 bp, Homo sapiens
caaagtgctggaattacaggtgtggactactgtacctggcctggaagttgactttttaaaaataaatttggattaactaaggagcctctgagtaaccgcartagaaccctcggtttctacagaatttgaaaaaaagttttatattccatatttaaaaaatgacaaccatttactttcctgaaattgtaaacctgttatagt

SEQ ID NO: 61160 - DNA, 201 bp, Homo sapiens
gtggggccatctcggctcactgcagtctccgcctcccgggttcaagcaattctcctgcctcagcctcccaagtagctgggactacaggtgcgcaccaccaygcctagctaatttttgtatttttagtagagacggggtttcactatgttggccgggatggtctcgaactcttgaccttgtgatccacccgccttggcctcc

SEQ ID NO: 61161 - DNA, 201 bp, Homo sapiens
tgaccttgtgatccacccgccttggcctcccaaagcgctgggattacaggcgtgagccactgtgcctggctgattttttttttttttaagtagagatagartctcactgtgttgtccaggctggtcttgaactcctggcctcaagtgatcctcccgccttagcttcccacgattacagtcgtgagccactgcacctggccc

SEQ ID NO: 61162 - DNA, 201 bp, Homo sapiens
ctgattttttttttttttaagtagagatagagtctcactgtgttgtccaggctggtcttgaactcctggcctcaagtgatcctcccgccttagcttcccaygattacagtcgtgagccactgcacctggccccagtttccttcttgaagaattgcatggggtttcttaggccactgttctacaagaggtataaatctggga

SEQ ID NO: 61163 - DNA, 201 bp, Homo sapiens
attatgaaaaatcaagtgagctgtatacttatgacagacatttatatatatatatatattatattatatatatatatattataatatatatatataatatwatatatatatatataatataatatatatatatatattagttctcacactgctataagaactacctgagactgggtaatttataaagaaaagaggtttaat

SEQ ID NO: 61164 - DNA, 201 bp, Homo sapiens
tcaagaaaaaaaaagtaagcccttttctctttgaagtcacttcagatttaataccttagcatagtagttaagagaatggactctggagtcagccagtttgrctccccatttcctggctttttgacatgcttagtaatttaacttctggaagcctttgttctctcatctgtataatataatagtaatagaacttacatttta

SEQ ID NO: 61165 - DNA, 201 bp, Homo sapiens
aattatgaaaaatcaagtgagctgtatacttatgacagacatttatatatatatatatattatattatatatatatatattataatatatatatataatawaatatatatatatataatataatatatatatatatattagttctcacactgctataagaactacctgagactgggtaatttataaagaaaagaggtttaa

SEQ ID NO: 61166 - DNA, 201 bp, Homo sapiens
tttagttcttgagggctccaccctcctgaagggattaatgccaattattgaaaggcttgaggctgtgagtttgatctctttctctccttcttaccctcttrccttccaccatgggatgacacaacaagaagattcttgccagatgctggcaccttgctcttggactttccaacctccagaactatgagccaaataaatttc

SEQ ID NO: 61167 - DNA, 201 bp, Homo sapiens
actttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaactacctgagactgggtaatttataa

SEQ ID NO: 61168 - DNA, 201 bp, Homo sapiens
ttactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaactacctgagactgggtaatttat

SEQ ID NO: 61169 - DNA, 201 bp, Homo sapiens
tggttactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaactacctgagactgggtaatt

SEQ ID NO: 61170 - DNA, 201 bp, Homo sapiens
ctggttactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaactacctgagactgggtaat

SEQ ID NO: 61171 - DNA, 201 bp, Homo sapiens
ttgatctgagtactggttactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaactacctg

SEQ ID NO: 61172 - DNA, 201 bp, Homo sapiens
ttttgatctgagtactggttactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaactacc

SEQ ID NO: 61173 - DNA, 201 bp, Homo sapiens
gttttttgatctgagtactggttactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaact

SEQ ID NO: 61174 - DNA, 201 bp, Homo sapiens
ctgttttttgatctgagtactggttactttggtatgttcaaattatgaaaaatcaagtgagctgtatacttatgacagacatttatatatatatatatattatattatatatatatatattataatatatatatataatataatatatatatatataatataatatatatatatatattagttctcacactgctataagaa

SEQ ID NO: 61175 - DNA, 201 bp, Homo sapiens
tgagactcctggaaagactcaatagtgagaatatagcctcccaccccattaacttcgctcccatgggagatggcttcccctcatgcaacaggcaggtttgkgagttagaggtcaaaagcagctgcctgaatgagttgttgtttccttatcactcctggtccctttgcaagtgaaccctgcagctcacccattcattcaccc

SEQ ID NO: 61176 - DNA, 201 bp, Homo sapiens
tcagccctaatgtctcctcagaattttttttacccatcataaataaatcggttcacactgtatttaattatatacttgtttaatgtctatcttcctcacargacactaagctccatgagggctgagttgtgtctgttttgttgtatatctcagtcttaggtggatgggtagaaaatagtaagtgcttgatacatttttgat

SEQ ID NO: 61177 - DNA, 201 bp, Homo sapiens
gtgcaatctcggctcactgcaacctccacctccgggttcaagtgattctcctgcctaagcctccagagtagcagggactacaggcgtcagccaccacgccyggctaattttttgtatttttagtagagacagagtttcgccatgttggccaggctgacttcaaactcctgacctcaggtgatccacccacctcggcctccc

SEQ ID NO: 61178 - DNA, 201 bp, Homo sapiens
ttgtccttgaagaaggtggtgtttcagcccatgtcccagctcttctcttgctgaacttagcagggatttgggacctagtaattaaatagctgagaagccartattcatcctgtcatcctctgagaagcatgttggtagcagagtgcattatattaatacatggtaggaggtacgagcatagcaatgagacttgggatttgg

SEQ ID NO: 61179 - DNA, 201 bp, Homo sapiens
ttgggacctagtaattaaatagctgagaagccagtattcatcctgtcatcctctgagaagcatgttggtagcagagtgcattatattaatacatggtaggrggtacgagcatagcaatgagacttgggatttggcttaggcttgccatagcccaagaaatgctgaggggagattcatgttggtaaggtcgaaatagcattg

SEQ ID NO: 61180 - DNA, 201 bp, Homo sapiens
aaatagctgagaagccagtattcatcctgtcatcctctgagaagcatgttggtagcagagtgcattatattaatacatggtaggaggtacgagcatagcartgagacttgggatttggcttaggcttgccatagcccaagaaatgctgaggggagattcatgttggtaaggtcgaaatagcattggactagaagtaaaaaa

SEQ ID NO: 61181 - DNA, 201 bp, Homo sapiens
ttagccaggatggtctcgatctcctgaccttatgatccacccgccttggcctcccaaagtgctgggattacaggcataagccaccacacccagccttaatrttctgttttttgatctgagtactggttactttggtatgttcaaattatgaaaaatcaagtgagctgtatacttatgacagacatttatatatatatatat

SEQ ID NO: 61182 - DNA, 201 bp, Homo sapiens
cttgccatagcccaagaaatgctgaggggagattcatgttggtaaggtcgaaatagcattggactagaagtaaaaaaaaagtctgtgttgtacttggctgwgctactatctttgtgacttttgacaagtaacttatgcccctgagcctcaaattcttcatttacattatggtgacaacaagtttcaaggccatttgccacc

SEQ ID NO: 61183 - DNA, 201 bp, Homo sapiens
gtggcgcaatctcggctcactgcaagctctgcttcccaggttcatgccattctcctgcctcagcctcccaagttgctgggactacaggcgcccgccacctygcccggctaattttttgtatttttagtagagacagggtttcaccttgttagccaggatggtctcgatctcctgaccttatgatccacccgccttggcctc

SEQ ID NO: 61184 - DNA, 201 bp, Homo sapiens
atttatttatttattcacttatttatttatttattgacagaatcttgctctgtcacccaggctggagtgcagtagcatgatcttggctcactgcaaccatracctcctgtgttcaaacgattttcgtgcctcagctacccaagtagctgggattacaggcatgtgccgccatgcccagctaaattttgtatttttagtaga

SEQ ID NO: 61185 - DNA, 201 bp, Homo sapiens
aattgtgattacccttgggggaggcaggtaactagaagggagcatgagatgggcttctgagatgctggcaatgttctgtttgtttgtttgtttgtttgttttgagacagagtctcgctctgtcgcccaggctggagtgcagtggcgcaatctcggctcactgcaagctctgcttcccaggttcatgccattctcctgcctc

SEQ ID NO: 61186 - DNA, 201 bp, Homo sapiens
agttgtgtgccttcctaccagtcactaatctttttgtgcttcagtgtcttagactgtaaattattgaaaagctacactttgttgaatgtccattatgtgcyacatacctatgtcagtcactttatgtacatcatttgttatctgcagcagcaaagtgagaacaaatgggaacttaggccctgaaaggcaagttgtgtgcaa

SEQ ID NO: 61187 - DNA, 201 bp, Homo sapiens
gaattgtgattacccttgggggaggcaggtaactagaagggagcatgagatgggcttctgagatgctggcaatgttctgtttgtttgtttgtttgtttgttttgagacagagtctcgctctgtcgcccaggctggagtgcagtggcgcaatctcggctcactgcaagctctgcttcccaggttcatgccattctcctgcct

SEQ ID NO: 61188 - DNA, 201 bp, Homo sapiens
cctctgattctactctctgctaacactccaccacctcctaattataggctgtacatttttcagacagtagtttttcattcctttgttttctttttaatgtrtagatatgaatacaagatgacagttcatttttagcgggcagagaattgtggtctctgactcaggaggaagactggggtatagctaactgggtttacttct

SEQ ID NO: 61189 - DNA, 201 bp, Homo sapiens
agaattgtgattacccttgggggaggcaggtaactagaagggagcatgagatgggcttctgagatgctggcaatgttctgtttgtttgtttgtttgtttgttttgagacagagtctcgctctgtcgcccaggctggagtgcagtggcgcaatctcggctcactgcaagctctgcttcccaggttcatgccattctcctgcc

SEQ ID NO: 61190 - DNA, 201 bp, Homo sapiens
tagaattgtgattacccttgggggaggcaggtaactagaagggagcatgagatgggcttctgagatgctggcaatgttctgtttgtttgtttgtttgtttgttttgagacagagtctcgctctgtcgcccaggctggagtgcagtggcgcaatctcggctcactgcaagctctgcttcccaggttcatgccattctcctgc

SEQ ID NO: 61191 - DNA, 201 bp, Homo sapiens
cacttgggcccagaagttagaggctgcagtgagctatgattgtgccaccgcaccccagcctgggtaagagtaagaccctgtcccttaaaaaaaaaaaaaaagaaaaaactaacatggaaagaagtctaagataataaaatttaaaaacatgttgcagaagactttgtatagcatctctcttccccttttaaagcaagtgtg

SEQ ID NO: 61192 - DNA, 201 bp, Homo sapiens
ttaatccagaaattctttgaagaatttagtgtaagtagagaattacataaattatgtgcatctgttttgtagactatgcagatgattgaaagaatgactgtatttctaagacataattatgcctcatcttaccagaaagatgccatggaaggttttcatacaattccatcacactgctacctgactgataacagttgtaaa

SEQ ID NO: 61193 - DNA, 201 bp, Homo sapiens
tttaatccagaaattctttgaagaatttagtgtaagtagagaattacataaattatgtgcatctgttttgtagactatgcagatgattgaaagaatgactgtatttctaagacataattatgcctcatcttaccagaaagatgccatggaaggttttcatacaattccatcacactgctacctgactgataacagttgtaa

SEQ ID NO: 61194 - DNA, 201 bp, Homo sapiens
gggcctaagggccccacctcttgataccattgaattggggattaggcttcaaagtgaatattggagaaataccaaagttcatgttgaactttagtcccccmcgtgggggtattaagaggtggtattaagaagtattaatcacttgggaagtggttaagtcatgaaggctctgcccttgtaaatgtgattaatgcccttata

SEQ ID NO: 61195 - DNA, 201 bp, Homo sapiens
tgaggatgattagacagcaaaaaaagaaaagttaaactttaaattaaggccaccgtgacctattcaccctccacttcccatctcagaatctaaacatggtygccctcgagaggcctgcttgccctccacagacagtgccactgcagatgacaggcactcaccaccacccaacccaaaccagagaatttgcaacagaggagg

SEQ ID NO: 61196 - DNA, 201 bp, Homo sapiens
cccgccccccgccatttcccatctcccttcctcccatccataacatccttccacagctcccttccccgctctgaggagagtcgatactaacagctaccctmtccctgccctgggagacctggggtgggcagggaacccctccctgagaacctcagacccactcttccattgcatcctgtaggacccagtggaacctgacag

SEQ ID NO: 61197 - DNA, 201 bp, Homo sapiens
ggtagaacagggacttaccagcttcccaaagggatctactcaccattgccaaactcttcatttccacattttgtgtaggtgtcagggaaccccaaactggygttgctttggggtctctaaaggagattggctgacaccaccatttcccccagatccagattctctgagggaggttgtttcttgagagtagatccagagtgt

SEQ ID NO: 61198 - DNA, 201 bp, Homo sapiens
gctggctgagcatggtggctcacgtctataatcccaggacttttggaggctgaggcagaaggatcacatgagccctggagtttgagactggcctgggcatcatagtgagacccccatctctacaaaaagttaaaaaaaaattagtagccagatgtggtggcatgcacctgtggtcctagctacttgggaggctgaggtggg

SEQ ID NO: 61199 - DNA, 201 bp, Homo sapiens
gaggcaggagaattgcttgaaccccggaggcagaggttacagtgagccgaggtcctgctacagcactccaccctgggggacgaagcgagactcttgtctcrgaacaaaaaaaaaaaacagaaaaagaagggaacagacaaaagtccctgtcttagtggtggagcttatattctagctggagagacaaacaaacataataaa

SEQ ID NO: 61200 - DNA, 201 bp, Homo sapiens; identical to SEQ ID NO: 32786

SEQ ID NO: 61201 - DNA, 201 bp, Homo sapiens
tgaggcccccagcccgccgacccggaaccacaacgccggcccggtgacagctcaaacccaccctctggcccttttctcccggttcctctccaaacctggtycaggcaccacgcccccttctcactgactagtgatcgccccttttgatgtccaggcctgcctttttggtgacctctgaccctgggcctagtgggattgatc

SEQ ID NO: 61202 - DNA, 201 bp, Homo sapiens
ttttatttacattttatatttttgtacatattgttagggtcattttttttttctttgagacggagtctagctctgtcgccaggctcaagtgcagtggtgcsatcttggctcaccgcaagctccacctcctgggttcaagtgattctcctgcctcagcctcctgagtagctgggattacaggcgcccgccaccacacccagc

SEQ ID NO: 61203 - DNA, 201 bp, Homo sapiens; identical to SEQ ID NO: 32773

SEQ ID NO: 61204 - DNA, 201 bp, Homo sapiens; identical to SEQ ID NO: 32772

SEQ ID NO: 61205 - DNA, 201 bp, Homo sapiens
aaaattagctgggtgtgatggcaggtgcctgtaatcccagctgtttgggagtctgaggcaggagaatcactagaaccgggaggcggaggttgcagtgagcygctgaaattgtaccactgcactcctgcctgggcgacagagcaagactccttcttaaaaaaaaaaaaaaaaaaaaatagcgccaggtgtggtatctcattc

SEQ ID NO: 61206 - DNA, 201 bp, Homo sapiens; identical to SEQ ID NO: 32775

SEQ ID NO: 61207 - DNA, 201 bp, Homo sapiens
caaggatgcagagtaaccgccatgttgtttatattctcaaagacagttcagcccgaccgtgagtgccacatgctcttccatcccatacttaattccttccytcctcagcccttcccccatctttgactatctcttgcagatagataccactagcctgttcattattttccccgtcctacagggctggaaaaggagccatta

SEQ ID NO: 61208 - DNA, 201 bp, Homo sapiens
tcctgaactcatggcctcaagtgatgtgcccacctcagcctcccaaaagtgctgggattacaggtgtgagccaccgcacacaacccttatgcctaattttyttttgagacagagtcgctctgtcacccaggctggagtgcagtggcacgatctcagctcactgcaagctccgcctcccaggttcacggcattctcctgcct

SEQ ID NO: 61209 - DNA, 201 bp, Homo sapiens
tcctagtacttagggaggccgaggtgggtggatcacttgagcccaggagttcgagactagcctaggcaacatggtgaaaccccatctctacaaaaaacacwaaaattagccaggtgtagtggcacgcacctgtggtcccagctacttgggggtctgaggcaggaggattgcttaagcccaggaggtcgaagctgcagtgag

SEQ ID NO: 61210 - DNA, 201 bp, Homo sapiens
cccaccccttggaaccctgctgaattttttatttatttatttatcctttgagacggagtctcattctcttgcccaggctggagtgcagtggcacgatctcrgctcactgcaacctccgcctcctgggttcaagcgactctcctgcctcagcctcccaagtagctaggattacaggtgcacactgccatgcctggctaattt

SEQ ID NO: 61211 - DNA, 201 bp, Homo sapiens
catcctggcctccagcatgtcttcccctgactttccccaccccttggaaccctgctgaattttttatttatttatttatcctttgagacggagtctcattstcttgcccaggctggagtgcagtggcacgatctcagctcactgcaacctccgcctcctgggttcaagcgactctcctgcctcagcctcccaagtagctag

SEQ ID NO: 61212 - DNA, 201 bp, Homo sapiens
caggcttctggcttcctgttggcatgctttccccatacttcctcctaccctgagtctccttttccctgcagaaggagcgagtggaaccgcaccaactggcrattgaccgaccctcacagaagctgctgaaattcctgaataagcactacaatctggagaccacagtcccacaggttagaggtttcagagaatagatcccca

SEQ ID NO: 61213 - DNA, 201 bp, Homo sapiens
gcctcccaaattgttgggattacaggcgtgatccaccacgcctggcccccgagttttttttttttttttgagacggagtctctctctgtcgcccaggctgragtgcagtgttgccatctcggctcactgcaagctctcctcttgagtaaactcttaatggctacactattttcctggctaaaacactgcagctggaatcag

SEQ ID NO: 61214 - DNA, 201 bp, Homo sapiens; identical to SEQ ID NO: 32777

SEQ ID NO: 61215 - DNA, 201 bp, Homo sapiens; identical to SEQ ID NO: 32776

SEQ ID NO: 61216 - DNA, 201 bp, Homo sapiens
gtggggagaactgttgaagtgatgtcattgaatgggcggcgggggcgttgagatttggttgacaagttagccttggataggaacatggacagttaatccaytgtaacatgatttgatagatgtgattacagaggaggcataaggacatggatttgagtgctatcttgggctgggggttgggtaaagaaagatgacatgtct

SEQ ID NO: 61217 - DNA, 201 bp, Homo sapiens
ttgaaggcttctttgcccatcaacatcgtaagtttttgcattttgttggtcacgtagtcggggtgagggaaaggaaagagctggactcttggtcctgccgrcccctcactgaggggccccgccgcttccttcctcacagggccccctgctccctctctgagggcaactcgacactctcgtgctgctgcagtcgatcccacg

SEQ ID NO: 61218 - DNA, 201 bp, Homo sapiens
gctttaactgagatggtaggtagaccagctttgggggaaatactaggagtacatttttaatatgttaattggagatgtctgtgatatgtccaggtttgagyagacagttggatacttccctggagatcagggaggaggtttggggaggagagttttcagcatacatctggtatctaaagccaacagacaggatgcgatcac

SEQ ID NO: 61219 - DNA, 201 bp, Homo sapiens; identical to SEQ ID NO: 32778

SEQ ID NO: 61220 - DNA, 201 bp, Homo sapiens
aagctcattgggagcctgtttgacagctgatatcaatggaccctcttgccagttcaggtccgtcaacataggccagagtcaggctcctttgtaaaccccasgcttctgttagccagtgagggacaggctggtgcaaacagcccttccatttgcagtcacagaatagtgacacaaatggcccaaaatttaaatgttactttt

SEQ ID NO: 61221 - DNA, 201 bp, Homo sapiens
agagagcatcccagacagaaggtaccaccagtgtatggccgtgaggtgggagtgtgcctgaaagagcaaattggctgtgtccagagcagcatgagtcagcrgaggagtatggtaggagatgagaccagagaggtaatgcggaggaggggccttataggctactgcaaagactggcttttattttaagtaaaaaataagatc

SEQ ID NO: 61222 - DNA, 201 bp, Homo sapiens
gcaggggaattgcttgaatcagggaggtagaggttgcagtgagctgagattgtgccactgcactgcactctagcctggtgacagagtaagaccccatatcaaaaaaaaaaaaaaaatggaaacggcaataagggagccagagtagaagcaagtagactaattaggcagcaacaatcctggcgaaaaatggtggtggctcag

SEQ ID NO: 61223 - DNA, 201 bp, Homo sapiens
tcattattttccccgtcctacagggctggaaaaggagccattattggtttcatcaaagttggatacaagaagctctttgtactggtgagtgttattggatrctaggagttcgtataccttggtttctgagaacaaaagtgctggaggttagggggcagcagagatgccggggttcctaaaacatttttattgtttctctct

SEQ ID NO: 61224 - DNA, 201 bp, Homo sapiens
tggcacgatctcagctcactgcaagctctgcctcccgggttcacgccattctgctgcctcagcctcccgagtagctgggactacaggcgcccgccaccacrtccggctaatttttttgtatttttagtagagatggggtttcaccatgttagccaggatggtctcgatctcctgacctcatgatccgcccgcctcggcctc

SEQ ID NO: 61225 - DNA, 201 bp, Homo sapiens
cccgccaccacgtccggctaatttttttgtatttttagtagagatggggtttcaccatgttagccaggatggtctcgatctcctgacctcatgatccgccygcctcggcctcccaaagtgctgggattacaggcgtgagccaccgcacctgacctttactgtaccttttctgtgttgaggtatgtttagatacatcagctg

SEQ ID NO: 61226 - DNA, 201 bp, Homo sapiens
cactcagagtttataacatttccaaccagataatgaaattgatatggagaaaccaaacctcagaggcactaaaatgctgtccagattccccatcccatatacacacacacacacacacacacacacacaaacacacttactgacagtctgagccccactccttcctcttcctcaccacctccaccttaccaacttctgaca

SEQ ID NO: 61227 - DNA, 201 bp, Homo sapiens
gacagagtgagactccgtctcaaaaaagaaaaaaaaaaaaaagaaagactcagatttctctttttttctaccaaaacctttgctgtcatgactctcttccktttttcttctttttctgtcttgctcttcattctccctgtccccagttctgaaggtagctgtggagcctccttggcccctaaacagggcccctcgccgcgc

SEQ ID NO: 61228 - DNA, 201 bp, Homo sapiens
cgtgaggtgggagtgtgcctgaaagagcaaattggctgtgtccagagcagcatgagtcagcggaggagtatggtaggagatgagaccagagaggtaatgcrgaggaggggccttataggctactgcaaagactggcttttattttaagtaaaaaataagatcaggccaggggtggcgactcacacctgtaatcccagcact

SEQ ID NO: 61229 - DNA, 201 bp, Homo sapiens
actcagagtttataacatttccaaccagataatgaaattgatatggagaaaccaaacctcagaggcactaaaatgctgtccagattccccatcccatatacacacacacacacacacacacacacacaaacacacttactgacagtctgagccccactccttcctcttcctcaccacctccaccttaccaacttctgacag

SEQ ID NO: 61230 - DNA, 201 bp, Homo sapiens
agtgtgcctgaaagagcaaattggctgtgtccagagcagcatgagtcagcggaggagtatggtaggagatgagaccagagaggtaatgcggaggaggggcmttataggctactgcaaagactggcttttattttaagtaaaaaataagatcaggccaggggtggcgactcacacctgtaatcccagcactttgggaggccg

SEQ ID NO: 61231 - DNA, 201 bp, Homo sapiens
tgggaggccgaggtaggtggatcacctgaggtctctactgaaaataccaaaattagctgggtgtgatggcaggtgcctgtaatcccagctgtttgggagtytgaggcaggagaatcactagaaccgggaggcggaggttgcagtgagccgctgaaattgtaccactgcactcctgcctgggcgacagagcaagactccttc

SEQ ID NO: 61232 - DNA, 201 bp, Homo sapiens
aaagtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactagctcc

SEQ ID NO: 61233 - DNA, 201 bp, Homo sapiens
ggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggg

SEQ ID NO: 61234 - DNA, 201 bp, Homo sapiens
ggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtc

SEQ ID NO: 61235 - DNA, 201 bp, Homo sapiens
aagggacaggcatggctctggcctttgggaagggaaacagcacaggaaccctaagcaagtgtgtcttactgatagacattggtcaggtctatgctgtgttyttaaagggtagaaatcagaacccataatggagataggtccttgatagactgttgagtgaaattactaatttttatggcatagcttgagtctcttgagctt

SEQ ID NO: 61236 - DNA, 201 bp, Homo sapiens
cctcaggtgatgtgccctcctcggcctcccaaagtgctggtattacaggcatgagccaccgcacctggcctcagattttctttttattgatccctttgttygtattccagtagaacgttttctgatgttttgtgagtgaggctgattttgttctgtcctccacatggatagaacttaatgcagagggaaatacagaggaag

SEQ ID NO: 61237 - DNA, 201 bp, Homo sapiens
tccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccttccttccttcgttcttctttagag

SEQ ID NO: 61238 - DNA, 201 bp, Homo sapiens
cttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagtt

SEQ ID NO: 61239 - DNA, 201 bp, Homo sapiens
aatactatcggggaaacggaagtggccgtcggtggcaggtttgggggagaccggaagtgacggtccgtggggaagtcgggggcggagccgcggggtggtgkgtgtgtgtgtgtgtgtgtgtgtgtgtgtgtgtgtgtgtgtgtttggctgtgggttagttgtgccgttctgctggaacaccgtgggaaggcagtagacgcg

SEQ ID NO: 61240 - DNA, 201 bp, Homo sapiens
atcatccggacaaacctggaatttctccaagagcagtttaatagcattgctgcgcatgtgctgcattgcacaggtcaggggctggccaggcgggggcaagkggggcctgttgcatgtgcagggctgccacgtgccagcattccctccttgtattttgcccacagatagtggatttggggcccggttgctggagttgtgtaa

SEQ ID NO: 61241 - DNA, 201 bp, Homo sapiens
tgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcg

SEQ ID NO: 61242 - DNA, 201 bp, Homo sapiens
cgtttctccaacctgcttactttttctctttagctccggtctgatatacaaaaacgactgcaggaagaccccaactacagtccccagcgcttccccaatgsccagcgggcctttgctgatgatccttagctctttgctctatggcccttcctcatcaggggaccgtttcccccctcttccttcacagtatttaagaaataa

SEQ ID NO: 61243 - DNA, 201 bp, Homo sapiens
ggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagc

SEQ ID NO: 61244 - DNA, 201 bp, Homo sapiens
atcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggag

SEQ ID NO: 61245 - DNA, 201 bp, Homo sapiens
cagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtgg

SEQ ID NO: 61246 - DNA, 201 bp, Homo sapiens
gccctgggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactcccca

SEQ ID NO: 61247 - DNA, 201 bp, Homo sapiens
gagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttgg

SEQ ID NO: 61248 - DNA, 201 bp, Homo sapiens
ggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatagggacttggccagcgtttctccaacctgcttactttttc

SEQ ID NO: 61249 - DNA, 201 bp, Homo sapiens
tgggaaggcttgacagtgccaccccgggctatttgacagtgtgcttggggggggaaatgttagcttctgagggatggccttgtgtgcttgctgggatcatrgggacttggccagcgtttctccaacctgcttactttttctctttagctccggtctgatatacaaaaacgactgcaggaagaccccaactacagtccccag

SEQ ID NO: 61250 - DNA, 201 bp, Homo sapiens
tgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccat

SEQ ID NO: 61251 - DNA, 201 bp, Homo sapiens
gaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttc

SEQ ID NO: 61252 - DNA, 201 bp, Homo sapiens
catcttcctgtcccccggcccagccaggcagtggtaccttcttgccattacataaccactgggtaagagcccctagtgacatgttaggggaaggggccctrggaattcattgactctgaacctttcattttaaagatgaagaaaatgaggtttagaaaaagaaagtatagtaattagtgtcactgctttctgacagcctgt

SEQ ID NO: 61253 - DNA, 201 bp, Homo sapiens
caaacatcagaaccagttgaaagtgaagcacctccccgggagcccatggaggcagaagaagtggaggagcgtgccccagcccagaacccggagctcactcmtggcccagccccagcgggcccaacacctgccccggaaacaaatgcacccaagtgagagatggagggaatctttagtgggtggggaatcctaagtgaagta

SEQ ID NO: 61254 - DNA, 201 bp, Homo sapiens
gttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctca

SEQ ID NO: 61255 - DNA, 201 bp, Homo sapiens
tcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagtc

SEQ ID NO: 61256 - DNA, 201 bp, Homo sapiens
atcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagt

SEQ ID NO: 61257 - DNA, 201 bp, Homo sapiens
cttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctgggggg

SEQ ID NO: 61258 - DNA, 201 bp, Homo sapiens
tagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtg

SEQ ID NO: 61259 - DNA, 201 bp, Homo sapiens
caaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctgggaattcattgactctgaacctttcattttaaagatgaagaaaatgaggt

SEQ ID NO: 61260 - DNA, 201 bp, Homo sapiens
ctcgaactcttgaccttgtgatccacccaccttggcctcccaaagtgctgggattacaggcttgagccatcgtgcccggccagcttttttcttttttttttaagttacagagtcttgctctgtcacccagactggagtgcagtggtgcaatccagtgagttaaagctcactgtaaccttgaactcctgggctcaaacagtt

SEQ ID NO: 61261 - DNA, 201 bp, Homo sapiens
atcccggatggaggtaagtgggcaaggctggctagggtctctctccaccctccctctcccttttctctcagcctgggagttagggcttcactggccacatycacagggtttggccttcataatctagtcttctctgcagtattcattcttttgggcagaaaaagtatctttgtgaggctctctcatttctgccaatcctct

SEQ ID NO: 61262 - DNA, 201 bp, Homo sapiens
tgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttct

SEQ ID NO: 61263 - DNA, 201 bp, Homo sapiens
cccagtctctgggacactggtgagcaagggtcggggagttctagtgcgtaacagtctagggagagactcctgtggtggtgcatggaagggcaggtctgaarttctcccttgctctctatccagcagggcgccggtctgggtaccaatgcctcgttggcccagatggtgagcggccttgtggggcagcttcttatgcagcca

SEQ ID NO: 61264 - DNA, 201 bp, Homo sapiens
gtgaatgtgtgtgtgtgcaggagaaactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaa

SEQ ID NO: 61265 - DNA, 201 bp, Homo sapiens
cctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcctggcc

SEQ ID NO: 61266 - DNA, 201 bp, Homo sapiens
gaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccg

SEQ ID NO: 61267 - DNA, 201 bp, Homo sapiens
tcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgt

SEQ ID NO: 61268 - DNA, 201 bp, Homo sapiens
atggccttgtgtgcttgctgggatcatagggacttggccagcgtttctccaacctgcttactttttctctttagctccggtctgatatacaaaaacgactrcaggaagaccccaactacagtccccagcgcttccccaatgcccagcgggcctttgctgatgatccttagctctttgctctatggcccttcctcatcaggg

SEQ ID NO: 61269 - DNA, 201 bp, Homo sapiens
gtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggat

SEQ ID NO: 61270 - DNA, 201 bp, Homo sapiens
ttgacagtgtgcttggggggggaaatgttagcttctgagggatggccttgtgtgcttgctgggatcatagggacttggccagcgtttctccaacctgcttrctttttctctttagctccggtctgatatacaaaaacgactgcaggaagaccccaactacagtccccagcgcttccccaatgcccagcgggcctttgctga

SEQ ID NO: 61271 - DNA, 201 bp, Homo sapiens
agtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctga

SEQ ID NO: 61272 - DNA, 201 bp, Homo sapiens
tcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcac

SEQ ID NO: 61273 - DNA, 201 bp, Homo sapiens
gtgccaccccgggctatttgacagtgtgcttggggggggaaatgttagcttctgagggatggccttgtgtgcttgctgggatcatagggacttggccagcstttctccaacctgcttactttttctctttagctccggtctgatatacaaaaacgactgcaggaagaccccaactacagtccccagcgcttccccaatgcc

SEQ ID NO: 61274 - DNA, 201 bp, Homo sapiens
aacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaagttctcccttgctctctatccagcagggcgccggtctg

SEQ ID NO: 61275 - DNA, 201 bp, Homo sapiens
aggctggtctcgaactccttacctcaggtgatgtgccctcctcggcctcccaaagtgctggtattacaggcatgagccaccgcacctggcctcagattttmtttttattgatccctttgttcgtattccagtagaacgttttctgatgttttgtgagtgaggctgattttgttctgtcctccacatggatagaacttaatg

SEQ ID NO: 61276 - DNA, 201 bp, Homo sapiens
cggggagttctagtgcgtaacagtctagggagagactcctgtggtggtgcatggaagggcaggtctgaagttctcccttgctctctatccagcagggcgcyggtctgggtaccaatgcctcgttggcccagatggtgagcggccttgtggggcagcttcttatgcagccagtccttgtgggtgagttttcattcttcccca

SEQ ID NO: 61277 - DNA, 201 bp, Homo sapiens
gctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcagtg

SEQ ID NO: 61278 - DNA, 201 bp, Homo sapiens
cgcggtgaacagttacgcacaatcgtctttctgacacaaacacaccctgccaggtggaagccaggatggagggcaggtgagacccgtaaggcaagatcccraaaccaaggaacggagcactctccccgcttgctccccagatccaagccctccacttccttccaatgccccccttcccgaaactgctccctcctgtatatt

SEQ ID NO: 61279 - DNA, 201 bp, Homo sapiens
caggtcctgacatgatgaggcaggtatgggccgccctgggctgagggggacatgggctaccctggactggagggctgggctgtggcatggggaccctgtcagagacaggtgtttggcctccatgccttcctgtgtctctggaagggtgaaactaagcgggatgctcctctcccagccccacctgcttttcagaggctacca

SEQ ID NO: 61280 - DNA, 201 bp, Homo sapiens
ggaatgtgaaaagggaagatagcacctgcgctaagcacattcctaggattgggccgcgtctcggggatgcagagtgggctcttcggcgcgccctgcagccrtgggagtggacgcctgcccaggccgaagggcaaggacttgcggggtggggtctctgtgcatgcgcggagctgaaagggagcgttttgcagatctccacgc

SEQ ID NO: 61281 - DNA, 201 bp, Homo sapiens
ggaagtggggtggttggttctgggtcctccctgaggctcacatggctgcccctccccatcctccaggcctcgccttctgtcccggatccgccaatcctccsatccctggatcctctgatgatggcatcaactgtctgggctacaggttgctctccaaagagtggctgcccctctacaccaacctcactgtggacataactt

SEQ ID NO: 61282 - DNA, 201 bp, Homo sapiens
tcagattttctgctgttgtgggagtatggcaagagtttgagggggcggagaaagagattgggaatgtgaaaagggaagatagcacctgcgctaagcacatkcctaggattgggccgcgtctcggggatgcagagtgggctcttcggcgcgccctgcagccatgggagtggacgcctgcccaggccgaagggcaaggacttg

SEQ ID NO: 61283 - DNA, 201 bp, Homo sapiens
ccagtgcaaagctgaggggtatcttatctggaagccagaaagagcccctgaggccaaggtcacagggaagccctcccactcaccccacctggtttcttttwaaagtagagtttattttatctcctttctgccatccctaattccttccttccatctgtccatccatcttctttcccctccctcccttcctcccttctcctt

SEQ ID NO: 61284 - DNA, 201 bp, Homo sapiens; identical to SEQ ID NO: 27566

SEQ ID NO: 61285 - DNA, 201 bp, Homo sapiens; identical to SEQ ID NO: 27597

SEQ ID NO: 61286 - DNA, 201 bp, Homo sapiens; identical to SEQ ID NO: 20562

SEQ ID NO: 61287 - DNA, 201 bp, Homo sapiens
agtcacacgcaggtgtgtgtggtcccaactcccgggatctcagacactcccttcctactgatggaacatggatgtgtactcagaactcagagaacagaacytgatcgcaggggatctttccaggctgggaacttcactgtcacttttcacagtgagtctaagcaaaagcccattctgagtcctaaagtcaaacctcctgag

SEQ ID NO: 61288 - DNA, 201 bp, Homo sapiens
cattttcaagatgccacctcaaatacggcaactctgcattctcacaagaaccaaggacttttgggtggtgcggccttgtctcctggtgaacactagagggygcattaggcctaagaatccctcctcccttctgtgttaggattaaacagagctctggctctgaaggtttcaggagtgagagcgaccacgtacgctttaaaa

SEQ ID NO: 61289 - DNA, 201 bp, Homo sapiens
accaccagccgggtgactttcagccacagttagtgaagccttcaagaatctcagccacatcttcatggcagacacttcatggaggctgctttgaggcaaartttatgcgttctgtttaacagatgacctctcaagagtctccttctcagttgaaaggggagaatttcaccaaaaacaactgtccggcccagagagagatct

SEQ ID NO: 61290 - DNA, 201 bp, Homo sapiens
agttgaaaggggagaatttcaccaaaaacaactgtccggcccagagagagatctgaggtttctcctggtctcccacacatcagagctcctctgctctgctygtcctgcttgtctaaacctaactgctttttctcagatagtgccccagctcttccttttaccatcatcctgcccctgggattttgtctcgtgccttttccc

SEQ ID NO: 61291 - DNA, 201 bp, Homo sapiens
aagcccgcggacaggacagatggctccgtgcaagctgcagcctggggtcctgagcttccctcgcaccgcacagtcctgggagccggtgagtgttgccttcrtcagagaactgaagtcaggagggaccaggtctgacgcacctgttacaacagcttaaagcctagattcctcagtagtgaagtttttattttttctaaggta

SEQ ID NO: 61292 - DNA, 201 bp, Homo sapiens
gtaatctgtttcccagttgtttgtttttatataattagatcataaactaaatacattgaggtacagtgttattatgctttttgttttttctacagaacccrtaaagagcatttgaagtaatgatttccaaattgttttattcacatgctgacatacttgctcttcttgaataaacactccaggtcccccagggcagcgcca

SEQ ID NO: 61293 - DNA, 201 bp, Homo sapiens
acatcatggaggtgaaagtgactttgagtaggatcatgtaaagatttgtacattaatgagcttgccagtttgttccagaagccaaaaggtcagctatactyagaagctcttaaaaattctgacttctcttttttgatcagcctgcagtgcctcaaagccctttgaaaaatgaattaagaaggaaatacttgacccaagtgg

SEQ ID NO: 61294 - DNA, 201 bp, Homo sapiens
acattggtgcccttaaacctgtaaattacttgaattacttattagaacaattcctgaagagacataggtgcctcctggctcacatgcctccggcttaccgkgttggcatccccgctggccacctccccaccatggcagcgtggggcagttgcttagctggactggtctcagtgtcttcatctgtgaaatgggaaggatgat

SEQ ID NO: 61295 - DNA, 201 bp, Homo sapiens
taggcaattagctatttgtggcttcctttattaataaataagggtcagcacactttttccacaaagggccggatgatacatattttaggctttgctggctstatggtctctgttgtaactactcagctctgtgttgcaggaggaaagtggccgaaaataatatgtaaatgagtgtacgtggcagtgttccaataaaacttt

SEQ ID NO: 61296 - DNA, 201 bp, Homo sapiens
ggcttcggacgccagggcaattccctgggtgcctcagatggggtggacaacaccgtcagaccgggagaccagggcagctcttcacagcccaactcagaagrgaggtaggtgtgtttctgttggttgaatgtggtttatgtgagtgactgctctttggacagaggctttttatggtaggaatctttgcgccacgtttagtga

SEQ ID NO: 61297 - DNA, 201 bp, Homo sapiens
gcccccgctgcaacccaggggagcctcagctccttcctacgctcttgaggcctcttataaagtggacatgcagggagaagagaagccttgtggcaggctcytgctgtctcctgtgttaacagaaggattgcagttttattattttgcggtgactttgaaatgtgctgtcactcaaacaaccatgtttttattggcttctgc

SEQ ID NO: 61298 - DNA, 201 bp, Homo sapiens
ggtgtgtttctgttggttgaatgtggtttatgtgagtgactgctctttggacagaggctttttatggtaggaatctttgcgccacgtttagtgaatctcarccgaattcttacatacgtgatcattttctgagctttctcccaaatgcttttccttcctgtaaagtcagcgtctctatcaagaatgtgtccctgtgtaaga

SEQ ID NO: 61299 - DNA, 201 bp, Homo sapiens
aggaaggcaggaagggcggagtctcctatttgagtttgtggcgcgcgaggccctgcagtccgggttggcgcttgggtactggctgggtccgatgctgggtrcgctgcgcgccatggagggcgaggacgtggaagacgaccagctgctgcagaagctcagggccagtcgccgccgcttccagaggcgcatgcagcggctgat

SEQ ID NO: 61300 - DNA, 201 bp, Homo sapiens
agaagagaagccttgtggcaggctcttgctgtctcctgtgttaacagaaggattgcagttttattattttgcggtgactttgaaatgtgctgtcactcaarcaaccatgtttttattggcttctgcacttggaggactcctccatgaagcccgcggacaggacagatggctccgtgcaagctgcagcctggggtcctgagc

SEQ ID NO: 61301 - DNA, 201 bp, Homo sapiens
caagaatgtgtccctgtgtaagatgcatcgaggtaaagcagaaagtgctcttgcagaagtttcacactttccattagaatgcattcagaggcttttttccygcaaatcctcacttactacgctttattcgtctttgtcaaaccttcatttctaacctcttcatctgacactcagaaaatagctgttgtaaggcgaaagtga

SEQ ID NO: 61302 - DNA, 201 bp, Homo sapiens
gaggtaaagcagaaagtgctcttgcagaagtttcacactttccattagaatgcattcagaggcttttttcctgcaaatcctcacttactacgctttattcrtctttgtcaaaccttcatttctaacctcttcatctgacactcagaaaatagctgttgtaaggcgaaagtgatctaaagcgaatgacttcctatttctgga

SEQ ID NO: 61303 - DNA, 201 bp, Homo sapiens
gttaacagaaggattgcagttttattattttgcggtgactttgaaatgtgctgtcactcaaacaaccatgtttttattggcttctgcacttggaggactcytccatgaagcccgcggacaggacagatggctccgtgcaagctgcagcctggggtcctgagcttccctcgcaccgcacagtcctgggagccggtgagtgtt

SEQ ID NO: 61304 - DNA, 201 bp, Homo sapiens
tcatctgacactcagaaaatagctgttgtaaggcgaaagtgatctaaagcgaatgacttcctatttctggattcctggtagggaaagagcaagagtggccygggagagccacgagcacagtattctcacaggtgcgaggggtgccctgcagatatctcagtgctcagtgttaaaactttgcaccttgttctgcagcttaat

SEQ ID NO: 61305 - DNA, 201 bp, Homo sapiens
ctacagggtggtgttgtgaaccctcacttctatagggcagcttcccacttcgtcctcctaggaggctccttccttttccccaggccagtctcactgcccasccccatcctgtcctcttttctagggaatctgtccctcaccccttccttctgtcttcagtctctgtcccctggatccatccgtcggtatttagatgcgctc

SEQ ID NO: 61306 - DNA, 201 bp, Homo sapiens
gcccccgccggtccgccgggaggggaggcctgcgtgtcggagtgaggctgggaggggacgtaggacgggaagggaaggggctctgaggactcggagcgggsgttggggaagcgggactggggcttgaatgcggagagaaggtggaggcggagctgggggctccggagagggaaaaaggaggcagcgccgaaggcttcggtg

SEQ ID NO: 61307 - DNA, 201 bp, Homo sapiens
aaggcgaaagtgatctaaagcgaatgacttcctatttctggattcctggtagggaaagagcaagagtggcccgggagagccacgagcacagtattctcacrggtgcgaggggtgccctgcagatatctcagtgctcagtgttaaaactttgcaccttgttctgcagcttaatttgtgcgaatcgtgtcagctagagtttta

SEQ ID NO: 61308 - DNA, 201 bp, Homo sapiens
cccctggatccatccgtcggtatttagatgcgctcagactcacgttagatacatcagacccttcgtggctctcccctgtcctgggccccttccttgccacrtccctttgcccagttccctttaccaccagagtgaaataacctgctccgtttggtgccatggattccctaccccaccaaccccgtgtgttcctcctctccc

SEQ ID NO: 61309 - DNA, 201 bp, Homo sapiens
cttctgtcttcgtccttccaagcctgcagtctgctcgcctcccgtccctgctggatgccctttctagagggtttgtttgagctgcctttgcccttcccccrggtggagccatggcttctctgtgtgctgactgtaacctccagccagaactcaactgggggcgttttactgcccagcagcccctctgcttcaatacttcat

SEQ ID NO: 61310 - DNA, 201 bp, Homo sapiens
gagcacagtattctcacaggtgcgaggggtgccctgcagatatctcagtgctcagtgttaaaactttgcaccttgttctgcagcttaatttgtgcgaatcrtgtcagctagagttttagtctgcgtgtgcccttttctctagagacagtggggtggggtgggtcagtgggagtgagtacctttgttggcattaaaggttgg

SEQ ID NO: 61311 - DNA, 201 bp, Homo sapiens
gcccctctgcttcaatacttcatgtccagacttggcacagctaagactcagcccgacagacaggctccccatcttctgctctgcgcctcagtacaggcccstgccgtcttccctctagcgttagccagaaacccaggatcttcatctcagcctctgcctcattcctcatggccaaggcatccctgtcctgtgccttgtgct

SEQ ID NO: 61312 - DNA, 201 bp, Homo sapiens
ctgggttcctctgcttgcgaaacagttttgtcactagcctttaaacacctgtctctcctggacactggccttccgcagcctctgtccccctctgcccagtmcctttcctggcaccttgcctacaccaatagttagtgatgggtgttgagtcgctaaagggaagctggtggtctttcagagtagaattggaaagctcttcat

SEQ ID NO: 61313 - DNA, 201 bp, Homo sapiens
cccaagagcgattcatcttcatcacttccaaagaccaaccccacacacagcgcaactcgcccgcagcagacatctgaccttcacgttcagggaaatagttstggaatatttagaaagtcagtgtcacccagcaaaactctttcagtcccagataaagaagtgccaggccacggaaggaatcgttacgatgaaattaaagaa

SEQ ID NO: 61314 - DNA, 201 bp, Homo sapiens
gctccttcatctacatgtgttgctcgtgccatcacgagggatggcacgagggaccatcagttccctgcaaaaagacccaggctatcagaaccccagggctycggacgccagggcaattccctgggtgcctcagatggggtggacaacaccgtcagaccgggagaccagggcagctcttcacagcccaactcagaagagagg

SEQ ID NO: 61315 - DNA, 201 bp, Homo sapiens
tggtgcagaatctgcctttcctcactccatggccccaggcagtttcccattctaggggttctctgggttactaagaaccacgggcagccgtagatggctcyagtgggtgcacccttgaagcaatggggatttttactgtacaacttactcgaagtgatgccaaaaccatccttgagaggaaaatgcactccttcctgaaaa

SEQ ID NO: 61316 - DNA, 201 bp, Homo sapiens
ctcagccacatcttcatggcagacacttcatggaggctgctttgaggcaaaatttatgcgttctgtttaacagatgacctctcaagagtctccttctcagytgaaaggggagaatttcaccaaaaacaactgtccggcccagagagagatctgaggtttctcctggtctcccacacatcagagctcctctgctctgcttgt

SEQ ID NO: 61317 - DNA, 201 bp, Homo sapiens
gaggtgttctagggagtatttccaggtctgtcctcaaatgccccaagtcacaaggtcgcctcattgggcagccgtcactaacccaaacagtaagtgtcatytatatgtctgtttcccagagtgccccctgggtcacagaaaccacccgttttcttatgggatgtgcttcttatcctccttggttgggatagatgagaattt

SEQ ID NO: 61318 - DNA, 201 bp, Homo sapiens
tgtcatttatatgtctgtttcccagagtgccccctgggtcacagaaaccacccgttttcttatgggatgtgcttcttatcctccttggttgggatagatgmgaatttacacagagcttaaccagctccagcatctttcctggcccccgtgtcacactctgttgcctgccagaatacctggtgcatggttttcctctaaaat

SEQ ID NO: 61319 - DNA, 201 bp, Homo sapiens
cctccttggttgggatagatgagaatttacacagagcttaaccagctccagcatctttcctggcccccgtgtcacactctgttgcctgccagaatacctgrtgcatggttttcctctaaaattgctacttttgtgcagagggtttcccacgcacccatgtgtgactttcagtgactaagaaaaaggccgtggtcctgggga

SEQ ID NO: 61320 - DNA, 201 bp, Homo sapiens
tacacattgcagaataagaattcatctccagaaaaaggcagcaatctcacaggggtgttatgtgttttcttactgtgctgctgaccagcggaaagcctgtrtttgtggaccaccgacttagtggatgtacctgaaatgctttttcctttaacccaaggcagcaagtggtgtcctcttggttgctgtgttgatccagggaac

SEQ ID NO: 61321 - DNA, 201 bp, Homo sapiens
gtaggacatattttcttcccactgcccgaagcctagctggccactgtcaccacattcacacgcttgtcgacatggctgtgctaagatgcacagtccgcatygtcaggggagaacccagctccttgcacccagttgacacctggcaacttttttcttgtaaccactggctctgatttcagtgtgcaggtaacagagctggaa

SEQ ID NO: 61322 - DNA, 201 bp, Homo sapiens
tcgtggccctggaacctgacaggaagccccttcctcctccgcagtacaaccagcccttcgaggacaccccggtggtgcaaatggccacgctgacctacgaracgccacagggtaagggtcatccccaccttctgagtattcgggtgaagagtgtgaatggagtagttgaaatgctgtccctgctctcttaagaagtaaaca

SEQ ID NO: 61323 - DNA, 201 bp, Homo sapiens
tacacatttgtggtgtttttgtttttgctattgcttaaaaaaacatagtcctgatccaatcttaagttctgtcatctgtgcacatggatggtttagaatgrtaacacacctttactttatgtgtatcttttctcccaggatactgcagtcgtatctccggaaagagtcctggtgacccagcgaaaccagcttcatctccca

SEQ ID NO: 61324 - DNA, 201 bp, Homo sapiens
gcccgcagcagacatctgaccttcacgttcagggaaatagttgtggaatatttagaaagtcagtgtcacccagcaaaactctttcagtcccagataaagamgtgccaggccacggaaggaatcgttacgatgaaattaaagaagaatttgacaagcttcatcaaaagtattgcctcaaatctcctgggcagatgacagtgc

SEQ ID NO: 61325 - DNA, 201 bp, Homo sapiens
ggctggggtcaattcctcccatatagctttataactaactcagtatcacttaatgaaaacaaacctcagagcaagttctatgttgcattaaacggacacaraaggttcacaagatctgctccttgagttaaaagaaatcctacctttctgcctttatagccaatccagacacatcttgggtgaaaagtttacacaggcaga

SEQ ID NO: 61326 - DNA, 201 bp, Homo sapiens
gaatgacgaatttgccttaaaaacctgaaactttacaaagaggaacaatcgcagggtatcagaaacctggcttggttttaatattgtaccttttttttgcytgtcactttggcatctggtgaacacagattgagcagaagttcagcgttcaggattatgtaaatggtcatttttgtttcttttcttcaggattgagaattt

SEQ ID NO: 61327 - DNA, 201 bp, Homo sapiens
tgagcagaagttcagcgttcaggattatgtaaatggtcatttttgtttcttttcttcaggattgagaatttggggtggaagactaataaaggaaagaaacraaggagagatccaggtatttagtgtcaaattttattgccaaataaccttgctgtggaggagtattcatatgaataaaggtgtgggtatgcccaacctctg

SEQ ID NO: 61328 - DNA, 201 bp, Homo sapiens
cactttgtttgggtccttacagaaaataccaaatccagttccttctagggaagaagaatgtctctcttcctgttttgaaaggggaggaagagagatgaggrgaggtgcagcctggaggatcacacatctttccttctgcatttttctaccttcggaagaccctggcttccctgcctagttgatccgagggtgttgtcgctc

SEQ ID NO: 61329 - DNA, 201 bp, Homo sapiens
actgcctctcagatgccacatggttcctctctgtggtcacaggtcaaggaacctgtatgaaagaatgaaaaacatcaagatcaatgtgacgatattaacarcaaatttgaaatcaaatcttcttgattaattattctagtcataaaaatgttaaaagtacatacaactacataaatgagctgattcctctctgcaaagatg

SEQ ID NO: 61330 - DNA, 201 bp, Homo sapiens
ggcctgcgtgtcggagtgaggctgggaggggacgtaggacgggaagggaaggggctctgaggactcggagcgggcgttggggaagcgggactggggcttgratgcggagagaaggtggaggcggagctgggggctccggagagggaaaaaggaggcagcgccgaaggcttcggtgcggggacggggaggaaagactggggc

SEQ ID NO: 61331 - DNA, 201 bp, Homo sapiens
tctagcacctggcagccagttctacccccagtgcaagcctgattcacgatgattttcactctgcagataaagctgtcagtgtggttggcagggcgccatcygcctggatgagcacacgacaggaaagctgggctctcggtcagtctcccctacaggggcagggtaaaaagagaggtgttctagggagtatttccaggtctg

SEQ ID NO: 61332 - DNA, 201 bp, Homo sapiens
ggaagtgggcttcagttaccctgtagtgctcctgggtagccccaagtcctctgaaccctcagagttgacacctgaggaccatccctaacggtataggcctygccaccttctcacgccctgtttttataaggctgggtggttcctaaaatattaatatttcagccaatctggtatcctgaatgcttgaatttcattactgag

SEQ ID NO: 61333 - DNA, 201 bp, Homo sapiens
agcggctgatagagaaggtgcggcccccgccggtccgccgggaggggaggcctgcgtgtcggagtgaggctgggaggggacgtaggacgggaagggaaggsgctctgaggactcggagcgggcgttggggaagcgggactggggcttgaatgcggagagaaggtggaggcggagctgggggctccggagagggaaaaagga

SEQ ID NO: 61334 - DNA, 201 bp, Homo sapiens
ggttataacacaatgcctgggttctgtttgtagctaccagagctaccacatagtttggggttggtgtagatcgtctgcttctctgtgattctcaaaccagsttctgcctcagacacagccacaaaacaaccctgtaaactccaccttacgtgacggtttcactggaagcaaaggttctgatattctggaagtgggcttcag

SEQ ID NO: 61335 - DNA, 201 bp, Homo sapiens
ggggctcaggggtccatcaaagcccatgtggcctgaggcgggcagcgctgcctgcacttttctggaagtcctctcctgaggctggcttttgctacttccargtctcggatttcctcgtgtcgattcccttcagcggtaaggccctcctctcagtctagcacctggcagccagttctacccccagtgcaagcctgattcacg

SEQ ID NO: 61336 - DNA, 201 bp, Homo sapiens
tctcagaggagctccaaggagaacttcataccctgctctgagcctgtgaaagggacaggggcattaagagattgcaagaacgtattagatgtttcttgccrtaagacaggtttaaaattggaaaaagcttttcttgaagtcaacagaccccaaatccataagttagatccaagttggaaggagcgcaaagtgacaccctcg

SEQ ID NO: 61337 - DNA, 201 bp, Homo sapiens
aggaagccccttcctcctccgcagtacaaccagcccttcgaggacaccccggtggtgcaaatggccacgctgacctacgagacgccacagggtaagggtcwtccccaccttctgagtattcgggtgaagagtgtgaatggagtagttgaaatgctgtccctgctctcttaagaagtaaacattgttcacctaactaatagg

SEQ ID NO: 61338 - DNA, 201 bp, Homo sapiens
tttctccctcatggtcacctttcatattattgcctttcttgaatagcacaggccagtaattttgcagaatgtccctgaatttggacctgattgcttcctcrtggttaggttcacgttaaacatttttggcaaaattactacagggatgacgtgtcctctcagaacatttggtcagtctgtcccattcttggtgacttttag

SEQ ID NO: 61339 - DNA, 201 bp, Homo sapiens
aaaattactacagggatgacgtgtcctctcagaacatttggtcagtctgtcccattcttggtgacttttaggctggtcattgagttaaggtaagaccttamttcgatgtttctcattgcgacaggccctttttccctggagtcatctatgtgtgattctttgagatctcctaggaaccttttctctaaaagcttctcaccc

SEQ ID NO: 61340 - DNA, 201 bp, Homo sapiens
agccagcaatgcggatcgcctgggtggaggtccccgcccaggttgtttctgtctctgccgttccttggcacacgtcagttggcattattctgctcaaaagwgctatctcccctctggttcttttttttgcttcctgtagttccctctcatgctttgatttattttatttttattttttaggatcagtaggaattcatggag

SEQ ID NO: 61341 - DNA, 201 bp, Homo sapiens
tataatccattgccggtatgcaatttgacgctcaagtaaccccagatttagctgtcagggagcccctttcaggctggcttttgtgtcgtgtagtgcaacgmcatgcgtttttgagcacttcttcacccctgccctgatgccatatctgcctctcccagttctcaccagccgcagtgagttaacacgtgctcatctggtcaa

SEQ ID NO: 61342 - DNA, 201 bp, Homo sapiens
atcttaagttctgtcatctgtgcacatggatggtttagaatggtaacacacctttactttatgtgtatcttttctcccaggatactgcagtcgtatctccrgaaagagtcctggtgacccagcgaaaccagcttcatctcccagagaatgggatcctttgcatccttcctccacagacatggccttagtacctagaaatga

SEQ ID NO: 61343 - DNA, 201 bp, Homo sapiens
ctttcagccacagttagtgaagccttcaagaatctcagccacatcttcatggcagacacttcatggaggctgctttgaggcaaaatttatgcgttctgttkaacagatgacctctcaagagtctccttctcagttgaaaggggagaatttcaccaaaaacaactgtccggcccagagagagatctgaggtttctcctggtc

SEQ ID NO: 61344 - DNA, 201 bp, Homo sapiens
gacctgtacgcagggatgctgcactccatgagccggctgttgagcacaaagccatcaagcatcatctccaccaaaacgttcatcatgcaaaactggaactscaggaggaggcacagatataagagcaggatgaacaaaacatattgcaaaggagccagacgttctcagaggagctccaaggagaacttcataccctgctct

SEQ ID NO: 61345 - DNA, 201 bp, Homo sapiens
ccgaaggcttcggtgcggggacggggaggaaagactggggcctccggaacggggagtggggaagcaggcctggggctcgggtgcagagaggagggtttggwggggctgggggtgctcctgagtgggacgagagaggcggagttgggggctccgctgcagagaccgcgtttggggcgccccaggccagactaacggcctctc

SEQ ID NO: 61346 - DNA, 201 bp, Homo sapiens
tcctgcgagtcctggtggccttcagggcttagaaacccgcaggctgagtttaccttccagcaaagcaaaagcaaaaagtttaagtgaggcttttgaaaacytaggcaaaagatctctggaagcaggtaggtgcctgcccaagagcgattcatcttcatcacttccaaagaccaaccccacacacagcgcaactcgcccgca

SEQ ID NO: 61347 - DNA, 201 bp, Homo sapiens
cacaatcttggctcactgcaacttccgcctcccgggttcaagcgattcttctgcctcagcctcccgagtagctgggattacaggcgcgcgccaccacgccyggctaatttttgtagttttagtagagacggggtttcaccatattgaccaggctggtctcgagctcctggcctcgtgatccatctgcctcggcctcccaaa

SEQ ID NO: 61348 - DNA, 201 bp, Homo sapiens
ttcatcaacataacttgttagagatatacttggatttcactggaagattaagatgtttcaaaatgagctgttttctcctccacgtctgctctttattccartttactagcttgaaaagttttgcatctccagaagcacaggactagtacagtgaacacccttcacttgtttcacaattaacatgttgtcatatctgcgtta

SEQ ID NO: 61349 - DNA, 201 bp, Homo sapiens
cagaaccccagggcttcggacgccagggcaattccctgggtgcctcagatggggtggacaacaccgtcagaccgggagaccagggcagctcttcacagccyaactcagaagagaggtaggtgtgtttctgttggttgaatgtggtttatgtgagtgactgctctttggacagaggctttttatggtaggaatctttgcgcc

SEQ ID NO: 61350 - DNA, 201 bp, Homo sapiens
ctcgagttcttggtgtagaaattatgtgaataaagttgctcaattagaatttttagggttctctttgataggcctgtttttctgatgtgtgtgtttttttkgggggggggttatttgtttgtttgtttgtttgtttgtttgtttttgagacagtctctctctatcgcccaggctggagtgcggtggcacaatcttggctca

SEQ ID NO: 61351 - DNA, 201 bp, Homo sapiens
atttggactctttttttttctctttcagttatcaatttaacatacagatttttttttgtttgtgttcaattttatggttttttcccatcactgttggtttatttttttttaaatataggaaacatttacatgatgcaaaagtcaaagctatatgaagaggtttgtttagaagtcttacaccccttcccatccatgtaggta

SEQ ID NO: 61352 - DNA, 201 bp, Homo sapiens
tttatccttagacaatatctctttaagaggcagacactcagagtatttggactctttttttttctctttcagttatcaatttaacatacagatttttttttgtttgtgttcaattttatggttttttcccatcactgttggtttatttttttttaaatataggaaacatttacatgatgcaaaagtcaaagctatatgaag

SEQ ID NO: 61353 - DNA, 201 bp, Homo sapiens
aacagtaagtgtcatttatatgtctgtttcccagagtgccccctgggtcacagaaaccacccgttttcttatgggatgtgcttcttatcctccttggttgrgatagatgagaatttacacagagcttaaccagctccagcatctttcctggcccccgtgtcacactctgttgcctgccagaatacctggtgcatggttttc

SEQ ID NO: 61354 - DNA, 201 bp, Homo sapiens
gagtgcggtggggcgatctcagctcactgcaacctctacttcctgggttcaagcgattctcctgcctcagcctcccaagtagctgggactacaggcgcccrccaccatgcccagctaatttttgtattgtagtagagatggactttcaccatgttggccaggctggtctcgaactcctggcctcaagtgatccacctgcct

SEQ ID NO: 61355 - DNA, 201 bp, Homo sapiens
gccacgtcagaccaggaagagtcagttgcttgggccttagcagtaagtgctgcctttagtaatgaatggacagagggggcgcttgggggctcaggggtccrtcaaagcccatgtggcctgaggcgggcagcgctgcctgcacttttctggaagtcctctcctgaggctggcttttgctacttccaagtctcggatttcctc

SEQ ID NO: 61356 - DNA, 201 bp, Homo sapiens
aggagagcctcctgagctggagcactgaatttctgtttttgtttttggttcttttgagatggagtttcactctgtcacccaggctggagtgcggtggggcratctcagctcactgcaacctctacttcctgggttcaagcgattctcctgcctcagcctcccaagtagctgggactacaggcgcccgccaccatgcccagc

SEQ ID NO: 61357 - DNA, 201 bp, Homo sapiens
ccagggaactttcactggcattctccccctactccccagttctttgctattgcatcctcggacatcctccctagactccacccaccgctcagctgcctgctccgtgcaggtaacccccaccctcccaggggctgcacatggtgggtgctgcagtggggagctgtctggacacagaccagtctcatgggttagcggctcagg

SEQ ID NO: 61358 - DNA, 201 bp, Homo sapiens
ctgcccaagagcgattcatcttcatcacttccaaagaccaaccccacacacagcgcaactcgcccgcagcagacatctgaccttcacgttcagggaaatasttgtggaatatttagaaagtcagtgtcacccagcaaaactctttcagtcccagataaagaagtgccaggccacggaaggaatcgttacgatgaaattaaa

SEQ ID NO: 61359 - DNA, 201 bp, Homo sapiens
gcctgatgcccactcctgtgcccacttggggctttttcagaccaaaccaccagccgggtgactttcagccacagttagtgaagccttcaagaatctcagcyacatcttcatggcagacacttcatggaggctgctttgaggcaaaatttatgcgttctgtttaacagatgacctctcaagagtctccttctcagttgaaag

SEQ ID NO: 61360 - DNA, 201 bp, Homo sapiens; identical to SEQ ID NO: 14109

SEQ ID NO: 61361 - DNA, 201 bp, Homo sapiens
acctatgaaattctcagcattgctataagcatttgattttttttaaggaaacttcctgtttaatggaatctgaatccaagatttgctttaatttcactctrttcttcccattttcccttattcttcttgttgtctctctaattaaaaaaaaaaaaaacctaggcttttttttttctatccagaaagttgggttttcatgat

SEQ ID NO: 61362 - DNA, 201 bp, Homo sapiens
acatgtgtttggcatttcatggctgggacaatggagtagagggtaggaagacaagctgtagaacaaaagcaaagtgaggtagaaagtaacaggtcccagamgaggacagacttagagatgtgtaaccttggatcctctttttcacttagaatatgggtaaacttcttagcacaagactggattaagagaagttctttctgt

SEQ ID NO: 61363 - DNA, 201 bp, Homo sapiens
acataatttaaagcacttagtctccacaaagcaatttagaaaaatcttcacttgttagatcccatgaagtacctatgaaattctcagcattgctataagcrtttgattttttttaaggaaacttcctgtttaatggaatctgaatccaagatttgctttaatttcactctattcttcccattttcccttattcttcttgtt

SEQ ID NO: 61364 - DNA, 201 bp, Homo sapiens
ttgtcacccagacatattctccaacccagcattggaaatctgaacgaatcttttctctttttgtcctacaagtttgtcagagatgagaatggattgctgtstacattctacaaccagaccctagactttataccaggctgtgccacttcctcttcacttcactcagaggatggccccaaaactgaaaaggaaatgaaatca

SEQ ID NO: 61365 - DNA, 201 bp, Homo sapiens
tgtacattctacaaccagaccctagactttataccaggctgtgccacttcctcttcacttcactcagaggatggccccaaaactgaaaaggaaatgaaatmatcaaatataccaaatccgaatttgactttatttgatgactcaatattttccttccagtactctaatttttttttatggcaatggcctatatggcacaag

SEQ ID NO: 61366 - DNA, 201 bp, Homo sapiens
atagaacctattgatctatagtatcaacatggatcaatctcaaaagattatgccaagtgaaagaagttagacacaaaagatgttttgtattatttaatttmtatgaagtttctagaaaaggcaaaaccatggtgacagaagctaaattgttggttgcttggggtcacaggtggagcatggggacagatggcaaacagggct

SEQ ID NO: 61367 - DNA, 201 bp, Homo sapiens
tatacacacacatacatacacacacacacatacatataaatatatattttcaaatgtagtggttattttgttattgcagccctaggtgtggtttcagaggsacccagatctcagcagggctctggcacaagtgtggggaaagggaaaatggttctcactatgagggtcactgaagacatttgagggcatttacagagatca

SEQ ID NO: 61368 - DNA, 201 bp, Homo sapiens
tacatacacacacacacatacatataaatatatattttcaaatgtagtggttattttgttattgcagccctaggtgtggtttcagagggacccagatctcwgcagggctctggcacaagtgtggggaaagggaaaatggttctcactatgagggtcactgaagacatttgagggcatttacagagatcacatttgtgacac

SEQ ID NO: 61369 - DNA, 201 bp, Homo sapiens
actatggaatcttggccgactttttttaaggactagaacaagaaaaagactgattgatataaggttttctatcaaaaccactgaactattcttaagaataygcagagattccttttggcagtgtactcatggacaactagttgtcctttttatttatttcatattccccaaactattctgaaaagtatttcaaaatgttaa

SEQ ID NO: 61370 - DNA, 201 bp, Homo sapiens
ttaactaaaatgacacattttaaacccatataaaattacaagtcagcattaaaaaatctaaacaattgaatctagccttgatcaactgtttccaagttttyctatcagtactcaattgctgtttgtactttttacttgtgtagtagataagcaatagtgtggaaaaggtttaaaagaagtccttagaagaaaaacttaaaa

SEQ ID NO: 61371 - DNA, 201 bp, Homo sapiens
tttgctgttaatttattcagtgagaaattttcattttatatattgactattttatgtctggaattttcttttcactcttttttatatcttcaattttctcrtactttttatttccattaagttcttacacaattacatttgtgtccctggtctataatttctaccatttctgaatctgtttctgttggctaatttttcttc

SEQ ID NO: 61372 - DNA, 201 bp, Homo sapiens
ttagttcttgattataacaagcgttagtaaatttgaaaaaagaatccttcaggatgctaattataattaaagatagtaattggccaggcacggtggctcaygcctgtaatcccagcactttgggcggccgaagagggcggatcatgaggtcagaagttcgagactagtctgaccaacatggtgaaaccctgtcttaactaa

SEQ ID NO: 61373 - DNA, 201 bp, Homo sapiens
ttggagagagaggtgataggaagtatcatttgatgggctgaatgtaaggttagggagaaaggattcatgaatgtcgctaaggcttctggcccccaaaaccwggcggtggtgaagccactgaatgagatgaggagcataggggtggcgggcaagggatggaacccagattttaattttggccatgttaaggctgagataccc

SEQ ID NO: 61374 - DNA, 201 bp, Homo sapiens
tctcgctctgtcgcccaggctggagtgcagtggcgggatctcggctcactgcaagctccgcctcccgggttcacgccattctcctgcctcagcctcccaastagctgggactacaggcgcccgccactacgcccggctaattttttgtatttttagtagagacggggtttcaccgttttagccaggatggtctcaatctcc

SEQ ID NO: 61375 - DNA, 201 bp, Homo sapiens
ggtatttgtattttcattttcattaagtttaaaatatttttttttctttttcttttcttgtttttgagacagggtcacactgtgtcccccagactggagtrcagtggcatgatcgcagctccttgcagcctcacctcctgggtttatgtgattctcccaccttagcctcctgagtagctgggactacaggtgcacaccacc

SEQ ID NO: 61376 - DNA, 201 bp, Homo sapiens
gaggtgataggaagtatcatttgatgggctgaatgtaaggttagggagaaaggattcatgaatgtcgctaaggcttctggcccccaaaacctggcggtggygaagccactgaatgagatgaggagcataggggtggcgggcaagggatggaacccagattttaattttggccatgttaaggctgagatacccagccaatgt

SEQ ID NO: 61377 - DNA, 201 bp, Homo sapiens
tcttttttttttttttttttttttttttggtagagatggggttttgccaagttgcttgagctggtcttgaactcctgggctcaagcggtccctgaccttgkccacccaaagtgctgggaatacagacatgaaccaccgcacctggcctcaaaaactttttttaaagccatttttatataaaggctacagtatattttcctc

SEQ ID NO: 61378 - DNA, 201 bp, Homo sapiens
ttaatatgttagacatcttaattataaataaccagatgaggcagcttccttttttcataatgcttaatttctttcttttcccattctaggagctacagcgsactaagcaagaagtcctctctttgcgaagagagaattctacactagatgttgaatgccacgagaaagaaaagcacgttaatcagctacaaacaaaagtgg

SEQ ID NO: 61379 - DNA, 201 bp, Homo sapiens
ccagcctgggtgacagtgcaagactctgtctcaaaaaaaaaaaaaaaaaaaaaaaaaaacacgaaaaagaaagagcaaagaattcatataataaccaactytttaccctactgatacagttttatattgatgggggttttttagtatagttttttcctcttcaatctgtagtcttacaaaatcattgagatctctggaatt

SEQ ID NO: 61380 - DNA, 201 bp, Homo sapiens
ctcagtgaatttttgtttctagtttttgctttttctctcatttgtttctcatgaactcatggacttttatgtagtcactgtgtttcagtcaatcttttctkttttttgcccaatttatcttttaccattgggagtcctcaatgtgctccctttcctgagctttcttaagtagagaagcttctgattcagtgagagattttc

SEQ ID NO: 61381 - DNA, 201 bp, Homo sapiens
aactcatggacttttatgtagtcactgtgtttcagtcaatcttttctgttttttgcccaatttatcttttaccattgggagtcctcaatgtgctccctttsctgagctttcttaagtagagaagcttctgattcagtgagagattttcactatctcttaagtgtgttataatgtaacattttcttttcaaaggtttttgct

SEQ ID NO: 61382 - DNA, 201 bp, Homo sapiens
gaagtatataaaataaaaataaaaatcctctctttcaaagtcttactacctagagataatctataaacattttgatgtatttttttcagacttttctctaygtatatgtaaataatatgtaatttataaatatttgtttataaacttataactgtaaattatgtcatttatatatgtacccatataatgggtttttggttt

SEQ ID NO: 61383 - DNA, 201 bp, Homo sapiens
gggcttctgttgaactaatcacccaaatagtaaacatagtactcaataagtagtttttcaatctctacctcactctattcctccctcattttggagtactscttgtctattgtccatggaaacaagttagatctgaaagtttcttcataagggcatttgtttaaaactccagagtgactgaaggatttgtttgtatttctg

SEQ ID NO: 61384 - DNA, 201 bp, Homo sapiens
gccatggtggtttgctgcacctatcaactcatcacctgggtattaagccccacagaaatttttaaaatcttgctatagtgccacatttgttgttgctttgrcattgattacaggcttctttgtagcattatatattattgtcatatgaattattagaaaatatatgtagattttgtctatatttaaataccaaagttacca

SEQ ID NO: 61385 - DNA, 201 bp, Homo sapiens
atacgtgaagaaggtagattataaactgcagagtatcaacctttaaaaaacaatctgtacatgtaagcaacaaagaaaaatgttaagtctacattgtggcrgctctcacccgtggttacccttggaatcagttgtggagacatcagaaaattattgttaaaagttttaaagttactgtaatttattcataaattagaatta

SEQ ID NO: 61386 - DNA, 201 bp, Homo sapiens
attcaaaagctgtataatctcattcaaaaattcagcctgtcatttagctataaaaggtcacctttttaatcctcaagccattctaggagaacatataaatrtacaagtggcagacttatattagacacattttgaaagataaaaagcatagtatgagacagattacagtctacccctcagttgagaagcaaataaaaacac

SEQ ID NO: 61387 - DNA, 201 bp, Homo sapiens
agattttaactaacattttctcagtttatactactgggtatcatacataagattgtgaattttaagtaaactgtaagatattctagaagtgaaatctttcraagagttgcttgactagcagaaatatgtgcttcggaaagtaatacaataaggagtcctatgtggcagcttctaaaataagaaactttaatgacaaaaatt

SEQ ID NO: 61388 - DNA, 201 bp, Homo sapiens
agccaacaagtctttggcaaagttcttatggatggatttgtgaagatatcgctgatttgatctaatccttaaattgtaaagaacaagtaacttggatgttmctggcttgatgtttaaaagaaatgttttaggtaatttcaattgtgagcacctctttgcaaaggctagtttggagaacaaatcatcaccctcttgatgctt

SEQ ID NO: 61389 - DNA, 201 bp, Homo sapiens
agcttgcacacctaccttgaaaagccctctagttcaaagttatcctagccccatggtagataataaagcagagttgtgtggcatgataaacaagactggcstctgagatagtgctctcttaattattagttattataacagatgctaatgccacctgatcaacaaatactatttagaattaatttatcatctttaatcatc

SEQ ID NO: 61390 - DNA, 201 bp, Homo sapiens
aataccacctactttggtgatcattgatctaggtagttttgtgctagcagctatgttgattaaaacatgtacttttgaattacagtttttaaaaatgacgyttttatttttgacgttgaacctgtgatcttcctgatgtcttaaaatgttactgtcaagattgaatacattcaaggatgtttaactgtgggaatgtaaaat

SEQ ID NO: 61391 - DNA, 201 bp, Homo sapiens
ccaagtagctgggactataggcgcccaccaccacgcccagctaattttttgtatttttagtagaaacagatttcaccctgttagccaggatggtcttgatytcctgacctcatgatctgcctgcctcggcctcccaaagtgttgggattacaggcgtgagccaccgcacccagccaagagcacacttctttataagtcttg

SEQ ID NO: 61392 - DNA, 201 bp, Homo sapiens
atctcttatcctcctgacactgtaattgtaggtgctgaaatgcttgttttctgtcagtgtcatccagtacagatctctaacatttgtgtgtgactggaggygccccaaggccctgttgcctcaatttctttatcttggtagtgtttggcccacagtgtgtattcagagacagattttgtgtacagatagcattattcagtt

SEQ ID NO: 61393 - DNA, 201 bp, Homo sapiens
ttttattaaagcactagacaatgaaagaaaagtccaccttagtggaagaggattttacctgtctgaggtataaaaaaaagctggaatattggcctgcctcyggtaggtaggagagaaacactgtaatgcagatcagcagcactatggaatcttggccgactttttttaaggactagaacaagaaaaagactgattgatata

SEQ ID NO: 61394 - DNA, 201 bp, Homo sapiens
gctaagaccaccaccaagctgtccccatatactcgtccaagataagctccaattgcaggactggtgactaaacttgcagcaaatgttgctgaaacctgcartaaattaaggatagacagagattagtcaggctacttttttcctcaacaccacataactcctttcataatcttgatttatgtcaggccttctgttgcacac

SEQ ID NO: 61395 - DNA, 201 bp, Homo sapiens
taaaaaattttgtgtaggaaaaggctttgaacatgtcctgaaaagctataattttgttttctttaatatccttgtaaatattgctatattctaatcaaaaktattacatattaaggagcctatcttaatattttgtgttaaactctaatgtagacattagcagaaaaaaaacaagaattagataagttacggaatgaatgg

SEQ ID NO: 61396 - DNA, 201 bp, Homo sapiens
aggttgcagtaagccaagatcacacctctgcactccagcctgggtgacagagcgagactccgtctcaacaaaaaacaaactatatatatatacacacacayacatacacacacacacatacatataaatatatattttcaaatgtagtggttattttgttattgcagccctaggtgtggtttcagagggacccagatctca

SEQ ID NO: 61397 - DNA, 201 bp, Homo sapiens
gttttaagaacaaaagaggcatttgatacaatccaggaacaaaaggtctacttttaaatttttctcagaaattgataatcatatttataagtaaacacaamtgccctaattattcatgtttttaaaaaatatatcaggtggttttagaagaaaatggtgagaaaaatcaagtacaactaggaaagcttgaagctacaataa

SEQ ID NO: 61398 - DNA, 201 bp, Homo sapiens
taggctaggtatggtggctcacacccgtagtcccagcactttaggaggccaagacaggaggattgcttgagcctaagcttgaggttacagtgagctactatttgtgccactgtactccagcctgggtgatagagcgagatcctgtctctgaaaaaaaaaaaagaaaaagaaaaaaattaaaattacatacctggctcacat

SEQ ID NO: 61399 - DNA, 201 bp, Homo sapiens
ataaaaaaccagcagcactagaaaacaaagctgtctgcaatataactatgatacactgatgttgttggatttctttacttctgagaagaaattactcaaamggccagatctagtaaaaacatttaaaaacaacaaactttcttttaggacttagttattcgtctgactgatgacacggatccattttttttatataacctt

SEQ ID NO: 61400 - DNA, 201 bp, Homo sapiens
tataaaaatcagagttccttagcttagttcttgattataacaagcgttagtaaatttgaaaaaagaatccttcaggatgctaattataattaaagatagtrattggccaggcacggtggctcacgcctgtaatcccagcactttgggcggccgaagagggcggatcatgaggtcagaagttcgagactagtctgaccaaca

SEQ ID NO: 61401 - DNA, 201 bp, Homo sapiens
ctgcacaccagccgaggcagcgagccaacatgagccaagtgctgttccaccaactagtcccgttgcaggtgaaatgcaaagactgtgaggagaggtaaggyccgcgtcatccagtgcccgcgggtggcggttggggtcaggccaatggggaaagatggcggttctggcccgtgggatccaccttgcacctaggtgtcgagt

SEQ ID NO: 61402 - DNA, 201 bp, Homo sapiens
tgcttaatttctttcttttcccattctaggagctacagcggactaagcaagaagtcctctctttgcgaagagagaattctacactagatgttgaatgccaygagaaagaaaagcacgttaatcagctacaaacaaaagtggcagttttagaacaggaaatcaaggataaggaccagcttgttttaagaacaaaagaggcat

SEQ ID NO: 61403 - DNA, 201 bp, Homo sapiens
aatacaatgtattattaaaattaatttcacctgcttttaaaagtctttttaaaatgtgacttctagaaaatttaaaagtaggctaggtatggtggctcacrcccgtagtcccagcactttaggaggccaagacaggaggattgcttgagcctaagcttgaggttacagtgagctactatttgtgccactgtactccagcct

SEQ ID NO: 61404 - DNA, 201 bp, Homo sapiens
aaatgcttgttttctgtcagtgtcatccagtacagatctctaacatttgtgtgtgactggaggtgccccaaggccctgttgcctcaatttctttatcttgrtagtgtttggcccacagtgtgtattcagagacagattttgtgtacagatagcattattcagttgggttaaccatctgattcacctagatggtttaaatta

SEQ ID NO: 61405 - DNA, 201 bp, Homo sapiens
aagtaggctaggtatggtggctcacacccgtagtcccagcactttaggaggccaagacaggaggattgcttgagcctaagcttgaggttacagtgagctaytatttgtgccactgtactccagcctgggtgatagagcgagatcctgtctctgaaaaaaaaaaaagaaaaagaaaaaaattaaaattacatacctggctca

SEQ ID NO: 61406 - DNA, 201 bp, Homo sapiens
cagatagcattattcagttgggttaaccatctgattcacctagatggtttaaattaatttttcatttatttggtattaactttttaaaaataatgtgtaartatgggaagctttgaaaggtacaagaggatgtactatctaaaagtccctactgtggtccccagtcctcttagagaaaaatactgttaggaatttcttatg

SEQ ID NO: 61407 - DNA, 201 bp, Homo sapiens
agtatctctattcatgtgcttatttaacatcaatattaaaataccactttggtgatatttctatttgaatcttttgaccattgctaaacaaggttgtcttkttattgaattataagttctttgtatattctggatacaagtcctttatcaagtatatgattagcaaatattttctcccagtggcttcccttttcattttct

SEQ ID NO: 61408 - DNA, 201 bp, Homo sapiens
caaaaatcttatgattcttcactataacgtcctttgaatcagaaatcagtcccttttaaaactaattcagcccaacacaatattcagtccttatttatcamaaggtatttgtctcacatttaccgaaatgcatcactgtcctatttctggctattcagtagtgatctattattgtgcctatagtagtcattctattactag

SEQ ID NO: 61409 - DNA, 201 bp, Homo sapiens
agtaggctaggtatggtggctcacacccgtagtcccagcactttaggaggccaagacaggaggattgcttgagcctaagcttgaggttacagtgagctackatttgtgccactgtactccagcctgggtgatagagcgagatcctgtctctgaaaaaaaaaaaagaaaaagaaaaaaattaaaattacatacctggctcac

SEQ ID NO: 61410 - DNA, 201 bp, Homo sapiens
tagcctcctgagtagctgggactacaggtgtgtgccaccatgcccaggtacctttttttgcatttttttgtagagatggagtttcaccatgttgctcaggstgatttcgaattcctgggctcaaggtatctgcctgcctcagcctcccaaagtgctggaattacaggcgtgagccaccatgcctggcccatatctttcctt

SEQ ID NO: 61411 - DNA, 201 bp, Homo sapiens
gaaaatggtcaccttctcaatttctacaaaatggtttgtttggattttgataggtatataaggaatttataggtcagttttcaaagaaatgctgttttggyagtattgtgtcttccaatccatgaatattaagagtctttccatttatttagagctttactttctctcagtaatgttttgcagttttcaatatataagtct

SEQ ID NO: 61412 - DNA, 201 bp, Homo sapiens
aacctttaatatattcctattatctgtataataggggtcagcaaactggagcacatgggccagttggctcactgttttcgtaaataaacttttcttggaayacagccatgctcatttgtttacatattgtagctgcttttgcacaggaagggcagagatgagtaattgtgacagagaccttatggcccgcaaagcctaaaa

SEQ ID NO: 61413 - DNA, 201 bp, Homo sapiens
gctgttccttgtgcctcaaatgcttttttctttcataactttcaggtatgtcttaaatcctttcactataaggacccttcaaagttgcctaagttgaaatraattgccattattcagttattagatagtgtggtgtaggtgaaagatctgagttttcatttgggctctgtaatgtgaccttaaaccattatttgggcctta

SEQ ID NO: 61414 - DNA, 201 bp, Homo sapiens
tagcctggagtgcagtggcacattcttggctcactgcaacttctgtctcccaggctcaggtgatcatcctacctcagcctccctagtaactgggaccacargtgcatgccaccatacccccagctaattttttgtaattttggtagagacagggttttgccatgttgcccaggctggtcttgagctcctgagctcaagtga

SEQ ID NO: 61415 - DNA, 201 bp, Homo sapiens
ggttttgccatgtttcccaggccaatctcaaactcctgggctcaagtgatctgcctgccttggcctcccaaagtgtggggattacaggcatgagccaccaygcccagccctattcttttcaagtacacatggaacactaaccaagatagactacgtcctaagtcctaaaccagtctggaattaaactagaaatctataaca

SEQ ID NO: 61416 - DNA, 201 bp, Homo sapiens
agtacagtggtgtgaacagaacttgtggcagccttgacctcccaggatcaagcattcctcccacctcagcctcccatgtagtcaaatatttttttctgcaraacactcttctttcttttaggactcaaaagacatgaatataaatctttattttcctaaaggtccacaaccttctgttcttttcttccattcttatttttt

SEQ ID NO: 61417 - DNA, 201 bp, Homo sapiens
caccaataagcggggcactaaggaatgacaacaaaccctaaaaaaattaaatgaaaaaaatgaataccacacatctatgagcatgaaccaaaaataaatcrttttactcctatagaaaaattttcaacaactttgtttctaaagtaaatatatcacaaacttttaaataaacaattgcttatctatatataaatttaaaat

SEQ ID NO: 61418 - DNA, 201 bp, Homo sapiens
tttcttttaggactcaaaagacatgaatataaatctttattttcctaaaggtccacaaccttctgttcttttcttccattcttattttttctgtttttcaratttgattatttctattgatccgccttcaagtttactgttttctctgtccattctactatcaagcccattcagcggtttttttctgttctaaaatttcca

SEQ ID NO: 61419 - DNA, 201 bp, Homo sapiens
aactctggtttttaagcattttatccaatctcaaatagaatctcacataaaagctttcatgaccaaaaaccagtagcctttaatctagccaaatgaaccayacaatttgatcatgttgaatgagaattacctgttcaaagtggtgctgagggcttgtgtttgttcccaagtctgttcctgttattggcagttctttaagtt

SEQ ID NO: 61420 - DNA, 201 bp, Homo sapiens
ttttctctgtccattctactatcaagcccattcagcggtttttttctgttctaaaatttccatttcgttttctttccttttttttttttttttttaatgaracttttttacattcatttgaacagtgttattagagcacggttataatgggtgatttgaagtggtttttctgataattccagtatttgtgtcatcttgggg

SEQ ID NO: 61421 - DNA, 201 bp, Homo sapiens
accttaaggaaatggtagcagagacatttgctaatatctaagaagttacatatatagtttttaattaaaggatgtataataaaacaaatagcttagtggcragaaattggtgctaataaacaaaaggtttttcaaaagaaattgtaacatctttggaaaactgtctggttctaagttcccacttcctttagttcccacgga

SEQ ID NO: 61422 - DNA, 201 bp, Homo sapiens
ctggcgagggccaagtctcttacgccttcccctcgtttctccctccccgcctcctccgcagaagccgagcgccaaactcaaactttatcaggacccggacstctcaggctaatcccgagggccgggcctgttgggcttttctgcacaccagccgaggcagcgagccaacatgagccaagtgctgttccaccaactagtccc

SEQ ID NO: 61423 - DNA, 201 bp, Homo sapiens
tcactgcaccctcgacctcccaggatcaagcaatcctcccatctcagcttcctgagtagctgggactacaggcacacaccaccacaccgggctttctttcytttttttttttttttttttttttttggtagagatggggttttgccaagttgcttgagctggtcttgaactcctgggctcaagcggtccctgaccttggcc

SEQ ID NO: 61424 - DNA, 201 bp, Homo sapiens
cgccattctcctgcctcagcctcccgaatagctgggactacaggcgcccgccacctcgcccggctaattttttgtatttttagtagagatggggtttcacygtgttagccaagatggtctcgatctcctgacctcgtgatccgcccgcctcggcctcccaaagtgctgggattacaggcgtgagccaccatgcccggccta

SEQ ID NO: 61425 - DNA, 201 bp, Homo sapiens
ggggtttcaccgtgttagccaagatggtctcgatctcctgacctcgtgatccgcccgcctcggcctcccaaagtgctgggattacaggcgtgagccaccaygcccggcctatttaaattttttaactcttttagttgaggaagggttgagagcctgggcactgtacaaacacccctccttgactgccagtcatgctggtcc

SEQ ID NO: 61426 - DNA, 201 bp, Homo sapiens
gttcaatatcaacagcagcatgaacaacagaaaaaagatttagaaatcctccatcaacaaaacatccaccagctacaaaacagactgtctgagttagaagyggctaataaagacttaaccgaaagaaaatataaaggagactccactattagagaacttaaagcaaaactttctggtgttgaagaggtattgaatgttgtt

SEQ ID NO: 61427 - DNA, 201 bp, Homo sapiens
cttaattagactattttttaaatatcctggctatcatcagccttgtatcatttaatgttccaagtttacaactgaaatcattagttctttttcttttcactttttttttttttttttttttaaatagagacaaggtttcaccatgttggccaggctggtcgtgaactcctgatctcaagtgatccgcctgcctcaacctcc

SEQ ID NO: 61428 - DNA, 201 bp, Homo sapiens
tgccacttgcactccagcctgggtgacagtgcaagactctgtctcaaaaaaaaaaaaaaaaaaaaaaaaaaacacgaaaaagaaagagcaaagaattcatwtaataaccaactctttaccctactgatacagttttatattgatgggggttttttagtatagttttttcctcttcaatctgtagtcttacaaaatcattga

SEQ ID NO: 61429 - DNA, 201 bp, Homo sapiens
tcacaatcttggctcactgccacctctgcctccggggttcaagcgatttttctgcctcagcctcccgagtagctgggactcaggtgcccaccaccatgccygctaatttttgtatttttagtaaagacagggttccaccatattggccaggctggtttcgaacttctgaccttgtgatccagctgcctcggcctcccaaag

SEQ ID NO: 61430 - DNA, 201 bp, Homo sapiens
agcggtttttttctgttctaaaatttccatttcgttttctttccttttttttttttttttttaatgagacttttttacattcatttgaacagtgttattaragcacggttataatgggtgatttgaagtggtttttctgataattccagtatttgtgtcatcttggggttgacttcttctggtttaacttttcccttatga

SEQ ID NO: 61431 - DNA, 201 bp, Homo sapiens
tgctttgtagtatgaattccttttctacctttcgtactatagcttctttttttttttttttgagacagaatttcgctcttgttgcccaggctggagtgcartggcatgatttggctcattgcaacctttgcctcccaggttcaagcaattctcctacctcagcctcccaagtagctggaattacacatgtgccaccatgcc

SEQ ID NO: 61432 - DNA, 201 bp, Homo sapiens
atagctgggattacagatgtgcaccaccacccccagttaatttttgtatttttagtagagatggggtttcaccatgttggtcaggctggtctcaaacttckggcctcatgtgattgacccacctcagcctcccaaaatgctgggatcacatgcgtgagccaccatgcctggctgtcagttcaaattttaaagactttgtca

SEQ ID NO: 61433 - DNA, 201 bp, Homo sapiens
aagataagtacagaactctgctaaataagccaggaaactgatgagctgctaatattggccaaaatgatcagcattgtttggcattaattttcagttgaaargagggaaatatagcaaacagtgaacaaaggttatttaccataagcctgccttttgtatgaaaagttagttaacatacacaactgtgatattagaaaagtt

SEQ ID NO: 61434 - DNA, 201 bp, Homo sapiens
ctgtgtgtttaaatatattagtacaatatcgtgcatattgtcttgtgatttttaaaatctccatattatttctcttatgttcttaatttgttttgtttaaygcgactagatggtttttctattgtttagtgttttcgaagaactagtttttcatttcattaattagttctacactgtttctccccctatttcgttaatttc

SEQ ID NO: 61435 - DNA, 201 bp, Homo sapiens
tctgtggccaacattcatcagtaaatttttttgagacaggtctctcaaggtctctcactgtgtcgcccaggttggagttcactggcctgattttggctcastgcaacctccgcctctgagactcaagtgatcctccaacctcagcctcccaagtaactgggactacaagcatgcgccaccctgcccagctaatttttgcat

SEQ ID NO: 61436 - DNA, 201 bp, Homo sapiens
taaatatattagtacaatatcgtgcatattgtcttgtgatttttaaaatctccatattatttctcttatgttcttaatttgttttgtttaatgcgactagrtggtttttctattgtttagtgttttcgaagaactagtttttcatttcattaattagttctacactgtttctccccctatttcgttaatttctatttacta

SEQ ID NO: 61437 - DNA, 201 bp, Homo sapiens
cagcaggaaaggtgatgctagacatggctgctactgccccagcagcccacatcatcctataaggagagcagcaaaacaaaaacagtaaattcttctccacygtacctgaaagtcaaactacataattaagtaattcttactgtgaaatggctgtagagaaaaggagaactgaacttgcttactaggtgactatgggcaagt

SEQ ID NO: 61438 - DNA, 201 bp, Homo sapiens
agattacagtctacccctcagttgagaagcaaataaaaacacaagggctaacaccaaaattaaaaatattaacattaaaatatttatacttaccaaggttytgaaccaaagccataccatgccaactgtaatatttgaaatcctagacccagtaaaatggtgttcttatttccaattgacctcataagtaaactcaagact

SEQ ID NO: 61439 - DNA, 201 bp, Homo sapiens
aatattaacattaaaatatttatacttaccaaggttctgaaccaaagccataccatgccaactgtaatatttgaaatcctagacccagtaaaatggtgttyttatttccaattgacctcataagtaaactcaagactatggtctgaaaaaaaaaaaaaaagatttatcagaataaagttttaaaaagtgacttctttcaat

SEQ ID NO: 61440 - DNA, 201 bp, Homo sapiens
caaagccataccatgccaactgtaatatttgaaatcctagacccagtaaaatggtgttcttatttccaattgacctcataagtaaactcaagactatggtytgaaaaaaaaaaaaaaagatttatcagaataaagttttaaaaagtgacttctttcaatctacactataaaaggactattggcacttttctacaatttggc

SEQ ID NO: 61441 - DNA, 201 bp, Homo sapiens
atttttatgaataggaagaaaaattatcattgatgcaatcactagatgatgctactaagcaactggactttacacgaaaggtaattcaaatttcattttgyctttgtaagtcatccagacattggcactgaattgcttccttgactcagttccaagcttttatgtattttctttcaaagcatgcttccgttgaatttccat

SEQ ID NO: 61442 - DNA, 201 bp, Homo sapiens
aagtagcatcctgggtgaatttcaggaagtacttaaatagaagctgcttaagaacaaggcattctgaggcagagcaggtgcctaaattactaattttccaragtagagatgatatattatacttcttacatgttattccttatgcctgctgtacctcttcattttctagcttggtgcataagtggtttagatttttctagg

SEQ ID NO: 61443 - DNA, 201 bp, Homo sapiens
tcctcaacaccacataactcctttcataatcttgatttatgtcaggccttctgttgcacaccctcccttttctcttcctacctgtgccatttatctttttytcttgtgggggcgagagtgggggaactgggtcttgctctgtcgcccaggctggagtgcagtggtgccatcacggctcactgtagtcttgacctctcaggc

SEQ ID NO: 61444 - DNA, 201 bp, Homo sapiens
gcacattccagcagcaacacaatcagaagtggaatttctcctaacctgaatgtggtaagatttaaaacaagatgtgagtgatcttagtgaatttcctgaamcaaaagtatttccagattgttaggaagtttccatgatttaaggtgctgataccaatacaaagtggagtcctacaattgcactgaaatagagtttaagttg

SEQ ID NO: 61445 - DNA, 201 bp, Homo sapiens; identical to SEQ ID NO: 61425

SEQ ID NO: 61446 - DNA, 201 bp, Homo sapiens
tcatacaacatgtagtttttttgtgtgtctttcttctttttttttgagataaaatctcattctgtcatccaggatagagtgcagtggcacgatcatggctyattgcagcctcgacctccctgggctcaggtgatcctcctatcttagcctcctgagtagctgggactacaggtgtgtgccaccatgcccaggtaccttttt

SEQ ID NO: 61447 - DNA, 201 bp, Homo sapiens
cagcagtgagctgagatcatgccacttgcactccagcctgggtgacagtgcaagactctgtctcaaaaaaaaaaaaaaaaaaaaaaaaaaacacgaaaaaraaagagcaaagaattcatataataaccaactctttaccctactgatacagttttatattgatgggggttttttagtatagttttttcctcttcaatctgt

SEQ ID NO: 61448 - DNA, 201 bp, Homo sapiens
gagagaagagaagaggaaaggaaaggagaggaggagaaaggaaaaggggaaaggggaagagaaaaggggaaggaaagggttaaaaaagggaaaaggcttarggaaaaggcttaaggaaaaggggaaaggggaagggaaaggaaaaggaaagaaaaagaaaaaagaagggaaagggaaaaggggaggggaaaggaaagggaa

SEQ ID NO: 61449 - DNA, 201 bp, Homo sapiens
cagtggcacgatcatggcttattgcagcctcgacctccctgggctcaggtgatcctcctatcttagcctcctgagtagctgggactacaggtgtgtgccaycatgcccaggtacctttttttgcatttttttgtagagatggagtttcaccatgttgctcagggtgatttcgaattcctgggctcaaggtatctgcctgcc

SEQ ID NO: 61450 - DNA, 201 bp, Homo sapiens
cccatatctttccttttcactcagtatactgtgtttgaggttcatccaggctgtaatgtgtgtcagtagttcttttcttttaattgctcagtagtatttcrttgtattgatatgccacaatttgttcattcatcagttgatggacatttgagttgttttaagtttttggatgttacagattaagctgctgtgaacatatgt

SEQ ID NO: 61451 - DNA, 201 bp, Homo sapiens
attttcctaaaggtccacaaccttctgttcttttcttccattcttattttttctgtttttcagatttgattatttctattgatccgccttcaagtttactsttttctctgtccattctactatcaagcccattcagcggtttttttctgttctaaaatttccatttcgttttctttccttttttttttttttttttaatga

SEQ ID NO: 61452 - DNA, 201 bp, Homo sapiens
cttctgttcttttcttccattcttattttttctgtttttcagatttgattatttctattgatccgccttcaagtttactgttttctctgtccattctactrtcaagcccattcagcggtttttttctgttctaaaatttccatttcgttttctttccttttttttttttttttttaatgagacttttttacattcatttga

SEQ ID NO: 61453 - DNA, 201 bp, Homo sapiens
tcatgtgattgacccacctcagcctcccaaaatgctgggatcacatgcgtgagccaccatgcctggctgtcagttcaaattttaaagactttgtcatgtcrtgctgtttggatctgtctcaagtgtgctattctgtgaccttggcagtagtttaccccatagttcggttcccaaagcctttggtatgctgattagggtcag

SEQ ID NO: 61454 - DNA, 201 bp, Homo sapiens
aaactaaaacctgctcataacctcatagtatgcaaccaaagaatactaattcattttatcactttcattggtaaaacttttaaattcaacacctgaaaatyatgagggaaaatgattacctcttgagatatattattgatgacatttaaagggaaaagtcctaaatttaccttaaataactgaaatgaattaagccttcat

SEQ ID NO: 61455 - DNA, 201 bp, Homo sapiens
tctgtgaggaattaattcttcttttgtcttataatgttgttattttgacttcattttctctgaatatagaactttaggttggcaagtttttttcctatctrtattttgaagatgttattccgttgttgcctggattgaatactttctggcaagatgtcagtagtcatgtttatatataatgtttcctttatataaagtgac

SEQ ID NO: 61456 - DNA, 201 bp, Homo sapiens
cccatataaaattacaagtcagcattaaaaaatctaaacaattgaatctagccttgatcaactgtttccaagtttttctatcagtactcaattgctgtttrtactttttacttgtgtagtagataagcaatagtgtggaaaaggtttaaaagaagtccttagaagaaaaacttaaaattgaacaaattctatttgttagtt

SEQ ID NO: 61457 - DNA, 201 bp, Homo sapiens
tagttttattatgcagttaaatctgtatcagtggacttttaaaacttggtactactactaaatctactatatcatgaatattcatttatttttatagtatsagaacttgggttgatttcaatgttaataaactaggcaaaacaaataactgttagaaggtacaattttcttctcttccctgtaactgaaagttttaagaat

SEQ ID NO: 61458 - DNA, 201 bp, Homo sapiens
tttgcccaatttatcttttaccattgggagtcctcaatgtgctccctttcctgagctttcttaagtagagaagcttctgattcagtgagagattttcactrtctcttaagtgtgttataatgtaacattttcttttcaaaggtttttgctacagttagtttctccagcagctattttggataactcacctgcatttttaaa

SEQ ID NO: 61459 - DNA, 201 bp, Homo sapiens
ctggcagaatagtttgagaagtacttgtgcataggtattttttactaatttctccctttattttctgaattatataagcatttgtgctctatttgattaaygtttatgagcactttcacctatatacctctgtccaattctggattctctaagatacagcataggatgtggaacactgtggtctctccctctcagggctta

SEQ ID NO: 61460 - DNA, 201 bp, Homo sapiens
tgaaaaaataagtttctaagttttattggtactgttctctttcaaacacatacctacatattagatttagttactttgggaatattgggctatttgtactrtctttacttagggtgttttggaaaataaatattttgtgggttattagaattctgcttaaaacacctgtgaagtttgaagcttttgctgaatttattgatt

SEQ ID NO: 61461 - DNA, 201 bp, Homo sapiens
agtcattctcaattgtatatttctgcataaatgagaatacaagatcattcttctacctttgaggctatacatgtaataatgtagtagctcatatatgatayaaagtgttaattcttacttctacataagcaccaaaacctaaatggtcacttaaggaccttgttcctcatggactgtgtgtgtcatgctgtgtcagcaatg

SEQ ID NO: 61462 - DNA, 201 bp, Homo sapiens
tgagtttttagagtctttctagtcaaatgctatagatcagtgcatgtcaaactttaaattatctggggatcttgttaaaatgatttagatttgagatggascctaagaatctgcatttctaacaggcttccaggatgatgctgatgctatactttgagtagcatggctatagatgattacattgtaaactgtgtaatttta

SEQ ID NO: 61463 - DNA, 201 bp, Homo sapiens
tctagccaaatgaaccatacaatttgatcatgttgaatgagaattacctgttcaaagtggtgctgagggcttgtgtttgttcccaagtctgttcctgttaytggcagttctttaagttccacatggaatatgtagaaaatgaatccatagagggccggtcccagaccattgcataatcctcgaattcctgttatcattcct

SEQ ID NO: 61464 - DNA, 201 bp, Homo sapiens
aaggactgctataaacgctgcaacactttctggtgaaaatttcattatctagaagggtttccagaaaaggtaacattaatgaatacaaatgtataccagayagaaaaccactgcagctacttgtatattaacatttaatgggccagaaaaaaataaatgtaattcatttataaacaaagaattcctcagaggaaatacaac

SEQ ID NO: 61465 - DNA, 201 bp, Homo sapiens
taagatattcctttttagtgactgcagagtattcattttttgggtttaacttaaattatttaactacttgcctaaatggtggtcatttaaatgcttcgaarttttggttattttaagcaatactgcaagaagcactcttagtttctagaagtgaaactgcaacatatctgtataaaatattgatggatactgcaaatttgc

SEQ ID NO: 61466 - DNA, 201 bp, Homo sapiens
ttggattgaatcatcatgatctatgtgaggcatccatcctggttttggaagagctcaaatcagaagttcccagcagggcttttatgttgctctggccatgkaatcaagccagacatacgtaactggttagaccagctgcaaataatcaataaaaggagtgaccagtggagcttcagactttatttatttatttacttattt

SEQ ID NO: 61467 - DNA, 201 bp, Homo sapiens
gatctatgtgaggcatccatcctggttttggaagagctcaaatcagaagttcccagcagggcttttatgttgctctggccatgtaatcaagccagacataygtaactggttagaccagctgcaaataatcaataaaaggagtgaccagtggagcttcagactttatttatttatttacttatttatcgaaatgaagtctct

SEQ ID NO: 61468 - DNA, 201 bp, Homo sapiens
agtatttagtcaaagtccaagcgagtctaccctaagacctacagtaatcgaagttcccaatatttgtattactaaagattcgggttttatttaaaggaaawtcacatacatcacgaactccaactgaaaatatgaactgagtttgataaagcagtttcaagaacgctacttaagagaatttctttttcatccattttaaat

SEQ ID NO: 61469 - DNA, 201 bp, Homo sapiens
ctgtgctctggctggcagttggggttggccagtggaagcactggcaggagatggagggaggaagagagagaggtggtggaatttgttcacagaatctcttsctgccagaccaccagttggctgtgggtccttcctctattgcagcccacagctcctgccctatagctgcaactggcaccatagaggtagaacttccactct

SEQ ID NO: 61470 - DNA, 201 bp, Homo sapiens
cttgctctggggcctacttttgagggcggcttcaaaagccactctgtgctctggctggcagttggggttggccagtggaagcactggcaggagatggaggsaggaagagagagaggtggtggaatttgttcacagaatctcttgctgccagaccaccagttggctgtgggtccttcctctattgcagcccacagctcctgc

SEQ ID NO: 61471 - DNA, 201 bp, Homo sapiens
ctgaacattctggagctgtactctatacaagttctgacagtaggataaggcttctttgtttctcttttcaatttctttttggttatcatttaccatataaycactttagaataatttgacacatataagggaaatctgtttctctattaccccttgctctatatcaagtaggattgtgagtgtacaaagtagttaagggaa

SEQ ID NO: 61472 - DNA, 201 bp, Homo sapiens
agggcatccttaaagcttttcctaggtagttcctcccagctcaggctctggatgatcctgaggatgtcctcctcactccctatcttctgccccaggcgacsgggtaccatgtcctgtggtttccctgcttcctggggaatgtgctctgtatgggaaaaacagaaaataagaccatttgctgagcatctaagaaaatgtttg

SEQ ID NO: 61473 - DNA, 201 bp, Homo sapiens
ataaaatactggcaaaccgaatccagcaacacatcaaaaagctgatccaccatgatcaagtgggcttcatccctgggatgcaaggctggttcaacatacasaaatcagtaaacataatccatcatataaacagaaccaatgataaaaaccacatgattatctcaatagatgcagaaaaggcctttgacaaaattcaacaac

SEQ ID NO: 61474 - DNA, 201 bp, Homo sapiens
gatgaacattgatgcaaaaatcctcaataaaatactggcaaaccgaatccagcaacacatcaaaaagctgatccaccatgatcaagtgggcttcatccctrggatgcaaggctggttcaacatacagaaatcagtaaacataatccatcatataaacagaaccaatgataaaaaccacatgattatctcaatagatgcaga

SEQ ID NO: 61475 - DNA, 201 bp, Homo sapiens
gaagagacacaacaaaaaaagagaattttagaccaatatccctgatgaacattgatgcaaaaatcctcaataaaatactggcaaaccgaatccagcaacayatcaaaaagctgatccaccatgatcaagtgggcttcatccctgggatgcaaggctggttcaacatacagaaatcagtaaacataatccatcatataaaca

SEQ ID NO: 61476 - DNA, 201 bp, Homo sapiens
ggcagaaataaaggtgttcaatgagaacaaagacacaacataccagaatctctgggacacatttaaagcagtgtgtagagggaaattgatagcactaaatkcccacaagagaaagcaggaaagatctaaaattgacaccctaacatcacaatgaaaagaactagagaagcaagagcaaacacattcaaaagctagcagaag

SEQ ID NO: 61477 - DNA, 201 bp, Homo sapiens
gcaattaaactagaactcaggattaagaaactcactcaaaaccactcaagtacatggaaactgaacaacctgctcctgaatgactactggttacataacgmaatgcaggcagaaataaaggtgttcaatgagaacaaagacacaacataccagaatctctgggacacatttaaagcagtgtgtagagggaaattgatagca

SEQ ID NO: 61478 - DNA, 201 bp, Homo sapiens
agcaaatgtaaaagaacagaaattataacaaactgtctctcagaccacagtgcaattaaactagaactcaggattaagaaactcactcaaaaccactcaastacatggaaactgaacaacctgctcctgaatgactactggttacataacgcaatgcaggcagaaataaaggtgttcaatgagaacaaagacacaacatac

SEQ ID NO: 61479 - DNA, 201 bp, Homo sapiens
tttaacaccccactgtcaacattagacagatcaacgagacagaaagttaacaaggatatccaggaattgaactcagctctgcaccaagcggacctaatagrcatctacagaactctccaccccaaatcaacagaatatacattcttctaagcaccacatcacacttattccaaaattgaccacatagttggaagtaaagca

SEQ ID NO: 61480 - DNA, 201 bp, Homo sapiens
aggggttgcaatcctagtctctggtgaaacaggctttaaaccaacaaagatcagaagagacaaagaaggccattacctaatggtaaagggatcaattcaayaagaagagctaactatcctaaatatatatgcacccaacatgggagcacccagattcataaagcaagtccttagagacctacaaagagacttagactcccc

SEQ ID NO: 61481 - DNA, 201 bp, Homo sapiens
caagcaaatggaaaacaaaaacaacaggggttgcaatcctagtctctggtgaaacaggctttaaaccaacaaagatcagaagagacaaagaaggccattayctaatggtaaagggatcaattcaacaagaagagctaactatcctaaatatatatgcacccaacatgggagcacccagattcataaagcaagtccttagag

SEQ ID NO: 61482 - DNA, 201 bp, Homo sapiens
gcatagctgaacaaaaggcagcagacacttctgcagacttaaacgtccttgtctgacagctttgaagagagtagtccttctcccagcacggagtttgagayctgagaatggacagactgcctcctcaagtgggtccctgaccccgagtagcctaactgggaggcacctcccagttggggccgactgacacctgatatggct

SEQ ID NO: 61483 - DNA, 201 bp, Homo sapiens
tccacctcccgggttcaagtgattctcctgcctcagcctcctgagcagctgggattacaggcatgcaacaccgtggccagctaatttttgtatttttcgtrgagacggggtttcactgtgttgaccaggctggtctcgaactcctgacctcagatgatccacttgccttggcctcccaaagtgctggggttataggcgtga

SEQ ID NO: 61484 - DNA, 201 bp, Homo sapiens
cttgattagacagagaaggagatgatggagaagaaagaaagatgacaggagaggataagggggtggccatgacaacagaggaagagagaggactcagaggktgtccccaaggcttagactctaaataattaagagacagccctgggctcagtatccaggttagatctgtgtaggatccctggggcactgaagttgaggatg

SEQ ID NO: 61485 - DNA, 201 bp, Homo sapiens
gcctcaccttgctctggggcctacttttgagggcggcttcaaaagccactctgtgctctggctggcagttggggttggccagtggaagcactggcaggagrtggagggaggaagagagagaggtggtggaatttgttcacagaatctcttgctgccagaccaccagttggctgtgggtccttcctctattgcagcccacag

SEQ ID NO: 61486 - DNA, 201 bp, Homo sapiens
gacagcagccttctgagaaaacccattaaatgggctggaacagtattcccaagagtgttatatgctatgtgcaaaatccaaagagggctgccgggcactgygcctctttgtagtccatgtcgtcaatatagcggatccatctgatgatctgtggaatgtccacatgcaaaggtctctttggactgtgttgagagagaaccg

SEQ ID NO: 61487 - DNA, 201 bp, Homo sapiens
tcatacagcaggatgaatgtgccgcaggactctcttgttttgggagatcctctaaaaagctgacagcagccttctgagaaaacccattaaatgggctggarcagtattcccaagagtgttatatgctatgtgcaaaatccaaagagggctgccgggcactgcgcctctttgtagtccatgtcgtcaatatagcggatccat

SEQ ID NO: 61488 - DNA, 201 bp, Homo sapiens
ccaggcgaccgggtaccatgtcctgtggtttccctgcttcctggggaatgtgctctgtatgggaaaaacagaaaataagaccatttgctgagcatctaagmaaatgtttgagaaagccctcctgcatttttgtgtttcttcattttttttgtgatttgtgaaaacaaaaacaattttaaggagaataaaaaattagaataa

SEQ ID NO: 61489 - DNA, 201 bp, Homo sapiens
agcacccatggaatctgctgggtcatatgattacgggccagggctgctcatacagcaggatgaatgtgccgcaggactctcttgttttgggagatcctctraaaagctgacagcagccttctgagaaaacccattaaatgggctggaacagtattcccaagagtgttatatgctatgtgcaaaatccaaagagggctgccg

SEQ ID NO: 61490 - DNA, 201 bp, Homo sapiens
agaggtgcccacccttatctgtcatggctacctttagcacccatggaatctgctgggtcatatgattacgggccagggctgctcatacagcaggatgaatrtgccgcaggactctcttgttttgggagatcctctaaaaagctgacagcagccttctgagaaaacccattaaatgggctggaacagtattcccaagagtgt

SEQ ID NO: 61491 - DNA, 201 bp, Homo sapiens
cagaggtgcccacccttatctgtcatggctacctttagcacccatggaatctgctgggtcatatgattacgggccagggctgctcatacagcaggatgaaygtgccgcaggactctcttgttttgggagatcctctaaaaagctgacagcagccttctgagaaaacccattaaatgggctggaacagtattcccaagagtg

SEQ ID NO: 61492 - DNA, 201 bp, Homo sapiens
atatgattcagctcatgatggacagctgtgatcacacagtcacccttatgtcccatggtcagatactcagtgtctgctagggcccagtagcaccctgggarctacttttcatatggtaaatagttctctgctacatatggcataaccttactatggaaccctagaggtctgtgctataattcacttatgagggcttgtcag

SEQ ID NO: 61493 - DNA, 201 bp, Homo sapiens
gagtgcttgccttatactatgacttggtggttctgatatgattcagctcatgatggacagctgtgatcacacagtcacccttatgtcccatggtcagataytcagtgtctgctagggcccagtagcaccctgggagctacttttcatatggtaaatagttctctgctacatatggcataaccttactatggaaccctagag

SEQ ID NO: 61494 - DNA, 201 bp, Homo sapiens
tatctctaaggttaccgtgccattgttaaggcaggatttctgcaattgtgtgttatagttatcactgggtagaagcatcaagaagtgtcttgtactgcttyctgggccacaattacattgttttgtggcaacaacttgatctcttcatgataaccagggtcatttagtaacttcactgttgcctagagatctactgtcaaa

SEQ ID NO: 61495 - DNA, 201 bp, Homo sapiens
tatttaagtctttagtccattttgagttgatttttgtatatggtgtgagacaagggtctaatttcattcttttgcatgtgaacatccagttttcccaacaycatctattgaatagactgtccttgccctattgtgtgtccttggcagccttgtcaaaaatcaatttgggcatctattttgtgtggagagaagtggcgcagg

SEQ ID NO: 61496 - DNA, 201 bp, Homo sapiens
cttttgcatgtgaacatccagttttcccaacatcatctattgaatagactgtccttgccctattgtgtgtccttggcagccttgtcaaaaatcaatttggrcatctattttgtgtggagagaagtggcgcagggaaaggatacatgttagctcatggccatggatattggttagtggctatcactcacaacagctggggaa

SEQ ID NO: 61497 - DNA, 201 bp, Homo sapiens
attttgtgtggagagaagtggcgcagggaaaggatacatgttagctcatggccatggatattggttagtggctatcactcacaacagctggggaatgggtrcatcacctgcttaagaggtcctgggaagggcatcaacaatgtctactaaaatccattccttgcactgttcagattcacttgtttctggccttcaggtggg

SEQ ID NO: 61498 - DNA, 201 bp, Homo sapiens
aatccctcttacccttgatatttttctcttactaatttttcatccactgacccccaccgtattcgttggctataaattcccacttgcccatgttgtttcakatttgaccccaatctctcccgctgcaagaccacattgtagtggtacctgtacctattgtgatggaaagtcttccttaccttactctatcaagtgtcactg

SEQ ID NO: 61499 - DNA, 201 bp, Homo sapiens
ccctagtttcctattgactatctatcttttcttcatttactccttattttgtcatgtctagctcccagcagttttctgagaaagggtacttggaaagccawttttttttagactttcaacgatggaaatagatttattcattcctcacagttgattgatacactgtctgcttaagctttttgagggtcaaattatgttctc

SEQ ID NO: 61500 - DNA, 201 bp, Homo sapiens
tgctcttgacatcctagaataaaaagggaaggccaaggtcacctttagggcattctttgaatgtggctggcctggggctggaatgggagaatatagtgcggtcctggctctgaaaaaccacagttactctgggtctgtgccttaaagctgtggtttcatgacgtcagatttcctctcaacagccaggagtaatcaagatag

SEQ ID NO: 61501 - DNA, 201 bp, Homo sapiens
ggctcaaccacgaggtgagttgctgaggctgggcgaatgctctgctcccattttacccagggaagccagatggagacctgagagaagataggaggaagaayccggaaccccactctcatgggaagtggactcggaccagagactttcctctttatgttttattttattttgtgtttttagagacagggtctcactccatta

SEQ ID NO: 61502 - DNA, 201 bp, Homo sapiens
accaatttactgtattagtccattctcacactgctaatcaagacatacctgaggctgggtaatttataaaggaaagatgtttaattgattcacagttcagsagggctggggagacctcaggaaacttacaatcatggcagaaggggatacaaacacatccttcttcacatggtggcaggaaagagaagtgccaagcaagag

SEQ ID NO: 61503 - DNA, 201 bp, Homo sapiens
gtacccagttccaaggtctcttccacacttttgggtatttttacagcagtgccccactacctggtaccaatttactgtattagtccattctcacactgctwatcaagacatacctgaggctgggtaatttataaaggaaagatgtttaattgattcacagttcaggagggctggggagacctcaggaaacttacaatcatg

SEQ ID NO: 61504 - DNA, 201 bp, Homo sapiens
gactttattgtccatatcactatcagcattttggtcaaagtcattcaacaagtctccaggaagttccagactttcccacattttcctgtcttcttctgagmcctccaaactgttccaacctctgcctggtacccagttccaaggtctcttccacacttttgggtatttttacagcagtgccccactacctggtaccaattt

SEQ ID NO: 61505 - DNA, 201 bp, Homo sapiens
aaaggcctgagctgtacattggccgcttttggccatagctgagatgcagggcaccaagtaccaagactgcacaaagcagcaaggccctgggcccagcataygcagccatttttttctcctcagcctccatgtctgtgatgggaaggactactgtaaagatctctgacatgccctggagacattttccccattgtcttggga

SEQ ID NO: 61506 - DNA, 201 bp, Homo sapiens
accctctgaagcaaaggcctgagctgtacattggccgcttttggccatagctgagatgcagggcaccaagtaccaagactgcacaaagcagcaaggccctkggcccagcatatgcagccatttttttctcctcagcctccatgtctgtgatgggaaggactactgtaaagatctctgacatgccctggagacattttcccc

SEQ ID NO: 61507 - DNA, 201 bp, Homo sapiens
cttcttgatttctctgcacctgcagacccaacaccatgtgtaagccaccaaggcttggggcttcaccctctgaagcaaaggcctgagctgtacattggccrcttttggccatagctgagatgcagggcaccaagtaccaagactgcacaaagcagcaaggccctgggcccagcatatgcagccatttttttctcctcagcc

SEQ ID NO: 61508 - DNA, 201 bp, Homo sapiens
gcagcaaacttctgcttgagcatccaggcatttccatacatcttttgaaatctaggcagaggttcccaagcctcacttcttgatttctctgcacctgcagrcccaacaccatgtgtaagccaccaaggcttggggcttcaccctctgaagcaaaggcctgagctgtacattggccgcttttggccatagctgagatgcagg

SEQ ID NO: 61509 - DNA, 201 bp, Homo sapiens
ctgcacccattaactcgtcacttatattaggtatttctcctaatgctatccctccccctgccccccaccccacgacaggcccctgtgtgtgatgttccccrccctgtgtccaagtgttctcattgttcgattcccacctatgagtgagaatatgcagtgtttggttttctgtccttgtgatagtttgctcagaatgatggt

SEQ ID NO: 61510 - DNA, 201 bp, Homo sapiens
cctctcatcatttaatccaaaacatagactcactaaataataaccccagccacaaatcatgtaatctagagagagatctatgagctctttctctgtctctytctggcctggcagactgagagatccagtgcacagaagatccagtgcacagaagggcagcctcatatggtttgtatggggaatacttagtcttgggatatt

SEQ ID NO: 61511 - DNA, 201 bp, Homo sapiens
gtttgttacatagatatacatgtgctacgttgatttgctgcacccattaactcgtcacttatattaggtatttctcctaatgctatccctccccctgcccyccaccccacgacaggcccctgtgtgtgatgttccccgccctgtgtccaagtgttctcattgttcgattcccacctatgagtgagaatatgcagtgtttgg

SEQ ID NO: 61512 - DNA, 201 bp, Homo sapiens
tacagtccatactttttttcataattttattttatttttattatacattaagttctagggtacatgtgcacaatgtgcaggtttgttacatagatatacakgtgctacgttgatttgctgcacccattaactcgtcacttatattaggtatttctcctaatgctatccctccccctgccccccaccccacgacaggcccct

SEQ ID NO: 61513 - DNA, 201 bp, Homo sapiens
tagcatcttaaaaaatatttttatagggacaagctacagtccatactttttttcataattttattttatttttattatacattaagttctagggtacatgygcacaatgtgcaggtttgttacatagatatacatgtgctacgttgatttgctgcacccattaactcgtcacttatattaggtatttctcctaatgctatc

SEQ ID NO: 61514 - DNA, 201 bp, Homo sapiens
tccctcttacccttgatatttttctcttactaatttttcatccactgacccccaccgtattcgttggctataaattcccacttgcccatgttgtttcagayttgaccccaatctctcccgctgcaagaccacattgtagtggtacctgtacctattgtgatggaaagtcttccttaccttactctatcaagtgtcactgaa

SEQ ID NO: 61515 - DNA, 201 bp, Homo sapiens
agaagggggtggggagaggaggagatttgttaaaggatacaaaattagagctagatagcaagaatgagttctagggttctatagcaccataggataactayagttaacaataatatatagtttcaaatagctagaaggaggatattgactgtcctcaacacgaagaaatgatgttttagatgatggatatgctaattaccc

SEQ ID NO: 61516 - DNA, 201 bp, Homo sapiens
tttttctcttactaatttttcatccactgacccccaccgtattcgttggctataaattcccacttgcccatgttgtttcagatttgaccccaatctctccygctgcaagaccacattgtagtggtacctgtacctattgtgatggaaagtcttccttaccttactctatcaagtgtcactgaataattttctttaacaggt

SEQ ID NO: 61517 - DNA, 201 bp, Homo sapiens
tactgttggtgggaatgtgaactagtacagccactatggagaaaagtatggaggttcctcaagaaactacaaacagaactaccacatgatctaacaatccyactactgggcatttatccaaaggaaaggaaatcagtatattgaagaaacatgtgcatccctaagtttatttcagcactattcacaataagccaagatata

SEQ ID NO: 61518 - DNA, 201 bp, Homo sapiens
ttttctcttactaatttttcatccactgacccccaccgtattcgttggctataaattcccacttgcccatgttgtttcagatttgaccccaatctctcccrctgcaagaccacattgtagtggtacctgtacctattgtgatggaaagtcttccttaccttactctatcaagtgtcactgaataattttctttaacaggta

SEQ ID NO: 61519 - DNA, 201 bp, Homo sapiens
tactcaacattgctaatcaccagggaaaggtaaatcaaaaccacaatgaggtatcatctcactgcagttagagtggctattaccaaaaagacaaaaaatarcaaatgctggcgaggatgtggagtaaagggaactcttatatactgttggtgggaatgtgaactagtacagccactatggagaaaagtatggaggttcctc

SEQ ID NO: 61520 - DNA, 201 bp, Homo sapiens
catggaggttgaatagatgccatgaatgggtccaagaacatggacactctctttcaccaaaatcaattcgggtcttgccactgttaatcacctaacttgcyaacagcagagactatcgctgagtctttgagatggcactgctcttggagagatcaggcagccatccagtgagaggttgacccctctgctttggaggggatg

SEQ ID NO: 61521 - DNA, 201 bp, Homo sapiens
gtgggattatatcaaactaaaaagcttctatacagcaaaggaaaccctacataaaaggaaaagacaacagagtaaaaatacaacctacagtatggggggaratttttgtaaacaattcatctgacagaagattaatatccagaatatacaaggaactaaaaatctcaatagcataaaaaaacccaccccaaaatgattaaa

SEQ ID NO: 61522 - DNA, 201 bp, Homo sapiens
gatgccatgaatgggtccaagaacatggacactctctttcaccaaaatcaattcgggtcttgccactgttaatcacctaacttgccaacagcagagactaycgctgagtctttgagatggcactgctcttggagagatcaggcagccatccagtgagaggttgacccctctgctttggaggggatggacattcatccttat

SEQ ID NO: 61523 - DNA, 201 bp, Homo sapiens
cttgtttctggccttcaggtgggtagtttttattttctcatccacattggtgttacctcctcaaccccctcctttactcactctaatagatgacatttacmtacataattaggtccactgttgacaatatacctttgctcagaatgatctaattatcagcagaacaaaggtgagcttgtttatggaaagtcccaactacat

SEQ ID NO: 61524 - DNA, 201 bp, Homo sapiens
tttatgaataagacctcaaaagcacaggcaacaaaagcaaaataaacaagtgggattatatcaaactaaaaagcttctatacagcaaaggaaaccctacayaaaaggaaaagacaacagagtaaaaatacaacctacagtatggggggagatttttgtaaacaattcatctgacagaagattaatatccagaatatacaag

SEQ ID NO: 61525 - DNA, 201 bp, Homo sapiens
gctctggtaaccaccattctacttatttctatgagtttggcttttaagagtatatgaccgagatcatgcagtatttctctttgtgtgcctggtttatttcacttagcataatgtcctcctggctcatccatgttgttgcaaatgacaacatttcttctttttaaggatggataatagtattccactctgtgtgtgtttgtg

SEQ ID NO: 61526 - DNA, 201 bp, Homo sapiens
tgtgttctcagataaaaagtaaactttaaaagtccacctggtatcaaagaacatggcctggaaacttgtttctctaggcctttgctcttgtctaggattgrttgtcaaaaaaattaccgttctttgagaagttgtatctattgtcctgtccgcctgcatatttgtggtttgaattaattgttacctacttggcctagaaag

SEQ ID NO: 61527 - DNA, 201 bp, Homo sapiens
aattttaaggagaataaaaaattagaataaataaataaaaaagccattctttaagttacaattatgagaaaattacctctatttttgaaggattctttccrcttttccctaaaatatatagttttccatactgttgcaatcaaagtatgtgtacatttttgaatattcttttttcttcaattcgcactatattgtacttat

SEQ ID NO: 61528 - DNA, 201 bp, Homo sapiens
ccagcatgttgtacaataggtctcttgaaataggcctttattgttgttaacttccttcctttaattatgttttgctcataagactttttcacaggtaaatkatgagttcacccattgagttgaaacccttgtcagggaaggtcaggagtgcatatatcacgttttggacctctcccatgacaccagtgaattacaggtgtg

SEQ ID NO: 61529 - DNA, 201 bp, Homo sapiens
ctcccattgcagcagccagcccctcatctccagggaggctgatggagagcaggctctgtctgaatgtgttcagctttccatccaacctccttaaagctgtygttcttctgggttctggggatgggtgggtcaacttctctcatcctcctcagcctctcctttagcaactgaactattttagttaaactttttgcagctctc

SEQ ID NO: 61530 - DNA, 201 bp, Homo sapiens
agtgagaggtgacagtgtgctggcagccctggcagccctcgctcactcttggcggtgccttggccttggcgcccactctggccatgcttgaggagcccttyattctgccgctgcactgtgggagcccctctctcagctggctgaggctggagccggctccctttgcttgcggggaggtgtggagggagaggcgcaggtggg

SEQ ID NO: 61531 - DNA, 201 bp, Homo sapiens
aggatagggcttcctttatcatttggtgcctttcaagtgcaactctaacaggtggaccacaacatattttgggttccctagtattagtgagaggtgacagygtgctggcagccctggcagccctcgctcactcttggcggtgccttggccttggcgcccactctggccatgcttgaggagcccttcattctgccgctgcac

SEQ ID NO: 61532 - DNA, 201 bp, Homo sapiens
tggaatgttgtattgtttctgatttgccatcttggctaggttgtggacaactaaagccttttttaccataatgcctcttattttataagtcagggaatcaygagagttccatcagcgtttaagtgctgcctatacattaaaagtatgcactcagggaccagggtatttaccaaagggtaggttcaaggacccaactggccc

SEQ ID NO: 61533 - DNA, 201 bp, Homo sapiens
tttgaggctaccaccaaattctgccattttacctggaatgttgtattgtttctgatttgccatcttggctaggttgtggacaactaaagccttttttaccrtaatgcctcttattttataagtcagggaatcacgagagttccatcagcgtttaagtgctgcctatacattaaaagtatgcactcagggaccagggtattt

SEQ ID NO: 61534 - DNA, 201 bp, Homo sapiens
gtattccatgatgtatatgtgccacattttcttaatccagtctatcattgattgacatttgggtttgttccaagtgtttgctattgtgaatagtgctgaartaaacataagtgtgcatgtgtctttatactagcatgatttataatcctttgggtatatacccagtaatgggatggctgggtcaaatggtatttctagttc

SEQ ID NO: 61535 - DNA, 201 bp, Homo sapiens
tctttctaactttagctattctaatgagtgcatgctgctattgctcatggttttaatttctaattttttactaatgaggttagtacccttcatatatttayagttcagttggttatcttacttttgttaactttctgttcaagtctcttatctgtgtttcattgagttgtctgatgttttttcttattgattgataggcac

SEQ ID NO: 61536 - DNA, 201 bp, Homo sapiens
ttgggaaccactgagtgagtgaatgaggtggtaaagtatacttttatttttcaagattgaatggataaaacagtgaaacatgagtgtaaaaaagtggaggyactctttttttcctttttctcttaatatatatgtatttttttttctttttctttttcacacctggtgaacaggaagtagtggttctctttattgtagatc

SEQ ID NO: 61537 - DNA, 201 bp, Homo sapiens
ccccagaattttggagagtaccttcattttgtagatgctcaattagtatttattgagtaaatgaaagaatggtggttgagagtgcaggtcctggaaaaagrttccctgagttcaaattccagatcttctctttaacaactgtgtgattttgggcaagtttcttaacctctctgtaccttagtttccttacagtaattgagg

SEQ ID NO: 61538 - DNA, 201 bp, Homo sapiens
ggtgtatatgtgccacattttcttaatccagtctatcattgttggacatttgggttggttccaagtctttgctattgtgaatagtgctgcaataaacataygtgtgcatgtgtcagagcagagattttatctgctttgttcactcttcaccccagaattttggagagtaccttcattttgtagatgctcaattagtattta

SEQ ID NO: 61539 - DNA, 201 bp, Homo sapiens
catgtgccatgctggtgtgctgcacccattaactcgtcatttagcattaggtatatctcctaatgctatccctccccccactccccaccccacaacagtcyccagagtgtgatgttccccttcctgtgtccatgtgttgtcattgttcaattcccacctatgcgcgagaacatgcggtgtttggttttttgtccttgcgat

SEQ ID NO: 61540 - DNA, 201 bp, Homo sapiens
agatcttagcttcctggctactcttacctaatgatgtaattactgatgagaaaatgaacccaaagtaatgcagccaactcctcttctggggagtggttgcrtttaattgcactaaagccacgtaacaaaaacaacagcaaaacccccaaacacttaaactacccaaacaaattgaaagtgctgaaaagttgagtgaggaca

SEQ ID NO: 61541 - DNA, 201 bp, Homo sapiens
atactagatgcaaatcagagaagattttcatcaggaaaactatcacgaaaattagcaaagatcttagcttcctggctactcttacctaatgatgtaattaytgatgagaaaatgaacccaaagtaatgcagccaactcctcttctggggagtggttgcatttaattgcactaaagccacgtaacaaaaacaacagcaaaac

SEQ ID NO: 61542 - DNA, 201 bp, Homo sapiens
cagctggtcagggtgcacttttcagagccagggggcccagcaaagatatggtcatatactagatgcaaatcagagaagattttcatcaggaaaactatcaygaaaattagcaaagatcttagcttcctggctactcttacctaatgatgtaattactgatgagaaaatgaacccaaagtaatgcagccaactcctcttctg

SEQ ID NO: 61543 - DNA, 201 bp, Homo sapiens
ttatttcagagcctgaggtggggttgattacagaaaactcacagctggtcagggtgcacttttcagagccagggggcccagcaaagatatggtcatatacyagatgcaaatcagagaagattttcatcaggaaaactatcacgaaaattagcaaagatcttagcttcctggctactcttacctaatgatgtaattactgat

SEQ ID NO: 61544 - DNA, 201 bp, Homo sapiens
ttatgggtctcgtgccatctctgaaccaactattgtggccaagtatggagtgttctgcctggccaggcctgagtcgtgtgtctactgctggaccaggggtsgggtagccccactcactgtcctccactgtggaaacccagctgagcccctgaggtgttaaggaactcctcctctcttcaacaacgttgacattccttcctt

SEQ ID NO: 61545 - DNA, 201 bp, Homo sapiens
tgtcagaactgactcttcttggactgttatgggtctcgtgccatctctgaaccaactattgtggccaagtatggagtgttctgcctggccaggcctgagtygtgtgtctactgctggaccaggggtcgggtagccccactcactgtcctccactgtggaaacccagctgagcccctgaggtgttaaggaactcctcctctc

SEQ ID NO: 61546 - DNA, 201 bp, Homo sapiens
ttagagtgagaatgaattcttggcttctatttccagcagagtaactatttctcttaattccataaagaatgtcagaactgactcttcttggactgttatgrgtctcgtgccatctctgaaccaactattgtggccaagtatggagtgttctgcctggccaggcctgagtcgtgtgtctactgctggaccaggggtcgggta

SEQ ID NO: 61547 - DNA, 201 bp, Homo sapiens
attaatccatgtaactacagccaactactttttgacaaaggcaccaagaactctcattagtgaaaggacagcctcttcaataaatggtgctggaaaaactygatatccatatgcagaagaatgaaactagactcccacctctcaccctatatgaaaatcaactcacagtggatcaaagatctaaatataagacatgaaact

SEQ ID NO: 61548 - DNA, 201 bp, Homo sapiens
cttcatacatggctagatccaggtgcttacataatgtcatcaaggatccacatctttttaattctcagctcttattttttgttggttgacttcattctcargaagattttctccctttagagtgagaatgaattcttggcttctatttccagcagagtaactatttctcttaattccataaagaatgtcagaactgactct

SEQ ID NO: 61549 - DNA, 201 bp, Homo sapiens
cagccttctgagtgcctgggactacaggtgcaccccagcatggctggctaatttttgtattttttttttttgtagagataggattttgtcatgttgctcargctggtctcaaacacctggcctcaagcgatctatcctcttcggcctggaaaggtgctggaactacaggcatgagctaccatgcccagctcaaaccaaact

SEQ ID NO: 61550 - DNA, 201 bp, Homo sapiens
tgtaaaaaagtggaggcactctttttttcctttttctcttaatatatatgtatttttttttctttttctttttcacacctggtgaacaggaagtagtggtkctctttattgtagatcacctgacttgtcccaaagactgagtaaaaaatgagatgatagaagctgttaattgaatgcaaacagtactacttgatgaaacaa

SEQ ID NO: 61551 - DNA, 201 bp, Homo sapiens
tgtgaatctgaaaatcacactcacatataataaaacatttgcgattttatgatgcaatatactcttggaggttgcttgagaaggcagattgtcagatgaaktaaacttgtgtatttattggcttactagaacatatttagcatccttttttgggaaccactgagtgagtgaatgaggtggtaaagtatacttttatttttc

SEQ ID NO: 61552 - DNA, 201 bp, Homo sapiens
taattttaaaacaaaaatttataaaatatctatgggaggaaattacattttcatgtgaatctgaaaatcacactcacatataataaaacatttgcgatttkatgatgcaatatactcttggaggttgcttgagaaggcagattgtcagatgaattaaacttgtgtatttattggcttactagaacatatttagcatccttt

SEQ ID NO: 61553 - DNA, 201 bp, Homo sapiens
aaggtattttggaagcagctgtgagatctatataagcagaactaacaatcagctactttaggacatcaggacatatgtgcctgggaaaagcagtgagtttycatcattggagatgttcaggcagcatcttcaaccagttggggacatcataaagagtactgaaacactggaggagggcatcatgtccagtcctgatggtcc

SEQ ID NO: 61554 - DNA, 201 bp, Homo sapiens
acccttaacggcatatctgatcagcaggggtttaatgggaagaagatgattggaacataattccagagtaaaagaaagatatatgaacaagcagatgaggktaaagtggtcctgtatgtgaggaaggcataagtaattttaaaacaaaaatttataaaatatctatgggaggaaattacattttcatgtgaatctgaaaat

SEQ ID NO: 61555 - DNA, 201 bp, Homo sapiens
taacaggcaagaaaagccacacaaaaccaggtgtgagaagtggtcctatttcattgcttggtcacggattactgaacaggagatttgaaacccttaacggsatatctgatcagcaggggtttaatgggaagaagatgattggaacataattccagagtaaaagaaagatatatgaacaagcagatgaggttaaagtggtcc

SEQ ID NO: 61556 - DNA, 201 bp, Homo sapiens
gatgggtgggtcaacttctctcatcctcctcagcctctcctttagcaactgaactattttagttaaactttttgcagctctcagagtccatctgacacttkggaggttaaaacattcaaaccttagacaacaagacatgagaaattttcatctgcacatctgggcttaggggcaagtgcagctggctttccctttgggaag

SEQ ID NO: 61557 - DNA, 201 bp, Homo sapiens
agtcagtttcatggatctatctggtcaattcttgtagcatcatatatattttaaagtttgtcttctctttatgtatttattttatttatgaggtgtcttargaagaaatctcaaactgtcaaaaggctctgattttgttcttgggctacctagtgcttttgacagccttggaagatgcaatggaaagcatgtccatcaatg

SEQ ID NO: 61558 - DNA, 201 bp, Homo sapiens
atgagaaattttcatctgcacatctgggcttaggggcaagtgcagctggctttccctttgggaagaaaaggcttcctcctgggtctgcagcaatcacaagkactttgaaatgggactgttttcctcacagctgcttcctgaaacaacaaaaggagctcagctcagtcaacctctggggcatcaggccagccctgcggggca

SEQ ID NO: 61559 - DNA, 201 bp, Homo sapiens
aaaactaaggcttgtcggatttgttcccttacactgcagagggaaaaggaagtactgagagggaaaatacgttgggtaatattgcaaagcaaactggcttyatacatggctagatccaggtgcttacataatgtcatcaaggatccacatctttttaattctcagctcttattttttgttggttgacttcattctcaggaa

SEQ ID NO: 61560 - DNA, 201 bp, Homo sapiens
ttctgtttcatgatagacagatacaatatgatggactcttggagaaatcgctggtcacaagggaagaaggtgaggtctctgatgaccctcccaaaatacayatagccaataaaccaaatcatatctgagcccagtttactggagctgtggattggggtggccaagagctttgtcatgcgtatggtaatagcttataagtat

SEQ ID NO: 61561 - DNA, 201 bp, Homo sapiens
ttgggaagaaaaggcttcctcctgggtctgcagcaatcacaaggactttgaaatgggactgttttcctcacagctgcttcctgaaacaacaaaaggagctsagctcagtcaacctctggggcatcaggccagccctgcggggcaggataaaaagtcagagaaggatcctggctgcttcctcagcttgggccaaggcagagt

SEQ ID NO: 61562 - DNA, 201 bp, Homo sapiens
cactgtctgcttaagctttttgagggtcaaattatgttctctggtatcagtagtaactgtgagctgtgagagatctttctgtttcatgatagacagatacratatgatggactcttggagaaatcgctggtcacaagggaagaaggtgaggtctctgatgaccctcccaaaatacacatagccaataaaccaaatcatatc

SEQ ID NO: 61563 - DNA, 201 bp, Homo sapiens
agtcttccaatggattctggtttcagaataaaagccaaagatcttataagatctcaggggacccttgagacccccagtgattttgtcctcacttgtctatrtgacctcacctcctgcctgtcctgcccaagtcacactggcttctcagtatagcgtgacaaacttgcttctgcccagggcctttttgctattcccctgctt

SEQ ID NO: 61564 - DNA, 201 bp, Homo sapiens
gttgggggtagtgggaggctgggctctggggaagggacccagggagatatgagcaggtgcttgcagggaaggtcagctttctccagctcctttctcatggyagacactcaattacagggcctcccaggtgctggatagctctgtgctggcagaatgctacttctcacacccctctgcacagcagagatgatgagggctggg

SEQ ID NO: 61565 - DNA, 201 bp, Homo sapiens
ggcagtgaatgagaaatgccctcttacatactctgacagtgctggggagagaaagctaaatagatagatagatagatagatagatagatagatagatagadaatgatgttagtctttggccaggctggacctgagaggaactgtttagcatgagcagctcttcttgcaccaccagaggcttcaccagcccagcaattccat

SEQ ID NO: 61566 - DNA, 201 bp, Homo sapiens
cagcttgggccaaggcagagtgggatgggggatttgctggtgacaagtgcctctgccccttcccaatgccacctgtgtgaatgttccctgcttcattttgytggaatagatttttgtgacttctctcaggctctgagatgttacttgccaaatgctattcacataaccattttacatatttctgttactgtatggtagaac

SEQ ID NO: 61567 - DNA, 201 bp, Homo sapiens
tcctgaaacaacaaaaggagctcagctcagtcaacctctggggcatcaggccagccctgcggggcaggataaaaagtcagagaaggatcctggctgcttcytcagcttgggccaaggcagagtgggatgggggatttgctggtgacaagtgcctctgccccttcccaatgccacctgtgtgaatgttccctgcttcatttt

SEQ ID NO: 61568 - DNA, 201 bp, Homo sapiens
gtgattctcctgccttagtttcctgagtacctgggattatgggcatatgccaccacagccagctaatttgtgtatatttagtagagatggggttttgccaygttggccagtctgctctccaactcctgacctcaattgatccactgcctcagcctcccaaagtgctgggattacaggcacgagccaccatgcccagcctaa

SEQ ID NO: 61569 - DNA, 201 bp, Homo sapiens
gtggcaggatctcagctcactgcaacctccacttcctgggttcaagtgattctcctgccttagtttcctgagtacctgggattatgggcatatgccaccamagccagctaatttgtgtatatttagtagagatggggttttgccatgttggccagtctgctctccaactcctgacctcaattgatccactgcctcagcctc

SEQ ID NO: 61570 - DNA, 201 bp, Homo sapiens
ttattctagttagccattcatctagtcttttttcaaggtttttagcttctttgtgatgggttcaaacatcctcctttagctcagtgaagtttgttatgacygatcttctgaagcctacttttgtcagctcgtcaaagtcattctctgtccagctttgttccattgctggcgaggagctacatttctttggaggagaagagg

SEQ ID NO: 61571 - DNA, 201 bp, Homo sapiens
gggtttcaccatgttagccaggatggtctcgatctcctgaccttgtgatccacccacctcagcctcccaaagtgctgggattacaggcgtaagccactgcrcccggcctagattttctagtttatttgtgtagaggtgtttatagtattctctgatggtagtttgtatttctgtgggatcagtggtgatatcccctttatc

SEQ ID NO: 61572 - DNA, 201 bp, Homo sapiens
actgggtttcaccatgttagccaggatggtctcgatctcctgaccttgtgatccacccacctcagcctcccaaagtgctgggattacaggcgtaagccacygcacccggcctagattttctagtttatttgtgtagaggtgtttatagtattctctgatggtagtttgtatttctgtgggatcagtggtgatatccccttt

SEQ ID NO: 61573 - DNA, 201 bp, Homo sapiens
cccgccactatgcccggctaatttttttgtacttttattagagactgggtttcaccatgttagccaggatggtctcgatctcctgaccttgtgatccaccyacctcagcctcccaaagtgctgggattacaggcgtaagccactgcacccggcctagattttctagtttatttgtgtagaggtgtttatagtattctctga

SEQ ID NO: 61574 - DNA, 201 bp, Homo sapiens
gtgtggctcacagtctctcatgagattatactcaagatatcagctagggctgcaatcatctggatacttgactggggctggaggatcctctttcaaaaagmcttgctcacatgctgttgcaggaggcttcattccttgctgattgtttctcaccatgtggacctctccacatggctgcttgagtatccttatgacatggca

SEQ ID NO: 61575 - DNA, 201 bp, Homo sapiens
acaacaatagtatttattatcttttacagtcttgtgggttaggaatatggtagcagtttagctcggtggttgtggggtgtggctcacagtctctcatgagrttatactcaagatatcagctagggctgcaatcatctggatacttgactggggctggaggatcctctttcaaaaagacttgctcacatgctgttgcaggag

SEQ ID NO: 61576 - DNA, 201 bp, Homo sapiens
attatctcaaaacttagtggtttgaaacaacaatagtatttattatcttttacagtcttgtgggttaggaatatggtagcagtttagctcggtggttgtgrggtgtggctcacagtctctcatgagattatactcaagatatcagctagggctgcaatcatctggatacttgactggggctggaggatcctctttcaaaaa

SEQ ID NO: 61577 - DNA, 201 bp, Homo sapiens
tgctatttacctagagattaaaagtatgcaaaattatacttttttttattgaggggctaaatatatttgtagttaaaataaaaagaaatgcaagggaatgrtgatgatgggtagaatagtaatgtgatcaaggaggagtaccctgggaaatttaacttcttatttcttagggtgtattcattttatttttggtatatctga

SEQ ID NO: 61578 - DNA, 201 bp, Homo sapiens
gcatgggggtcatggccatcacgaacatgtcacagtgctgcagagattttgtttatggccacttttggggccagtttatggccagatttgggggcctattyccaacatgaaggtaaaacaaggatactttttagacaagcaaaaactgagagcatttgccaccatcagacttaatatactttgtcaggaagaaaggaaatg

SEQ ID NO: 61579 - DNA, 201 bp, Homo sapiens
catgctccggctcctaggctgggtgagccttagagcctttgggtggactgctgctttagcagcttaggaaggcaaatgctggctcctcttcctctcctcamttggtaggactcagagcaaagaaaggatggcttttctccagtccttctcccttttcagacaggcggcacagctagagaaatatgtaaagatcaggggaag

SEQ ID NO: 61580 - DNA, 201 bp, Homo sapiens
aagaacacctttaagtggttttccaccctgggtgggccaggtgttccttgccctcattccagtaaacccactaccttcagcatgggggtcatggccatcaygaacatgtcacagtgctgcagagattttgtttatggccacttttggggccagtttatggccagatttgggggcctatttccaacatgaaggtaaaacaag

SEQ ID NO: 61581 - DNA, 201 bp, Homo sapiens
agctttctccagctcctttctcatggcagacactcaattacagggcctcccaggtgctggatagctctgtgctggcagaatgctacttctcacacccctcygcacagcagagatgatgagggctgggcctgattttctccctgcactctgatataataaagttgttgtcactaggacctattaaatcagacactcatggta

SEQ ID NO: 61582 - DNA, 201 bp, Homo sapiens
cgccttgcatgctccggctcctaggctgggtgagccttagagcctttgggtggactgctgctttagcagcttaggaaggcaaatgctggctcctcttcctytcctcacttggtaggactcagagcaaagaaaggatggcttttctccagtccttctcccttttcagacaggcggcacagctagagaaatatgtaaagatca

SEQ ID NO: 61583 - DNA, 201 bp, Homo sapiens
aaacaaaatgagtttcaagtaagataaataaaaacaaacccatacctagtttcatcatagtaaaactggaaaaacaaagagagatgttaaaagtagtcaamaagaagacagattatctataaagaaatgcctttttttttgagatggagtctctctgttgctcagggtggtgtgcagtggcaggatctcagctcactgcaa

SEQ ID NO: 61584 - DNA, 201 bp, Homo sapiens
tcacacccctctgcacagcagagatgatgagggctgggcctgattttctccctgcactctgatataataaagttgttgtcactaggacctattaaatcagrcactcatggtagtaaatgtggagatcaggcagcttggaaatcctcaggcacatgtgcatgtggatgcgtgtgtgtgtcatgaggacacaggataaagtct

SEQ ID NO: 61585 - DNA, 201 bp, Homo sapiens
tggtctgaagaacccctctacccacactgcaggctggaggtcgccttgcatgctccggctcctaggctgggtgagccttagagcctttgggtggactgctrctttagcagcttaggaaggcaaatgctggctcctcttcctctcctcacttggtaggactcagagcaaagaaaggatggcttttctccagtccttctccct

SEQ ID NO: 61586 - DNA, 201 bp, Homo sapiens
tcagattcagtaaacaaaatgagtttcaagtaagataaataaaaacaaacccatacctagtttcatcatagtaaaactggaaaaacaaagagagatgttamaagtagtcaaaaagaagacagattatctataaagaaatgcctttttttttgagatggagtctctctgttgctcagggtggtgtgcagtggcaggatctca

SEQ ID NO: 61587 - DNA, 201 bp, Homo sapiens
ggctggtctgaagaacccctctacccacactgcaggctggaggtcgccttgcatgctccggctcctaggctgggtgagccttagagcctttgggtggactsctgctttagcagcttaggaaggcaaatgctggctcctcttcctctcctcacttggtaggactcagagcaaagaaaggatggcttttctccagtccttctc

SEQ ID NO: 61588 - DNA, 201 bp, Homo sapiens
ttgattttttcttgtgaatttgtttgagttcattgtagattctggatatcagccctttgtcagatgggtggattgcaaaacattttctcccattctgtagrttgcctgttccctctcatagtagtttcttttgctgtgcagaagctgtttagtttaattagatcccatttgtctattttggctttttttgccattgctttt

SEQ ID NO: 61589 - DNA, 201 bp, Homo sapiens
aggacctattaaatcagacactcatggtagtaaatgtggagatcaggcagcttggaaatcctcaggcacatgtgcatgtggatgcgtgtgtgtgtcatgargacacaggataaagtctgttgtctgtggccctgggggattgaggcagtgatcaccagagctggctttatctttgcgttcatgcatcttctacccactcag

SEQ ID NO: 61590 - DNA, 201 bp, Homo sapiens
ctctccttgtcaatattgatattatcaatctttctaactttagctattctaatgagtgcatgctgctattgctcatggttttaatttctaattttttactratgaggttagtacccttcatatatttatagttcagttggttatcttacttttgttaactttctgttcaagtctcttatctgtgtttcattgagttgtctg

SEQ ID NO: 61591 - DNA, 201 bp, Homo sapiens
ttgatattatcaatctttctaactttagctattctaatgagtgcatgctgctattgctcatggttttaatttctaattttttactaatgaggttagtaccyttcatatatttatagttcagttggttatcttacttttgttaactttctgttcaagtctcttatctgtgtttcattgagttgtctgatgttttttcttatt

SEQ ID NO: 61592 - DNA, 201 bp, Homo sapiens
ttcttctagattttcttttcttctttctttcattcttttttttttttttgagacggagtctcactctgtcacccaggctagagtactagagtgcagtggcrctatctcagctcactgcaagctctgcctcccaggttcatgccattctcctgcctcagcctcctgagtagctgggactacaggtgcccgccactatgcccg

SEQ ID NO: 61593 - DNA, 201 bp, Homo sapiens
cctctcatagtagtttcttttgctgtgcagaagctgtttagtttaattagatcccatttgtctattttggctttttttgccattgcttttggtgttttagwcatgaagtccttgcccatgcctatgtcctgaatggtattgcctaggttttcttctagggtttttatggttttaggtctaacatttaagtctttaatccat

SEQ ID NO: 61594 - DNA, 201 bp, Homo sapiens
ttactttatttataaaaatatgagtgaatacaaaatatcagtgtgaagattaatatggcccatgcagctcttgtgagaggtcatggagattgggactgtcraatggcctttaaaaaaaattaatccaatggcctttaaaaaaaatagtcttttaaaaaaatttagctctgctgaagggggaggttccaagatggcagaata

SEQ ID NO: 61595 - DNA, 201 bp, Homo sapiens
tcctctaaaaagctgacagcagccttctgagaaaacccattaaatgggctggaacagtattcccaagagtgttatatgctatgtgcaaaatccaaagaggsctgccgggcactgcgcctctttgtagtccatgtcgtcaatatagcggatccatctgatgatctgtggaatgtccacatgcaaaggtctctttggactgtg

SEQ ID NO: 61596 - DNA, 201 bp, Homo sapiens
agtgttatatgctatgtgcaaaatccaaagagggctgccgggcactgcgcctctttgtagtccatgtcgtcaatatagcggatccatctgatgatctgtgraatgtccacatgcaaaggtctctttggactgtgttgagagagaaccggaggtttaatatagtgctgagatgagactgctttccatcctgggtgaatgcaa

SEQ ID NO: 61597 - DNA, 201 bp, Homo sapiens
tgctatgtgcaaaatccaaagagggctgccgggcactgcgcctctttgtagtccatgtcgtcaatatagcggatccatctgatgatctgtggaatgtccasatgcaaaggtctctttggactgtgttgagagagaaccggaggtttaatatagtgctgagatgagactgctttccatcctgggtgaatgcaaactgttctg

SEQ ID NO: 61598 - DNA, 201 bp, Homo sapiens
ccactttttgatggggttgtttgattttttcttgtgaatttgtttgagttcattgtagattctggatatcagccctttgtcagatgggtggattgcaaaamattttctcccattctgtagattgcctgttccctctcatagtagtttcttttgctgtgcagaagctgtttagtttaattagatcccatttgtctattttgg

SEQ ID NO: 61599 - DNA, 201 bp, Homo sapiens
cccgcaataggccccggtgtgtgatgttccccaccctgtgtccaagcattcttattgttcagttcccacctatgagtgagaacatgcagtgtttggttttytgtccttgcgagaatttgctcagaatgatggtttccagcttcatccatgtccctgcaatggatcatcctttttaatggatgcatagtattccatggtgta

SEQ ID NO: 61600 - DNA, 201 bp, Homo sapiens
tcatcatttacattaggtattcctcctaatgctatccctccccccacacccaccccgcaataggccccggtgtgtgatgttccccaccctgtgtccaagcrttcttattgttcagttcccacctatgagtgagaacatgcagtgtttggttttttgtccttgcgagaatttgctcagaatgatggtttccagcttcatcca

SEQ ID NO: 61601 - DNA, 201 bp, Homo sapiens
acatatgtatacatgtgccatgttggtgtgctgcatccattaactcatcatttacattaggtattcctcctaatgctatccctccccccacacccaccccrcaataggccccggtgtgtgatgttccccaccctgtgtccaagcattcttattgttcagttcccacctatgagtgagaacatgcagtgtttggttttttgt

SEQ ID NO: 61602 - DNA, 201 bp, Homo sapiens
gggccccaaaccgtacctctcagtgtgcgcctccttcaggcgatttcccaccccatccgcgtcttctctgccattcaaaggggcaagggtgtgtaggagasgaggtagggagatacctctctcccgaggatccctggcagaggggcctggcactgcaggggtgcatgcaagaagtgggtgcacgtccgcagagcttgggtg

SEQ ID NO: 61603 - DNA, 201 bp, Homo sapiens
gcaggggcaaaatgccaccagtctctgtgctaaagcataacaagagttacctttgctctatttcccaacaagttcctcatctccatctgagaccacctcarcctggactttattgtccatatcactatcagcattttggtcaaagtcattcaacaagtctccaggaagttccagactttcccacattttcctgtcttcttc

SEQ ID NO: 61604 - DNA, 201 bp, Homo sapiens
cattttttcatatacctattggctatttgtattttttgagagaggtctattaggttctttgcccattttaaaattgggttatttgctttcttgctattgarttgacttctttatttgttttgaatattaaccccttattagatgtgtgatttgcaaatattttctcccattctattgattgtttcttcactctgttgattg

SEQ ID NO: 61605 - DNA, 201 bp, Homo sapiens
tgccattcaaaggggcaagggtgtgtaggagacgaggtagggagatacctctctcccgaggatccctggcagaggggcctggcactgcaggggtgcatgcragaagtgggtgcacgtccgcagagcttgggtgggcagcaacgagagggcttgggtgggcgagaagagaaggcatgggctgcttgcactcattttattcca

SEQ ID NO: 61606 - DNA, 201 bp, Homo sapiens
tctgatgatctgtggaatgtccacatgcaaaggtctctttggactgtgttgagagagaaccggaggtttaatatagtgctgagatgagactgctttccatmctgggtgaatgcaaactgttctgatccttcctcctgacgggaactaaaagaacacatttgccttatcaaaagtcacatatcaaatgctagaggctgtgtt

SEQ ID NO: 61607 - DNA, 201 bp, Homo sapiens
ttggctttgcagggtacagccccaacttctagctgctttcacaggctggcattgagtgtctgtggctgcacatgatgcaagctgttgctgggtctaccatyctggggtctgaggacagtggccctcttctcacaactccactaggcagcgccccagtgtggactctgtgtgggtctcccatcccacatttcccttccacac

SEQ ID NO: 61608 - DNA, 201 bp, Homo sapiens
agaacacatttgccttatcaaaagtcacatatcaaatgctagaggctgtgttgctctattctaatgaagacacaacatacaaaactgcagtaaccgctgcyccaccacttggtagagtagtctgctatcatctgctagggtgtatttggttttccaggtgaccatctctgtatcacttaaatctttgaggctaccaccaaa

SEQ ID NO: 61609 - DNA, 201 bp, Homo sapiens
taaagttccaaaatgatctcttttgactccatgtctcacatccaggtcacactgatgcaagaggtgggttttcacagtcttggggagccctgccccttggmtttgcagggtacagccccaacttctagctgctttcacaggctggcattgagtgtctgtggctgcacatgatgcaagctgttgctgggtctaccatcctgg

SEQ ID NO: 61610 - DNA, 201 bp, Homo sapiens
gaagacacaacatacaaaactgcagtaaccgctgccccaccacttggtagagtagtctgctatcatctgctagggtgtatttggttttccaggtgaccatytctgtatcacttaaatctttgaggctaccaccaaattctgccattttacctggaatgttgtattgtttctgatttgccatcttggctaggttgtggacaa

SEQ ID NO: 61611 - DNA, 201 bp, Homo sapiens
ggtacagacattgggtaaatacacccatttcaaatgggagaaattggccaaaatgaaggggctacaagccacatgcaagtccaaaatccaatagggcagtygttaaaccttaaagttccaaaatgatctcttttgactccatgtctcacatccaggtcacactgatgcaagaggtgggttttcacagtcttggggagccct

SEQ ID NO: 61612 - DNA, 201 bp, Homo sapiens
ttttttgagagaggtctattaggttctttgcccattttaaaattgggttatttgctttcttgctattgaattgacttctttatttgttttgaatattaacyccttattagatgtgtgatttgcaaatattttctcccattctattgattgtttcttcactctgttgattgtttccttggttgtgcagaagacttttagtta

SEQ ID NO: 61613 - DNA, 201 bp, Homo sapiens
atttctcttaattccataaagaatgtcagaactgactcttcttggactgttatgggtctcgtgccatctctgaaccaactattgtggccaagtatggagtkttctgcctggccaggcctgagtcgtgtgtctactgctggaccaggggtcgggtagccccactcactgtcctccactgtggaaacccagctgagcccctga

SEQ ID NO: 61614 - DNA, 201 bp, Homo sapiens
cttactttatttataaaaatatgagtgaatacaaaatatcagtgtgaagattaatatggcccatgcagctcttgtgagaggtcatggagattgggactgtyaaatggcctttaaaaaaaattaatccaatggcctttaaaaaaaatagtcttttaaaaaaatttagctctgctgaagggggaggttccaagatggcagaat

SEQ ID NO: 61615 - DNA, 201 bp, Homo sapiens
catacaaaactgcagtaaccgctgccccaccacttggtagagtagtctgctatcatctgctagggtgtatttggttttccaggtgaccatctctgtatcayttaaatctttgaggctaccaccaaattctgccattttacctggaatgttgtattgtttctgatttgccatcttggctaggttgtggacaactaaagcctt

SEQ ID NO: 61616 - DNA, 201 bp, Homo sapiens
ttctgatttgccatcttggctaggttgtggacaactaaagccttttttaccataatgcctcttattttataagtcagggaatcacgagagttccatcagcrtttaagtgctgcctatacattaaaagtatgcactcagggaccagggtatttaccaaagggtaggttcaaggacccaactggcccactgtgggatggattt

SEQ ID NO: 61617 - DNA, 201 bp, Homo sapiens
tcagcgtttaagtgctgcctatacattaaaagtatgcactcagggaccagggtatttaccaaagggtaggttcaaggacccaactggcccactgtgggatrgatttaggatagggcttcctttatcatttggtgcctttcaagtgcaactctaacaggtggaccacaacatattttgggttccctagtattagtgagaggt

SEQ ID NO: 61618 - DNA, 201 bp, Homo sapiens
gatttgataccagacttctggttgtgtatgaacttccctgttagggacagaacatttttttactggagacaggaggagcgatgggatcaggtctagcattygaaggtattttggaagcagctgtgagatctatataagcagaactaacaatcagctactttaggacatcaggacatatgtgcctgggaaaagcagtgagtt

SEQ ID NO: 61619 - DNA, 201 bp, Homo sapiens
tggggttataggcgtgagccactgtgtctggccagccctgagtacttcaaagtaacggtgacaaactacagcacattaaaattgtgagagaaactagaagmttgggaaaagggtggaagacccagggatgatgcttctgagaaaagaaagctcagctgagatttgataccagacttctggttgtgtatgaacttccctgtt

SEQ ID NO: 61620 - DNA, 201 bp, Homo sapiens
ttattcattcctcacagttgattgatacactgtctgcttaagctttttgagggtcaaattatgttctctggtatcagtagtaactgtgagctgtgagagayctttctgtttcatgatagacagatacaatatgatggactcttggagaaatcgctggtcacaagggaagaaggtgaggtctctgatgaccctcccaaaata

SEQ ID NO: 61621 - DNA, 201 bp, Homo sapiens
gtccagtttagcttggaggggaccatctctactactcaatgccccaatagaggacttcccagctgtcatctcgaaatttctcattcttggcacttgtgggwaaagtctaattctagagctccccagagtcactttatctcctggggcagtaaaaatctgcccatggcactgatcttggaggagacctcttatcttcaggga

SEQ ID NO: 61622 - DNA, 201 bp, Homo sapiens
ctttaggccacttcagccccaggttctagcaccttcaccctggtgcttttccctcccagggagtctcatgaactatttcctttggggaaggtgaagaaagwccagtttagcttggaggggaccatctctactactcaatgccccaatagaggacttcccagctgtcatctcgaaatttctcattcttggcacttgtgggaa

SEQ ID NO: 61623 - DNA, 201 bp, Homo sapiens
ctttacttatgcaaatatctgcagctggcttgaatttctcctcagaaaatgggtttttcttttctagcacatcaccaggctgcaaattttctgaacttttrtgctctgcttcccttttaaacataaattccaactccaaaccatatcttcatgaaagaataaaactgtgtgtttttaagagcacctaagtcacatcttgaa

SEQ ID NO: 61624 - DNA, 201 bp, Homo sapiens
accaagactgcacaaagcagcaaggccctgggcccagcatatgcagccatttttttctcctcagcctccatgtctgtgatgggaaggactactgtaaagayctctgacatgccctggagacattttccccattgtcttgggaattaacatttggcttctctttacttatgcaaatatctgcagctggcttgaatttctcct

SEQ ID NO: 61625 - DNA, 201 bp, Homo sapiens
ggcaccaagtaccaagactgcacaaagcagcaaggccctgggcccagcatatgcagccatttttttctcctcagcctccatgtctgtgatgggaaggactrctgtaaagatctctgacatgccctggagacattttccccattgtcttgggaattaacatttggcttctctttacttatgcaaatatctgcagctggcttg

SEQ ID NO: 61626 - DNA, 201 bp, Homo sapiens
gatgcaagctgttgctgggtctaccatcctggggtctgaggacagtggccctcttctcacaactccactaggcagcgccccagtgtggactctgtgtgggkctcccatcccacatttcccttccacactgacctagcagagattctccatgagggctctgcccctgcagcaaacttctgcttgagcatccaggcatttcca

SEQ ID NO: 61627 - DNA, 201 bp, Homo sapiens
cagtgtgttttgacttgagcagccttggcttctttctctttccctcagcagcggggagtcagcttggccagtgcttgtgatgggcaagcctggggcatccycttctcatgggttgggtgaagcctctagtgctgaaggacaaagctcacacaactccccgcttttggctgtcagcaccagccagacaggagcaagaaccag

SEQ ID NO: 61628 - DNA, 201 bp, Homo sapiens
ggcattgagtgtctgtggctgcacatgatgcaagctgttgctgggtctaccatcctggggtctgaggacagtggccctcttctcacaactccactaggcarcgccccagtgtggactctgtgtgggtctcccatcccacatttcccttccacactgacctagcagagattctccatgagggctctgcccctgcagcaaact

SEQ ID NO: 61629 - DNA, 201 bp, Homo sapiens
ccttggcttctttctctttccctcagcagcggggagtcagcttggccagtgcttgtgatgggcaagcctggggcatccccttctcatgggttgggtgaagmctctagtgctgaaggacaaagctcacacaactccccgcttttggctgtcagcaccagccagacaggagcaagaaccaggaacaactcccagcatctcaga

SEQ ID NO: 61630 - DNA, 201 bp, Homo sapiens
accaaagggtaggttcaaggacccaactggcccactgtgggatggatttaggatagggcttcctttatcatttggtgcctttcaagtgcaactctaacagrtggaccacaacatattttgggttccctagtattagtgagaggtgacagtgtgctggcagccctggcagccctcgctcactcttggcggtgccttggcctt

SEQ ID NO: 61631 - DNA, 201 bp, Homo sapiens
ggtgcctttcaagtgcaactctaacaggtggaccacaacatattttgggttccctagtattagtgagaggtgacagtgtgctggcagccctggcagccctygctcactcttggcggtgccttggccttggcgcccactctggccatgcttgaggagcccttcattctgccgctgcactgtgggagcccctctctcagctgg

SEQ ID NO: 61632 - DNA, 201 bp, Homo sapiens
gtgcctttcaagtgcaactctaacaggtggaccacaacatattttgggttccctagtattagtgagaggtgacagtgtgctggcagccctggcagccctcrctcactcttggcggtgccttggccttggcgcccactctggccatgcttgaggagcccttcattctgccgctgcactgtgggagcccctctctcagctggc

SEQ ID NO: 61633 - DNA, 201 bp, Homo sapiens
ggaactacaattcaagatgagatttgggtggggacacagccaaactatatcattccaccactggctccacccaaatctcatgtcctcacatttcaaattayaatcatgccctcccaacagtcccccaaaggcttaactcattccagcattaactcaaaagtccgagtctaaagtctcatctgagacaaggcaagtccctcc

SEQ ID NO: 61634 - DNA, 201 bp, Homo sapiens
ggctcagggattgtaaacgcaccaatcagcaccctgtcaaaacagaccaatcagctgtctgtaaatcagacaaatcagctctctgtaaaatggaccaatcrgcaggatgtgggtggggccagataagggaataaaagcaggccgccccagccagcagtggcaacctgctcgggtccccttccacactgtggaagctttgtt

SEQ ID NO: 61635 - DNA, 201 bp, Homo sapiens
ggagtctatagaggcaggcaggcctccttgagctgtggtgggcttcacccagttcgagcttcctggccactttgtttacctagtcaagcctcagcaatggyggacgcccctcccccagcccaggctgccgcctcacagttcaatcttggactgctgtgccagcagtgagcaaagctccatgggtgtgggacctgctgagcc

SEQ ID NO: 61636 - DNA, 201 bp, Homo sapiens
caaatctccactcctggatgctctagtctttcctgattacaggcccacatggagcctgtttgaaggggtcgctgccatgggctgagtcagggcattgaggyctggatgtcagggctcagcagtgtccagtttccaggcctcattacagctgctcccatgaggggttcccccagcactgggcctggagagttatgagtctct

SEQ ID NO: 61637 - DNA, 201 bp, Homo sapiens
tcacaggctggcattgagtgtctgtggctgcacatgatgcaagctgttgctgggtctaccatcctggggtctgaggacagtggccctcttctcacaactcyactaggcagcgccccagtgtggactctgtgtgggtctcccatcccacatttcccttccacactgacctagcagagattctccatgagggctctgcccctg

SEQ ID NO: 61638 - DNA, 201 bp, Homo sapiens
atgatgtaattactgatgagaaaatgaacccaaagtaatgcagccaactcctcttctggggagtggttgcatttaattgcactaaagccacgtaacaaaarcaacagcaaaacccccaaacacttaaactacccaaacaaattgaaagtgctgaaaagttgagtgaggacagaagcctctcatcatttaatccaaaacata

SEQ ID NO: 61639 - DNA, 201 bp, Homo sapiens
tttcctatctccaggaaatggagacatgacagtatactttttggcctgcttgtttttctttaccaaaaacaattttaggaaaagcttgagaatatgtaagkctcagtgatgtgactttttcctttttcttctgtcgttgaagaggaagagttgaggaacctccttggatagaaggggtatagcttattttaggacttcaac

SEQ ID NO: 61640 - DNA, 201 bp, Homo sapiens
tggaagactccctcttgaggggtgtggcttcaaaaaaggagcatttcctatctccaggaaatggagacatgacagtatactttttggcctgcttgtttttytttaccaaaaacaattttaggaaaagcttgagaatatgtaaggctcagtgatgtgactttttcctttttcttctgtcgttgaagaggaagagttgaggaa

SEQ ID NO: 61641 - DNA, 201 bp, Homo sapiens
cgtgtgtgtgtcatgaggacacaggataaagtctgttgtctgtggccctgggggattgaggcagtgatcaccagagctggctttatctttgcgttcatgcrtcttctacccactcagctcacatttcgttataccattcagcagttggcaacctgaggggttcctagggagggagatgtaggctagtccatcttctcctcc

SEQ ID NO: 61642 - DNA, 201 bp, Homo sapiens
ggtgctggatagctctgtgctggcagaatgctacttctcacacccctctgcacagcagagatgatgagggctgggcctgattttctccctgcactctgatrtaataaagttgttgtcactaggacctattaaatcagacactcatggtagtaaatgtggagatcaggcagcttggaaatcctcaggcacatgtgcatgtgg

SEQ ID NO: 61643 - DNA, 201 bp, Homo sapiens
tatctggaattacaaatttcaaaagaagtgaatctcacaactataatgttaaacaaaaaagaagttgcagaaaagtacctacaatataatgctatttaccwagagattaaaagtatgcaaaattatacttttttttattgaggggctaaatatatttgtagttaaaataaaaagaaatgcaagggaatggtgatgatgggt

SEQ ID NO: 61644 - DNA, 201 bp, Homo sapiens
gaagtaaagtgtgcacttctaaatcagtagagggaaacaattgaataagataatctaatcaatttaaaagttatcaggaaaagataaaaagaggatgcttrgaaaaaactagaaaggccaaaataagataacagaaataatcagtaaccataataaatttaaatggagtaagaaattaaattaactagatgtatctggaat

SEQ ID NO: 61645 - DNA, 201 bp, Homo sapiens
ggggcctatttccaacatgaaggtaaaacaaggatactttttagacaagcaaaaactgagagcatttgccaccatcagacttaatatactttgtcaggaaraaaggaaatgatctgaaaaggaaaatgtaagatgcaggaaaatagtgatcaaaggaattgataaagttgataaatataaatatttactatattaagcaac

SEQ ID NO: 61646 - DNA, 201 bp, Homo sapiens
agcccagtttactggagctgtggattggggtggccaagagctttgtcatgcgtatggtaatagcttataagtatttattcccaaatggctaagaaattaaytgagcaccatttattttaccacagtttctgtgtttactatatactaaatgttttctataggctagagccattatctgagctctctagtcagtttcatgga

SEQ ID NO: 61647 - DNA, 201 bp, Homo sapiens
gaagagaaaataattaccaacctagaattgcttaccaacacattattcaagaatgaaggtgccgagaccagctcggccatggagaccctaacctggcggcrctagaggaattaaagacacacatacagaaatatagggtgtggagtgggaaatcaggggtctcatagccttcagagctgagagccctgaacagaaatttac

SEQ ID NO: 61648 - DNA, 201 bp, Homo sapiens
aatatcatctaatggaataatatctcaagcttgaagagaaaataattaccaacctagaattgcttaccaacacattattcaagaatgaaggtgccgagacyagctcggccatggagaccctaacctggcggcgctagaggaattaaagacacacatacagaaatatagggtgtggagtgggaaatcaggggtctcatagcc

SEQ ID NO: 61649 - DNA, 201 bp, Homo sapiens
tccattctcagatctcaaactctgtgctgggaaaaccactgctctcttgaaaactgtcagacagggacgtttaaatttgcagaagtttctgctgccttttkttcagctgtgcccttcccccagaggtggagtctatagaggcaggcaggcctccttgagctgtggtgggcttcacccagttcgagcttcctggccactttg

SEQ ID NO: 61650 - DNA, 201 bp, Homo sapiens
tttccaacttggttccattctccctgtcaatttcaggtacaccaatcagacgtagatttggtcttttcacatagtcccatatttcttggaggctttgttcrtttctttttcctctaaaattctcttcttgcttcatttcattcatttgctcttcaatcactgatacccttttttccacttgaccgaataggatactgaagc

SEQ ID NO: 61651 - DNA, 201 bp, Homo sapiens
ggattgaaaattctcttctttaagaatgttgaatattggcccccactctcttctggcttttagagtttctgctgagagatccactgttagtctgatgggcytccctttgtgggtaacccagactttctctctggctgcccttaacattttttccttcatttcgaccttggtgagtctgacaattttgtgtcatggggttgc

SEQ ID NO: 61652 - DNA, 201 bp, Homo sapiens
gaaggacaaagctcacacaactccccgcttttggctgtcagcaccagccagacaggagcaagaaccaggaacaactcccagcatctcagaatcaaatctcyactcctggatgctctagtctttcctgattacaggcccacatggagcctgtttgaaggggtcgctgccatgggctgagtcagggcattgaggtctggatgt

SEQ ID NO: 61653 - DNA, 201 bp, Homo sapiens
cttcacttatgaaacttagtttggctggatatgaaattctggattgaaaattctcttctttaagaatgttgaatattggcccccactctcttctggctttkagagtttctgctgagagatccactgttagtctgatgggcctccctttgtgggtaacccagactttctctctggctgcccttaacattttttccttcattt

SEQ ID NO: 61654 - DNA, 201 bp, Homo sapiens
ggatgctctagtctttcctgattacaggcccacatggagcctgtttgaaggggtcgctgccatgggctgagtcagggcattgaggtctggatgtcagggcycagcagtgtccagtttccaggcctcattacagctgctcccatgaggggttcccccagcactgggcctggagagttatgagtctctcctgtactttctgct

SEQ ID NO: 61655 - DNA, 201 bp, Homo sapiens
ttgtggaggaccaaagaatgataacattaatttgcctattgagagtgttttgggaaagttagccaaagctttagcagaaaaacacctgagaaagcttcacyagacagttcttctccaccgtgacaatgcttttgctcatgtctctcatcatacaagaacaattttgttagagtttcaatgggaaatctttaggcatccacc

SEQ ID NO: 61656 - DNA, 201 bp, Homo sapiens
gagcaacctcagcgtgcctcgagggggacaggcatccgggaggccagcggctgagctgggttctgggcgctggcaggtcagcagggcagggaagagaaggkcatcgagggtgggcctgggggcttcccagcagccagcccctgtgactgggagaaaatcctgcccctgggcggaaaggcccccatctctccctaatggtga

SEQ ID NO: 61657 - DNA, 201 bp, Homo sapiens
actaatacaatcctgaagcatttcatcaaagaattgtaacaggagatgaaacatggcttcaccagtatgatcctgaagaaaaagcacaatcaaagcagtgkctatcaagaggaggaagtcaaagcaaagcagaccagtcaagagcaaaggtaatggcaacagtttttttaggatactcaaggtattttccttgttgacttt

SEQ ID NO: 61658 - DNA, 201 bp, Homo sapiens
cagactaatacaatcctgaagcatttcatcaaagaattgtaacaggagatgaaacatggcttcaccagtatgatcctgaagaaaaagcacaatcaaagcartggctatcaagaggaggaagtcaaagcaaagcagaccagtcaagagcaaaggtaatggcaacagtttttttaggatactcaaggtattttccttgttgac

SEQ ID NO: 61659 - DNA, 201 bp, Homo sapiens
ttataaattacccagtccccagcagttctttatagaagtgtgaaaacagactaatacaatcctgaagcatttcatcaaagaattgtaacaggagatgaaayatggcttcaccagtatgatcctgaagaaaaagcacaatcaaagcagtggctatcaagaggaggaagtcaaagcaaagcagaccagtcaagagcaaaggta

SEQ ID NO: 61660 - DNA, 201 bp, Homo sapiens
tgttcagttcccacctatgagtgagaacatgcagtgtttggttttttgtccttgcgagaatttgctcagaatgatggtttccagcttcatccatgtccctrcaatggatcatcctttttaatggatgcatagtattccatggtgtatatgtgccacattttcttaatccagtctatcattgattgacatttgggttggttc

SEQ ID NO: 61661 - DNA, 201 bp, Homo sapiens
caccacagaccaagagctccacttgcacagtgctgctggctaagaagaagttgctgtacctgagcactggaccacatggactcacagagactcccaaccargtaaaggggtgatatggcttgtggatgtcaaccatattctcttcttgatcacctcgctgctggaacaatgggccatggtcagagtagagtggtcatggag

SEQ ID NO: 61662 - DNA, 201 bp, Homo sapiens
atgtccagtcctgatggtcctgtccatccctaagggattatgattccaatcttctttagctactgtggagcatttgggcttttcctttccctaagctcccwtgcaagttgtaccattctttttgctatttaaggcatgcagtaggcaataattcaatgtatggggttccaatcctgggtgccctggcttttgcccttggca

SEQ ID NO: 61663 - DNA, 201 bp, Homo sapiens
catcactttgtgaggaaaaaaattcatcttgtttgtgccctaattgaagagaactgacaacagcagaaacaatagccaacaccatagacatctcagttggktcagtttacacaattctgactgaaaagttacagtggagcaaactttcaactcgataggtaacaaaactgttgtacccagatctgctacagttaagagcag

SEQ ID NO: 61664 - DNA, 201 bp, Homo sapiens
tagatgacatttacatacataattaggtccactgttgacaatatacctttgctcagaatgatctaattatcagcagaacaaaggtgagcttgtttatggaragtcccaactacatctctgggtaaggaccagtgcacctggtccagtttatacaccactccagcttccctggattccacttgcattgactgcttgctttgc

SEQ ID NO: 61665 - DNA, 201 bp, Homo sapiens
tattatgatggaaattaaaggtgatgtttttaagatctggggatataaaaatagactggcatataaaccaggccaggtgttagctataattcttttagcartggtgtttatgcccagttaaattcaatatcctcatgggagaagggagataactgagataaaataggcaaattagttaatgaaaaattgaaaaatagaata

SEQ ID NO: 61666 - DNA, 201 bp, Homo sapiens
ctgctctgacctcagggtctggggccacaggaacagcattcctgaacctcgacgtctgtggagatgccaggtcttctccaggggctgcaccttgtcttctyctttttcccttccactaagacttttagatgcccccatccctagtctgacccctaaccagacatctgttcccagtgggaccttttgtaggagctgagagac

SEQ ID NO: 61667 - DNA, 201 bp, Homo sapiens
atttaggcattggttaagagaggattaactagatgtgaagaaattacccagaatgcaacagagaaaaagagatagaaaatgtaaaagagagggtatgagaygaggatgataaactgagaaattataattcttctatttggtgttccagaagagaggagtcagagaagaggacagagaaaatatttgatgaaataatagctg

SEQ ID NO: 61668 - DNA, 201 bp, Homo sapiens
acgcctggcttggagggtcccacacccacagagacttgctcactgctagcacagcagtctgagatcgaactgcaagtcggcagcgaggctgggggaggggwgcccgccattgctgaggcttcagtaggtaaacaaagtggctgggaagctcgaactgggtggagcccatggcagctcgaggaggcctgcctgcctctgtag

SEQ ID NO: 61669 - DNA, 201 bp, Homo sapiens
ctcaggctctgagatgttacttgccaaatgctattcacataaccattttacatatttctgttactgtatggtagaaccaatcaactaaccaattaatcgascaaccaaccaaaatcctaattctggagacacattggataaaggatcctagaaatctcccttcctttttataagatagtctgctctgacctcagggtctgg

SEQ ID NO: 61670 - DNA, 201 bp, Homo sapiens
acctctctgtaccttagtttccttacagtaattgaggataacaagtacctgcctcatagaattgctatgaagactaagttaatacatttaaatctcagatmagtccacagcacatagatttgatagatgtcaatcatcatcatcatcatcatcatcatatgaaattattagctggggtgttagaaatataagaagagacag

SEQ ID NO: 61671 - DNA, 201 bp, Homo sapiens
actccctggcaagcacttctgatggtttaggttgtttattcaataaggcaaatcggatctttatctctaaggttaccgtgccattgttaaggcaggatttytgcaattgtgtgttatagttatcactgggtagaagcatcaagaagtgtcttgtactgcttcctgggccacaattacattgttttgtggcaacaacttgat

SEQ ID NO: 61672 - DNA, 201 bp, Homo sapiens
acccattaagtaatttctcatcacgggagtatctcgattggatttcctcagaaacagaccctgatacaaaaatttgagtgcaaatagtttgtttgtgatgkgattcctggaagcactgatgggtgagtgaagaagtgaaacagagaaggaaagaaaatacagggtgtttcaatgagcaaattacctctgtgggcacctggg

SEQ ID NO: 61673 - DNA, 201 bp, Homo sapiens
agctgttaattgaatgcaaacagtactacttgatgaaacaaatggtggaaaatgccttattatgatggaaattaaaggtgatgtttttaagatctggggayataaaaatagactggcatataaaccaggccaggtgttagctataattcttttagcaatggtgtttatgcccagttaaattcaatatcctcatgggagaag

SEQ ID NO: 61674 - DNA, 201 bp, Homo sapiens
tgaatctcaggtttttgaatagtgtctaatgaatcccaagtttctgactccagcctgaatatttttcctgaattctaggcttaaatatcaaactacctacycaatgtttgtatgtggatgactaatagccatctaaacttaacacaccccataccattctcttgatttccatggccccaaacttgttcctttgctggttct

SEQ ID NO: 61675 - DNA, 201 bp, Homo sapiens
cagctacaggaggctggaccacaaccaacatgaaatttttgctgagtttagacagaaggtcactacgtcactgaggtatctcattgaatacttgattagayagagaaggagatgatggagaagaaagaaagatgacaggagaggataagggggtggccatgacaacagaggaagagagaggactcagagggtgtccccaag

SEQ ID NO: 61676 - DNA, 201 bp, Homo sapiens
ttcctggccactttgtttacctagtcaagcctcagcaatggtggacgcccctcccccagcccaggctgccgcctcacagttcaatcttggactgctgtgcyagcagtgagcaaagctccatgggtgtgggacctgctgagccaggcatgggatataatctcctggtgtgccgtttgctaagaccattggaaaagcacagta

SEQ ID NO: 61677 - DNA, 201 bp, Homo sapiens
aaaattctcttcttgcttcatttcattcatttgctcttcaatcactgatacccttttttccacttgaccgaataggatactgaagcttgtgcatgcctcakgtagttcttgtgccatggttttcagctccatcaggtcatttaaggtcttctctatgctgtttattctagttagccattcatctagtcttttttcaaggtt

SEQ ID NO: 61678 - DNA, 201 bp, Homo sapiens
ggaaagacctggtgggaggtgattggatcatgggggcagtttcccccatgctgtcctcatgatagtgagggtgttcccatgagatctgatggttttataartagcagtttcctgtgggcttttcacttactgtttttcctgccaccatgtgaagaaggtctttgcttcccctttgccttccaccatgattataagtttcct

SEQ ID NO: 61679 - DNA, 201 bp, Homo sapiens
cgtgtgcatgtgtcagagcagagattttatctgctttgttcactcttcaccccagaattttggagagtaccttcattttgtagatgctcaattagtatttwttgagtaaatgaaagaatggtggttgagagtgcaggtcctggaaaaagattccctgagttcaaattccagatcttctctttaacaactgtgtgattttgg

SEQ ID NO: 61680 - DNA, 201 bp, Homo sapiens
actctccaagaacataagtttcccatgtgtcaccaaatctaatccctagttttcagttagttttcttgacctctcagtatcattgggcacctgctgattcsttcctccctttgaaaatgtttggcttcagtgaaagacattctcttctcggctttctcctaccttttttcagtctctgatgcttgctccacctctgctaag

SEQ ID NO: 61681 - DNA, 201 bp, Homo sapiens
agtaccttcattttgtagatgctcaattagtatttattgagtaaatgaaagaatggtggttgagagtgcaggtcctggaaaaagattccctgagttcaaaktccagatcttctctttaacaactgtgtgattttgggcaagtttcttaacctctctgtaccttagtttccttacagtaattgaggataacaagtacctgcc

SEQ ID NO: 61682 - DNA, 201 bp, Homo sapiens
tataagaatgtatatgtttgcaagaacttttcttagggaggggcagaggctgagaagaattcaagtttgttgggcagtgtgtggagagaggagtgctatgragctgtcagagcacaatatttacaagcatcagatgttcctgaacattctggagctgtactctatacaagttctgacagtaggataaggcttctttgtttc

SEQ ID NO: 61683 - DNA, 201 bp, Homo sapiens
gtttcttaacctctctgtaccttagtttccttacagtaattgaggataacaagtacctgcctcatagaattgctatgaagactaagttaatacatttaaawctcagatcagtccacagcacatagatttgatagatgtcaatcatcatcatcatcatcatcatcatatgaaattattagctggggtgttagaaatataaga

SEQ ID NO: 61684 - DNA, 201 bp, Homo sapiens
gattggggtggccaagagctttgtcatgcgtatggtaatagcttataagtatttattcccaaatggctaagaaattaactgagcaccatttattttaccayagtttctgtgtttactatatactaaatgttttctataggctagagccattatctgagctctctagtcagtttcatggatctatctggtcaattcttgtag

SEQ ID NO: 61685 - DNA, 201 bp, Homo sapiens
agttcagtggtgtgaacacagctcactgcagcctcaatctcccaggtttagcaattctcccacctcagcctcctgagtagggtagctgagactacaggcaygtgccaccatgcccagctagtttttgtattttttgtagagatggcatctcaccatgtcacccaggttggtatcaaactcctgagctcaaatgatcctcct

SEQ ID NO: 61686 - DNA, 201 bp, Homo sapiens
gattgtaaacgcaccaatcagcaccctgtcaaaacagaccaatcagctgtctgtaaatcagacaaatcagctctctgtaaaatggaccaatcagcaggatrtgggtggggccagataagggaataaaagcaggccgccccagccagcagtggcaacctgctcgggtccccttccacactgtggaagctttgttcttttgct

SEQ ID NO: 61687 - DNA, 201 bp, Homo sapiens
tggtgtgaacacagctcactgcagcctcaatctcccaggtttagcaattctcccacctcagcctcctgagtagggtagctgagactacaggcacgtgccaycatgcccagctagtttttgtattttttgtagagatggcatctcaccatgtcacccaggttggtatcaaactcctgagctcaaatgatcctcctgcctcag

SEQ ID NO: 61688 - DNA, 201 bp, Homo sapiens
catttttgaatattcttttttcttcaattcgcactatattgtacttataactagatttggagttgggattcccaagctctgaggcaagcagggagggagcygttggaggccccttgatgtttgcgcctttggagtaggatgattgtgaaagcagtagaaggacttcagaaccaggaaggtcatctcctcctgtacctctcc

SEQ ID NO: 61689 - DNA, 201 bp, Homo sapiens
attgtacttataactagatttggagttgggattcccaagctctgaggcaagcagggagggagccgttggaggccccttgatgtttgcgcctttggagtagsatgattgtgaaagcagtagaaggacttcagaaccaggaaggtcatctcctcctgtacctctcccttaccccaggctctggtaaccaccattctacttatt

SEQ ID NO: 61690 - DNA, 201 bp, Homo sapiens
attttttgagagaggtctattaggttctttgcccattttaaaattgggttatttgctttcttgctattgaattgacttctttatttgttttgaatattaamcccttattagatgtgtgatttgcaaatattttctcccattctattgattgtttcttcactctgttgattgtttccttggttgtgcagaagacttttagtt

SEQ ID NO: 61691 - DNA, 201 bp, Homo sapiens
cagtgtggactctgtgtgggtctcccatcccacatttcccttccacactgacctagcagagattctccatgagggctctgcccctgcagcaaacttctgcytgagcatccaggcatttccatacatcttttgaaatctaggcagaggttcccaagcctcacttcttgatttctctgcacctgcagacccaacaccatgtgt

SEQ ID NO: 61692 - DNA, 201 bp, Homo sapiens
gccacatgcaagtccaaaatccaatagggcagtcgttaaaccttaaagttccaaaatgatctcttttgactccatgtctcacatccaggtcacactgatgyaagaggtgggttttcacagtcttggggagccctgccccttggctttgcagggtacagccccaacttctagctgctttcacaggctggcattgagtgtctg

SEQ ID NO: 61693 - DNA, 201 bp, Homo sapiens
acctgaggggttcctagggagggagatgtaggctagtccatcttctcctccatggatcaacataggccagacccagctacaggaggctggaccacaaccarcatgaaatttttgctgagtttagacagaaggtcactacgtcactgaggtatctcattgaatacttgattagacagagaaggagatgatggagaagaaaga

SEQ ID NO: 61694 - DNA, 201 bp, Homo sapiens
cattggataaaggatcctagaaatctcccttcctttttataagatagtctgctctgacctcagggtctggggccacaggaacagcattcctgaacctcgaygtctgtggagatgccaggtcttctccaggggctgcaccttgtcttctcctttttcccttccactaagacttttagatgcccccatccctagtctgacccc

SEQ ID NO: 61695 - DNA, 201 bp, Homo sapiens
agatagaaaatgtaaaagagagggtatgagacgaggatgataaactgagaaattataattcttctatttggtgttccagaagagaggagtcagagaagagracagagaaaatatttgatgaaataatagctgattgttttctagaattaaagaaagatatgaatcctcagattcagtaaacaaaatgagtttcaagtaaga

SEQ ID NO: 61696 - DNA, 201 bp, Homo sapiens
tgctgagccaggcatgggatataatctcctggtgtgccgtttgctaagaccattggaaaagcacagtattagtgcgggagtgtcccaattttccaggtacygtctgtcacggcttcccttggctaggaaagggaattccccgacctcttgtacttcccgggtgaggtgatgccccaccctgcttcagctcacactctgtgt

SEQ ID NO: 61697 - DNA, 201 bp, Homo sapiens
gtgagcaaagctccatgggtgtgggacctgctgagccaggcatgggatataatctcctggtgtgccgtttgctaagaccattggaaaagcacagtattagkgcgggagtgtcccaattttccaggtactgtctgtcacggcttcccttggctaggaaagggaattccccgacctcttgtacttcccgggtgaggtgatgcc

SEQ ID NO: 61698 - DNA, 201 bp, Homo sapiens
gcctccttgagctgtggtgggcttcacccagttcgagcttcctggccactttgtttacctagtcaagcctcagcaatggtggacgcccctcccccagcccrggctgccgcctcacagttcaatcttggactgctgtgccagcagtgagcaaagctccatgggtgtgggacctgctgagccaggcatgggatataatctcct

SEQ ID NO: 61699 - DNA, 201 bp, Homo sapiens
agttttcttgacctctcagtatcattgggcacctgctgattcgttcctccctttgaaaatgtttggcttcagtgaaagacattctcttctcggctttctcstaccttttttcagtctctgatgcttgctccacctctgctaagttcttaaaatattggtattcctcagagctggatcctaggaccttctctttccaatctg

SEQ ID NO: 61700 - DNA, 201 bp, Homo sapiens
tgaataatgttaaactttgttaaatgtaaatttaaaaattaaggctaaatattgcatattagaagtaaagtgtgcacttctaaatcagtagagggaaacarttgaataagataatctaatcaatttaaaagttatcaggaaaagataaaaagaggatgcttggaaaaaactagaaaggccaaaataagataacagaaataa

SEQ ID NO: 61701 - DNA, 201 bp, Homo sapiens
tcaagacggtcttaggggacaggagctggtggcgggaggggagacagcactccgagcaacctcagcgtgcctcgagggggacaggcatccgggaggccagmggctgagctgggttctgggcgctggcaggtcagcagggcagggaagagaagggcatcgagggtgggcctgggggcttcccagcagccagcccctgtgact

SEQ ID NO: 61702 - DNA, 201 bp, Homo sapiens
ccggtgaggagaggccttgcctgtcccagaggcctggtcccgctcagccaggtcatgggacagtggaaaggccccgctggaacctaggaggaagtggcgcwggtcaagacggtcttaggggacaggagctggtggcgggaggggagacagcactccgagcaacctcagcgtgcctcgagggggacaggcatccgggaggcc

SEQ ID NO: 61703 - DNA, 201 bp, Homo sapiens
agttgccggtgaggagaggccttgcctgtcccagaggcctggtcccgctcagccaggtcatgggacagtggaaaggccccgctggaacctaggaggaagtkgcgcaggtcaagacggtcttaggggacaggagctggtggcgggaggggagacagcactccgagcaacctcagcgtgcctcgagggggacaggcatccggg

SEQ ID NO: 61704 - DNA, 201 bp, Homo sapiens
aggcagggcaggctgaaagtagcagaggctgtgttgtgattggcggtcagcggtccggagtccaccgagggctgggctggatgtgaagggttgagttgcckgtgaggagaggccttgcctgtcccagaggcctggtcccgctcagccaggtcatgggacagtggaaaggccccgctggaacctaggaggaagtggcgcagg

SEQ ID NO: 61705 - DNA, 201 bp, Homo sapiens
tgtctgatgttttttcttattgattgataggcacaacttgtaagttctgcatgtgagccctttgttgatatatgtgttgcaaggatcttctcccattctayggtttgcctttttcgctcacttaaaggtgtcttttcatgagcaaaagtccttcttgtagtctcatttttaaaatcgtttttcctttaaggcgataattct

SEQ ID NO: 61706 - DNA, 201 bp, Homo sapiens
aaattctggacacattagtaccagctcagatcctatacacaagacctcccaaaagtgctgcatattttgtaggttcctttggcaaaggattggaacaataytttctgaaggtcagatgaagcataatggaaggacccaaagtcaccagttctctcagatgcaactggggcagtgagaaactaaagaaaatattcataaaat

SEQ ID NO: 61707 - DNA, 201 bp, Homo sapiens
tcacatggtggcaggaaggagacgtgccaagcaaaagtgggaaaagcctcttataaaacaatcaggtctcttgagaacccactcactttcacaagaacagyagcatgggggtaattgcccccatgattcaattacttcccaccgggttcctcccatgacatgtggggattatgggaactacaattcaagatgagatttggg

SEQ ID NO: 61708 - DNA, 201 bp, Homo sapiens
tcagatcctatacacaagacctcccaaaagtgctgcatattttgtaggttcctttggcaaaggattggaacaatactttctgaaggtcagatgaagcatartggaaggacccaaagtcaccagttctctcagatgcaactggggcagtgagaaactaaagaaaatattcataaaatggtatacaagtaggggcaacacaca

SEQ ID NO: 61709 - DNA, 201 bp, Homo sapiens
ttttccagtttctaagagaatcaatgacacacttggttaagagtcaagaactttgtgtgaccacagaagtccttttaccttattgggtcctactcatacarttaggattttggattatgtgatagcaataatagctaactatgttgagcccttatgtgttttaagcaagtattagcttgctttcaataactacataagata

SEQ ID NO: 61710 - DNA, 201 bp, Homo sapiens
tttgcccactttttgatggggttgtttttttcttgtaaatttgtttaagttctttgtagattctggatattagctctttgtcagatgggtagactgcaaamattttcttccattcgctacagtccatacttttacagtgagtcctgaggtcattattaacagtcattatcttcctttagcaccttttctgcattccctacc

SEQ ID NO: 61711 - DNA, 201 bp, Homo sapiens
actttctaatcatctgagtggtcaaaaagtggagtacgtcacccaggcttggggatcaccaggtgaagatgaggtagcagaatttaagcaatgggttaggrtggtacatgagtaaattaactaagttcctttaaatgaattttccagtttctaagagaatcaatgacacacttggttaagagtcaagaactttgtgtgacc

SEQ ID NO: 61712 - DNA, 201 bp, Homo sapiens
aataaccaggaagcagatttttagttcaagaactttctaatcatctgagtggtcaaaaagtggagtacgtcacccaggcttggggatcaccaggtgaagaygaggtagcagaatttaagcaatgggttaggatggtacatgagtaaattaactaagttcctttaaatgaattttccagtttctaagagaatcaatgacaca

SEQ ID NO: 61713 - DNA, 201 bp, Homo sapiens
atgaaggccctctgggcagaaataaccaggaagcagatttttagttcaagaactttctaatcatctgagtggtcaaaaagtggagtacgtcacccaggctwggggatcaccaggtgaagatgaggtagcagaatttaagcaatgggttaggatggtacatgagtaaattaactaagttcctttaaatgaattttccagttt

SEQ ID NO: 61714 - DNA, 201 bp, Homo sapiens
cataggtgagggttccctctctctgaaagggtggtgggatccaggttacatccctgttcgtaggagtcagggttagaagttaattgttatggagtgatcaraagatgtttccctggctcctgcaatgcctccgacccccttggtggcctctgttacatagggattggaagactccctcttgaggggtgtggcttcaaaaaa

SEQ ID NO: 61715 - DNA, 201 bp, Homo sapiens
acacagaatgcaaatgaaggccctctgggcagaaataaccaggaagcagatttttagttcaagaactttctaatcatctgagtggtcaaaaagtggagtasgtcacccaggcttggggatcaccaggtgaagatgaggtagcagaatttaagcaatgggttaggatggtacatgagtaaattaactaagttcctttaaatg

SEQ ID NO: 61716 - DNA, 201 bp, Homo sapiens
cattgtctttatatgattggagggtggtttggatttgaagtgttagatttgttttacttgttcaggtgtgaacacagaatgcaaatgaaggccctctgggmagaaataaccaggaagcagatttttagttcaagaactttctaatcatctgagtggtcaaaaagtggagtacgtcacccaggcttggggatcaccaggtga

SEQ ID NO: 61717 - DNA, 201 bp, Homo sapiens
ggcctgaggagtcatgggtagggcagggggccttgcctcctgctcttgcatgtggtctttcacaacagctgaacatatgggggacctgtcccaggaaagcrtcaaccctggaccctgagggatatgtccagagaagtgaggaggctggaggaatgagagctattagtcagagaaagaaaagacctggagaggtatgaccat

SEQ ID NO: 61718 - DNA, 201 bp, Homo sapiens
aatttaatttcctttacaccttccattccttgccttatgccaacctccccaacccctcagattattttgaagcaaatcccagacatcaccaaatactcttstacaccatgagtatgggtctcaagttagggaagtgatctggttctaatttgtatacttggcttgccccactcctccagtggcctgaggagtcatgggtag

SEQ ID NO: 61719 - DNA, 201 bp, Homo sapiens
caatacatggccaatttaatttcctttacaccttccattccttgccttatgccaacctccccaacccctcagattattttgaagcaaatcccagacatcamcaaatactcttgtacaccatgagtatgggtctcaagttagggaagtgatctggttctaatttgtatacttggcttgccccactcctccagtggcctgagg

SEQ ID NO: 61720 - DNA, 201 bp, Homo sapiens
ggaagaatcctatttcaaagtgaaaggaggagttcatcttcttgtattggatcctgtgtcagaaatatttttaaaagattttattataaaagttttcaaaygcatacaaaagtaggaaggattgtatagtgaactcaatgtatctgttcctcaccttccatcataatcaatacatggccaatttaatttcctttacacctt

SEQ ID NO: 61721 - DNA, 201 bp, Homo sapiens
gtcagggctcagcagtgtccagtttccaggcctcattacagctgctcccatgaggggttcccccagcactgggcctggagagttatgagtctctcctgtamtttctgctctggggacctggttccacaatcttccgggaaggtctttctggtgtatgtgctctgtttcagtttatattctggactcctatgaagatgtttc

SEQ ID NO: 61722 - DNA, 201 bp, Homo sapiens
ctaatcatacagtgattctaggatgaaatgagataatatatgtgaccttgcattattctacacaaatgacaccacttcacatcttatatttttctcaaaasaaggatattacaatttcttttctccaaccagatcttggacaagctgtgctcctctgagacagtaacatcagacaaaagtctcatagaccgtgatctctga

SEQ ID NO: 61723 - DNA, 201 bp, Homo sapiens
tctccaaccagatcttggacaagctgtgctcctctgagacagtaacatcagacaaaagtctcatagaccgtgatctctgacagggcgagtactgaaccagscgtattcacctttgaaagcctgggacgatgtaggccctcaggaggatttgtttattgattgatggcaggactgtggcccagaaaacttttcactcgaaag

SEQ ID NO: 61724 - DNA, 201 bp, Homo sapiens
ctggaccacatggactcacagagactcccaaccaggtaaaggggtgatatggcttgtggatgtcaaccatattctcttcttgatcacctcgctgctggaayaatgggccatggtcagagtagagtggtcatggaggttgaatagatgccatgaatgggtccaagaacatggacactctctttcaccaaaatcaattcgggt

SEQ ID NO: 61725 - DNA, 201 bp, Homo sapiens
gttatttgctttcttgctattgaattgacttctttatttgttttgaatattaaccccttattagatgtgtgatttgcaaatattttctcccattctattgrttgtttcttcactctgttgattgtttccttggttgtgcagaagacttttagttagatgcaatcctatttgtctatttttgctttgttgcctgtgtttttg

SEQ ID NO: 61726 - DNA, 201 bp, Homo sapiens
aaagtataataaaaaaaagaaaaaaaaaattaaaaagtttttcaaattttaattttttcagttttatttatttattactattaatatttatttatttattwgtttttgagacagaatctcacccttttgcccaggctggagtgcagtggcacaatcttggctcactgcagcctctacctcccgggttcaagcaattttcat

SEQ ID NO: 61727 - DNA, 201 bp, Homo sapiens
ggttgaagaggccagtgtggcaccaacagctctttccacactccttgcccaagaggaagttgtcttctttgggttcacactacagggcagacccagccackggcctcagggcatccttaaagcttttcctaggtagttcctcccagctcaggctctggatgatcctgaggatgtcctcctcactccctatcttctgcccca

SEQ ID NO: 61728 - DNA, 201 bp, Homo sapiens
catcagagtgaacaggcaacctacagtatgggagaaaatttttgcaatctacccatccgacaaagggctaatatccagaatctataaagaactgaaacaartttacaagaaaaaatcaaacaaccccattaaaaagtgggcaaaggatatgaacagacacttctcaaaagaagacatttatgcagccaaaagacacatgag

SEQ ID NO: 61729 - DNA, 201 bp, Homo sapiens
ctccttaagctgataagcaacttcagcaaagtctcagcatacaaaatcaatgtgcaaaaatcacaagcattcctatacaccaataacagacaaagagagagccaaatcatgagtgaactcccattcacaattgcttcaaagaatataaaatatgtagaaatccaacttacaagggatgtgaaggacctcttcaaggagaat

SEQ ID NO: 61730 - DNA, 201 bp, Homo sapiens
tctccttaagctgataagcaacttcagcaaagtctcagcatacaaaatcaatgtgcaaaaatcacaagcattcctatacaccaataacagacaaagagagagccaaatcatgagtgaactcccattcacaattgcttcaaagaatataaaatatgtagaaatccaacttacaagggatgtgaaggacctcttcaaggagaa

SEQ ID NO: 61731 - DNA, 201 bp, Homo sapiens
tgatccaccatgatcaagtgggcttcatccctgggatgcaaggctggttcaacatacagaaatcagtaaacataatccatcatataaacagaaccaatgayaaaaaccacatgattatctcaatagatgcagaaaaggcctttgacaaaattcaacaaccttcatgctaaaaactctcaataaattaggtattgatgggac

SEQ ID NO: 61732 - DNA, 201 bp, Homo sapiens
agccggctccctttgcttgcggggaggtgtggagggagaggcgcaggtgggaaccggggctgcgcgcggcactcgggggccagtgtgagttccgggtgggygtgggatcggcggcccatgctagggcttagcacctgggccagcagctggggagggtgcaccgggttctctagcagtgccagctggcaggtgctgcacttg

SEQ ID NO: 61733 - DNA, 201 bp, Homo sapiens
agcacctgggccagcagctggggagggtgcaccgggttctctagcagtgccagctggcaggtgctgcacttgaattcttgccaggcctcagctgcctctcygtggggcagagctcggaacctgcagcccgccatgcccaagcctccccactgccctgggctcctgcgcagcctgagcctcctcgacaagcactgccccctg

SEQ ID NO: 61734 - DNA, 201 bp, Homo sapiens
ccagcagctggggagggtgcaccgggttctctagcagtgccagctggcaggtgctgcacttgaattcttgccaggcctcagctgcctctctgtggggcagrgctcggaacctgcagcccgccatgcccaagcctccccactgccctgggctcctgcgcagcctgagcctcctcgacaagcactgccccctgctccagggct

SEQ ID NO: 61735 - DNA, 201 bp, Homo sapiens
atgtcagggctcagcagtgtccagtttccaggcctcattacagctgctcccatgaggggttcccccagcactgggcctggagagttatgagtctctcctgyactttctgctctggggacctggttccacaatcttccgggaaggtctttctggtgtatgtgctctgtttcagtttatattctggactcctatgaagatgtt

SEQ ID NO: 61736 - DNA, 201 bp, Homo sapiens
gcctgtttgaaggggtcgctgccatgggctgagtcagggcattgaggtctggatgtcagggctcagcagtgtccagtttccaggcctcattacagctgctyccatgaggggttcccccagcactgggcctggagagttatgagtctctcctgtactttctgctctggggacctggttccacaatcttccgggaaggtcttt

SEQ ID NO: 61737 - DNA, 201 bp, Homo sapiens
cagcttggccagtgcttgtgatgggcaagcctggggcatccccttctcatgggttgggtgaagcctctagtgctgaaggacaaagctcacacaactccccrcttttggctgtcagcaccagccagacaggagcaagaaccaggaacaactcccagcatctcagaatcaaatctccactcctggatgctctagtctttcctg

SEQ ID NO: 61738 - DNA, 201 bp, Homo sapiens
gcctggccagcagtgtgttttgacttgagcagccttggcttctttctctttccctcagcagcggggagtcagcttggccagtgcttgtgatgggcaagccwggggcatccccttctcatgggttgggtgaagcctctagtgctgaaggacaaagctcacacaactccccgcttttggctgtcagcaccagccagacaggag

SEQ ID NO: 61739 - DNA, 201 bp, Homo sapiens
tgtgtagctaggattacagacccacactactgggcctggccagcagtgtgttttgacttgagcagccttggcttctttctctttccctcagcagcggggastcagcttggccagtgcttgtgatgggcaagcctggggcatccccttctcatgggttgggtgaagcctctagtgctgaaggacaaagctcacacaactccc

SEQ ID NO: 61740 - DNA, 201 bp, Homo sapiens
tggcttttctccagtccttctcccttttcagacaggcggcacagctagagaaatatgtaaagatcaggggaagcctgttttgcatagtgagagtcttgcaygcttgggacatcaggacagcctccaggggttctaagtgtgtgtggactattctcagggaagaaatgctggagggccttgggctgacattctagctcctcc

SEQ ID NO: 61741 - DNA, 201 bp, Homo sapiens
caggcttgccttagagctctcatactgacaaaccctttaattacatgtattgtgctgtgtattggcatgtagtcagtgttcagtgttttttggagttgttktttgctttttttgtttttatagacagagtctcactctgttgcccaggctggaatacagtggcacaatcatagctcactgtagcctcgaaatcctgggctc

SEQ ID NO: 61742 - DNA, 201 bp, Homo sapiens
tttgtatttttagtggagacagggtttcaccttgttggctaggctggtctcaaactcctgacctcaagatatctgccagcctcagcctcccaaagtgctgrgattacaggcataagccactgcacccagccaatattaatttttaaattgacaaatacaaattgtacatatttacagtgtacaacatgaagttttgataca

SEQ ID NO: 61743 - DNA, 201 bp, Homo sapiens
ggtggtggaatttgttcacagaatctcttgctgccagaccaccagttggctgtgggtccttcctctattgcagcccacagctcctgccctatagctgcaaytggcaccatagaggtagaacttccactctcttcccaggtttcaagaaccactccttctccaggccccttcctgctggtaggcagtggtggcttctcactc

SEQ ID NO: 61744 - DNA, 201 bp, Homo sapiens
aaatgatgtgtcctgtttctctttagtagaaattatatttttggctaccagttaagaaacttgtactcctttgtcccttatgttactataaactcaagatratgagttttgtggtatttgacttcataggcaaaatcaaaatttttactttgttgctattctgttttatgaaataaacttctgtctatgcatttgaactaa

SEQ ID NO: 61745 - DNA, 201 bp, Homo sapiens
cattttcattcaaaatcatccctaaacttcatgttaatttcacctgagaaggactattttatgcattttagaggttggaagcaaaaaacaaacaaacaaamaaaaacagttgtttctactaggaaggtcaaagaaaataaaagttactccatttttactgccacaggatgcaggaagtgctggcccacatctaggacagca

SEQ ID NO: 61746 - DNA, 201 bp, Homo sapiens
tgaggtttcgccgtgttagccaggatggtctggatctcctgacctcgtgattcgcccgccttggcctcccaaagtgctgggattacaggcgtgagccaccwcgcccggcctaaaatcttgttattttaagttgagcattttcattcaaaatcatccctaaacttcatgttaatttcacctgagaaggactattttatgcat

SEQ ID NO: 61747 - DNA, 201 bp, Homo sapiens; identical to SEQ ID NO: 32409

SEQ ID NO: 61748 - DNA, 201 bp, Homo sapiens; identical to SEQ ID NO: 32383

SEQ ID NO: 61749 - DNA, 201 bp, Homo sapiens; identical to SEQ ID NO: 32427

SEQ ID NO: 61750 - DNA, 201 bp, Homo sapiens; identical to SEQ ID NO: 32429

SEQ ID NO: 61751 - DNA, 201 bp, Homo sapiens
aaccctcaagcttcctatcctagcctgaccctatggtgtgggaggagggaaaggtaagggcagtggaaggccagagagaaacagaatttcttcccttagayggctcccctccaggccctgtcctacctcccagagccccttcccttctctcctctgagtaccagatcctccctgatacccccgaccccatgggcatcctct

SEQ ID NO: 61752 - DNA, 201 bp, Homo sapiens; identical to SEQ ID NO: 19096

SEQ ID NO: 61753 - DNA, 201 bp, Homo sapiens
attaatatacaccagtggttcctcctccctgttaaagactaatgctcagatgctgtttacggatatttatattctagtctcactctcttgtcccacccttyttctcttccccattcccaactccagctaaaatatgggaagggagaacccccaataaaactgccatggactggactctattcattcattcattcatttatc

SEQ ID NO: 61754 - DNA, 201 bp, Homo sapiens
tgggagggcctgcctctcaggtgctgatctgcatacacctcagaggcctccctcccaccttacctagccaagccacaagtaaaatattcagcaggtgacasggaagaatcaagcatagagtgataaagaatatgtgagagacttggatgtagtatgtcgggtgtatatgtgtgcttgtagccatgtgggcaaacaggtatc

SEQ ID NO: 61755 - DNA, 201 bp, Homo sapiens
acccctataatgatcctgtgtcctaaattaatatacaccagtggttcctcctccctgttaaagactaatgctcagatgctgtttacggatatttatattcyagtctcactctcttgtcccacccttcttctcttccccattcccaactccagctaaaatatgggaagggagaacccccaataaaactgccatggactggac

SEQ ID NO: 61756 - DNA, 201 bp, Homo sapiens
attttacatatatatctctatctatctatctatatacacacacacacacatacacacacacacacacacacacacacacacacacatatatatatatatakagagagagagagagagagagagataaccctttaggaaggtaggactctgttcttgtgcttgggagtaaggcaaggatatagccaagacaaacagacggga

SEQ ID NO: 61757 - DNA, 201 bp, Homo sapiens; identical to SEQ ID NO: 19099

SEQ ID NO: 61758 - DNA, 201 bp, Homo sapiens
tatacaccagtggttcctcctccctgttaaagactaatgctcagatgctgtttacggatatttatattctagtctcactctcttgtcccacccttcttctyttccccattcccaactccagctaaaatatgggaagggagaacccccaataaaactgccatggactggactctattcattcattcattcatttatcataga

SEQ ID NO: 61759 - DNA, 201 bp, Homo sapiens
tggcatcacatatgcctgcatgccattaacaccagctggccctacccctataatgatcctgtgtcctaaattaatatacaccagtggttcctcctccctgktaaagactaatgctcagatgctgtttacggatatttatattctagtctcactctcttgtcccacccttcttctcttccccattcccaactccagctaaaa

SEQ ID NO: 61760 - DNA, 201 bp, Homo sapiens
gtacaatatcaccatcaccgtcaccgacttggggatacccaggctgaaaaccgagcacaacacaactgtgttggtctctgacgtcaatgacaacgcccccrccttcacccaaacctcctacaccctgttcgtccgcgagaacaacagccccgccctgcacatcggcagtgtcagcgctacagacagagactcaggcaccaa

SEQ ID NO: 61761 - DNA, 201 bp, Homo sapiens
gaagacctcccattcgtgctaaaatcttcagttgagaattactacacgttggaaacagagagaccactggacagagagagcacagccgagtacaatatcaycatcaccgtcaccgacttggggatacccaggctgaaaaccgagcacaacacaactgtgttggtctctgacgtcaatgacaacgcccccaccttcacccaa

SEQ ID NO: 61762 - DNA, 201 bp, Homo sapiens
ctggggacaacggaagaattgtttgttccattccggaagacctcccattcgtgctaaaatcttcagttgagaattactacacgttggaaacagagagaccrctggacagagagagcacagccgagtacaatatcaccatcaccgtcaccgacttggggatacccaggctgaaaaccgagcacaacacaactgtgttggtct

SEQ ID NO: 61763 - DNA, 201 bp, Homo sapiens
tatcaccatcaccgtcaccgacttggggatacccaggctgaaaaccgagcacaacacaactgtgttggtctctgacgtcaatgacaacgcccccaccttcwcccaaacctcctacaccctgttcgtccgcgagaacaacagccccgccctgcacatcggcagtgtcagcgctacagacagagactcaggcaccaacgccca

SEQ ID NO: 61764 - DNA, 201 bp, Homo sapiens
tctacttggtggtggcgttggcctcggtgtcttcgctcttcctcttctcggtgctcctgttcgtggcggtgcggctgtgcaggaggagcagggcggcctckgtgggaagctgctcggtgcctaagggcccctttccagggcatctggtggacgtgagcggcaccgggaccctttcccagagctaccagtacgaggtgtgtc

SEQ ID NO: 61765 - DNA, 201 bp, Homo sapiens
cacagaggatttggtggacaagtcagagacgcgttccgcagagctgaagcctttcttcaagaagcctacaagaaaggaactatggagaaccaagggacacrcactcagcagataaggcaagtcctgcttctctttgttttgctcggaatgtctcaggcgggctctgaaacctggagcttttctgtggcagaagaaatgcag

SEQ ID NO: 61766 - DNA, 201 bp, Homo sapiens
ctgacgtcaatgacaacgcccccaccttcacccaaacctcctacaccctgttcgtccgcgagaacaacagccccgccctgcacatcggcagtgtcagcgcyacagacagagactcaggcaccaacgcccaggtcaactactcgctactcccgccccaggacctgcacctgcccctcgcctccctggtctccatcaacacag

SEQ ID NO: 61767 - DNA, 201 bp, Homo sapiens
gagaccactggacagagagagcacagccgagtacaatatcaccatcaccgtcaccgacttggggatacccaggctgaaaaccgagcacaacacaactgtgytggtctctgacgtcaatgacaacgcccccaccttcacccaaacctcctacaccctgttcgtccgcgagaacaacagccccgccctgcacatcggcagtgt

SEQ ID NO: 61768 - DNA, 201 bp, Homo sapiens
tgtcatcaattaccagtccaatcccagaaaatacgccagagaccgtggttatggtttttagtatccaagatatagactctggggacaacggaagaattgtwtgttccattccggaagacctcccattcgtgctaaaatcttcagttgagaattactacacgttggaaacagagagaccactggacagagagagcacagccg

SEQ ID NO: 61769 - DNA, 201 bp, Homo sapiens
tcaaggacaatggcgagcctccgcgctcggccaccgccacgctgcaagtgctcctggtggacggcttctcccagccctacctgccgctccctgaggcggcmccggcccaggcccaggccgactcgctcaccgtctacttggtggtggcgttggcctcggtgtcttcgctcttcctcttctcggtgctcctgttcgtggcgg

SEQ ID NO: 61770 - DNA, 201 bp, Homo sapiens
ctctcccatcttctcggaaaaacaaatgctcctagaaatcccagagaacagtcccgttggtgctgtgttcttactagaaagtgcgaaggatttagatgtargaatcaatgctgtaaaaagctacacaataagccccaactctcattttcacattaaaatgagagtcattccagacaataggaaataccccgagttagttct

SEQ ID NO: 61771 - DNA, 201 bp, Homo sapiens
ccgggcaggttttaaactcttgacctcatgttccacccgccacggcctcccaaagtgctgtgattaccggtgtgagccactgcgcccggccttttttttttcttttcttttcttttttttgatacagagtcttagtcacccagactagaggtcagtggcaggatctcagctcactgcaacctctgcctcctgggctcaaga

SEQ ID NO: 61772 - DNA, 201 bp, Homo sapiens
ggctggtggtgctggtcaaggacaatggcgagcctccgcgctcggccaccgccacgctgcaagtgctcctggtggacggcttctcccagccctacctgcckctccctgaggcggcaccggcccaggcccaggccgactcgctcaccgtctacttggtggtggcgttggcctcggtgtcttcgctcttcctcttctcggtgc

SEQ ID NO: 61773 - DNA, 201 bp, Homo sapiens
atctttagtagagacggggtttcaccacgttggccgggcaggttttaaactcttgacctcatgttccacccgccacggcctcccaaagtgctgtgattacmggtgtgagccactgcgcccggccttttttttttcttttcttttcttttttttgatacagagtcttagtcacccagactagaggtcagtggcaggatctca

SEQ ID NO: 61774 - DNA, 201 bp, Homo sapiens
acctgcacctgcccctcgcctccctggtctccatcaacacagacaacggccacctgttcgccctcaggtcgctggactacgaggccctgcaggctttcgasttccgcgtgggcgccacagaccgcggctccccggctttgagcagcgaggcgctggtgcgcgtgctggtgctggacgccaacgacaactcgcccttcgtgc

SEQ ID NO: 61775 - DNA, 201 bp, Homo sapiens
ggtggacggcgactcgggccagaacgcctggctgtcgtaccagctgctcaaggccacggagcccgggctattcggcgtgtgggcgcacaatggcgaggtgmgcaccgccaggctgctgagcgagcgcgacgcggccaagcacaggctggtggtgctggtcaaggacaatggcgagcctccgcgctcggccaccgccacgct

SEQ ID NO: 61776 - DNA, 201 bp, Homo sapiens
tccttagaccacagaggatttggtggacaagtcagagacgcgttccgcagagctgaagcctttcttcaagaagcctacaagaaaggaactatggagaaccragggacacgcactcagcagataaggcaagtcctgcttctctttgttttgctcggaatgtctcaggcgggctctgaaacctggagcttttctgtggcagaa

SEQ ID NO: 61777 - DNA, 201 bp, Homo sapiens
ccgccaggctgctgagcgagcgcgacgcggccaagcacaggctggtggtgctggtcaaggacaatggcgagcctccgcgctcggccaccgccacgctgcamgtgctcctggtggacggcttctcccagccctacctgccgctccctgaggcggcaccggcccaggcccaggccgactcgctcaccgtctacttggtggtgg

SEQ ID NO: 61778 - DNA, 201 bp, Homo sapiens
gtggtgacctaccactgcaatcttggaagcagagggagaaaggtgtttgagctcgtgggtgagccctccatatactgcaccagcaaagatgatcaagtggkcgtctggagcggcccagtccctcagtgcattatacctaacaaatgcacacctccaaatgtggaaaatggaatattggtgtctgacaacagaagcttattt

SEQ ID NO: 61779 - DNA, 201 bp, Homo sapiens
atatataacattttttaatgaaaaataacaattttccaaaacaaaataaaattagtgagaatagtggcattgttcacattttttgcacatctcttcaacayctaacttaaaggaagacttggatttgggctgttgtgtaatcacacaatatgtagactttggaaaatatcactatacacttctgcccggcgcagtggctca

SEQ ID NO: 61780 - DNA, 201 bp, Homo sapiens
ctgaaacagctcgctattcactcctattttcttctttagatttcaattaaaaggcagctctgctagttactgtgttttggctggaatggaaagcctttggratagcagtgttccagtgtgtgaacgtaagtaataggagtaacatttcaggccaatctctcctcttcatctgttcagtatttgacccatgacctcccctaa

SEQ ID NO: 61781 - DNA, 201 bp, Homo sapiens
tcagaccagtagtcctcaaagattttttgcctcagggcaccttttacattttaagattaacaaagatcccaaagaggtttcttttatgtgggttatatctrttggtatttatcatattggaattcaaactgagagattttttaaataagtattgattctttttgtttttgtttttgtttttcctaagagagggtaccagta

SEQ ID NO: 61782 - DNA, 201 bp, Homo sapiens
ctgttgaaagcattaagaatgtagtaatcatgagaattcatccttcacaactgagtgtcccctatttaaatctgcaaactcttagagttaaagtagggctsacagaaatgagaaatagaattgccaactaaaaatatgcttgtatccagatgactctgtaaagtgtgacctggttagcctttaccatcatgttgaacaaaa

SEQ ID NO: 61783 - DNA, 201 bp, Homo sapiens
ccctcttaatgccctaatcatttctgaaaggccccatcacctctcactgctgttacactggcaattaaatttcaataagagttttggtagagacaaaccasattcaaacaatagcaataatacactataatatataaacaaagtgagtcttggaggaaaagtgcactgtgaccatgtaaggcagtttcactaagagttttt

SEQ ID NO: 61784 - DNA, 201 bp, Homo sapiens
ttgaaaaaccttatttctgagactgctacaatgtgaagcatctcaagaacaggcactgagcactcggtaatagcctttgttctgcaggacttttaaagtcmtagatattggggatactggacatttaagtgaaatgtgcttttagagagtaaatgtaattttcatagattttctattgctataacacaatacgtgagacta

SEQ ID NO: 61785 - DNA, 201 bp, Homo sapiens
gtgaactaagtgtcctcttggctgaaacagctcgctattcactcctattttcttctttagatttcaattaaaaggcagctctgctagttactgtgttttgkctggaatggaaagcctttggaatagcagtgttccagtgtgtgaacgtaagtaataggagtaacatttcaggccaatctctcctcttcatctgttcagtat

SEQ ID NO: 61786 - DNA, 201 bp, Homo sapiens
gaaaaaccttatttctgagactgctacaatgtgaagcatctcaagaacaggcactgagcactcggtaatagcctttgttctgcaggacttttaaagtcatrgatattggggatactggacatttaagtgaaatgtgcttttagagagtaaatgtaattttcatagattttctattgctataacacaatacgtgagactaga

SEQ ID NO: 61787 - DNA, 201 bp, Homo sapiens
gtgtgccactacacctggctaattttttgtatttttagtagaaatggggtttcaccgtgttagccaggatggtctctatctcctgacctcgtgatccgccsgcctcggcctcccaaactgctgggattacaggcgtgagccactgcacccggcccagtgtagataattcactttactaaaactcacctggaactttgggga

SEQ ID NO: 61788 - DNA, 201 bp, Homo sapiens
gatagtgggagaaggagcaagatggtcaggtttcattgccatttcacttgtagtcaaataccatgaatttctggtaatactaatctgggcagggctgtggrtatgcgtgtacattagttaattttttgcaagcaggtgtgaatgtacagaagttgaacagttcagtggatgcagtgtagatttttttttttttgagacaga

SEQ ID NO: 61789 - DNA, 201 bp, Homo sapiens
tgtgcaactctgccacctgctggcctcaggtcctcaaaatcctgaaattggggctgggccttagattgtgaactaagtgtcctcttggctgaaacagctcrctattcactcctattttcttctttagatttcaattaaaaggcagctctgctagttactgtgttttggctggaatggaaagcctttggaatagcagtgttc

SEQ ID NO: 61790 - DNA, 201 bp, Homo sapiens
gtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactctttga

SEQ ID NO: 61791 - DNA, 201 bp, Homo sapiens
tggcactttgcattaccatataaaatttagaatcagcttgtcaatttccacaaaaagaatcctacttgaatttgtattgagtttctattgacttagtacawcaatttgtagacattaacaaatttagttttgaagtttaaatttatgaacatgatatatcctcccatttttgaagtcttctttaatttcttttaaaaatat

SEQ ID NO: 61792 - DNA, 201 bp, Homo sapiens
tccttcccctctgcagagggcaagccggaggctggtctcagcaggagctagggctctcctcaaaggctttctgaccttggggcaggcttgacatccccatrgccctgcatccctcatcccttttcatgtctactggaggacagtgagccatagctgcagcaatcttgtttaaatttaggtagttgaattttttagaattaa

SEQ ID NO: 61793 - DNA, 201 bp, Homo sapiens
gtggatgtcattccagggaggttctgttccactggtttatttgccatacattgtgtttttgtttggtttagttttttgccatactataatggcaaaaaaaactgtagcattacattaagattttaattactatagcatgacattaatatttgatatctggtggcatatatcttctaactatgtgcatcttcaagatttact

SEQ ID NO: 61794 - DNA, 201 bp, Homo sapiens
tggataggcaattgatctaatatcatttattaaatgttgcaccatggccataagtcaggtgacctatatgtggatgtcattccagggaggttctgttccaytggtttatttgccatacattgtgtttttgtttggtttagttttttgccatactataatggcaaaaaaaactgtagcattacattaagattttaattacta

SEQ ID NO: 61795 - DNA, 201 bp, Homo sapiens
tgcctctctttccccctcacatggaagtcttactcctgttgttttattttttcttctcgtgaaatcctgtgatgacttcctgggccaactccctcatggcygtgtgctgtttccacttaatctccagcttggggctaaggtatcctttgtttgtgatgaagggtgagtgtgacccagtgttgagaccaaggactcagtgtg

SEQ ID NO: 61796 - DNA, 201 bp, Homo sapiens
ccacatctcaaagggaaggattaaaacatttcaccattaacctggtgtttacagtaggctttttgtaggtaaccatttttgaattaaggacattctcatayactcttcattattaaaaattttttgtctttgaaacatgttgaagtttatcgagcactttagttatatgtatcgatgtaatcatatctgtttctctttttt

SEQ ID NO: 61797 - DNA, 201 bp, Homo sapiens
ttactaactatgaggccttcagcaggcataggatatagcaaaagaaattcccccataactaacaagtactctggaactgtcctttctacaatgtgtcagcygcctccagaaatcctgcatggtgagcataccctaagccatcaggacaactttttacctgggcaggaagtgttctacagctgtgagcccagctatgacctc

SEQ ID NO: 61798 - DNA, 201 bp, Homo sapiens
gaattttcttggaaatattaaaaaaaattagtaaaatagaaaaaacaaacaatataataatacacctatacctatatctatatttttatctctgtttctasttctgtaaactctctatacccaaatcctggtaaatggctgtaagtcttcttggagaagactaggggaagatttacaatacatgcttttgactgcgtagca

SEQ ID NO: 61799 - DNA, 201 bp, Homo sapiens
tagagtaacctaaatattttaaactatggtttggaaataatctactagtaggaaaaagatgtgttcaaatgaccattacaaagaattccctaagaaacatraaatagctatgcagaatgaaaataagtatatccatacactggcatggtattcagccataaaaaatgatagcataaagaagcacttaatgactagaaagag

SEQ ID NO: 61800 - DNA, 201 bp, Homo sapiens
aaaatgttattattaggggaaaattgagtaaagtgtacctgggatctttctgtgctattccctacaactgcatgggaatctgattatctcaaaataaaatwtttttttttttaagttactactaaatttccaaggggatgggcttcctaccaaagaattgtatattgtgaaattaaatcattcgaacttaaaacaattcaa

SEQ ID NO: 61801 - DNA, 201 bp, Homo sapiens
ttatttatattagttaaaatgttagagtaacctaaatattttaaactatggtttggaaataatctactagtaggaaaaagatgtgttcaaatgaccattayaaagaattccctaagaaacatgaaatagctatgcagaatgaaaataagtatatccatacactggcatggtattcagccataaaaaatgatagcataaaga

SEQ ID NO: 61802 - DNA, 201 bp, Homo sapiens
caaaatgttattattaggggaaaattgagtaaagtgtacctgggatctttctgtgctattccctacaactgcatgggaatctgattatctcaaaataaaawttttttttttttaagttactactaaatttccaaggggatgggcttcctaccaaagaattgtatattgtgaaattaaatcattcgaacttaaaacaattca

SEQ ID NO: 61803 - DNA, 201 bp, Homo sapiens
atcacttgaacctgggacgcggaggttgcagtgagctaagatcacacgactgtgctccagcctggatgacagagtgagatatcacctcaaaaaaaaaaaaacacaaaaaacaagaaacaaaaataatttacatgtaattgaagcgggcttacaggagtataaatacagttgcctgccaggagctcatatgttgctgactct

SEQ ID NO: 61804 - DNA, 201 bp, Homo sapiens
tcttgaaaggccccatgcactataaacctcagaagtgggcatgtattttaacctacttcttagaatttatacttaggaaataatcacacactttttaaagyagtttggtataaacttttcattgcagcattatttatattagttaaaatgttagagtaacctaaatattttaaactatggtttggaaataatctactagta

SEQ ID NO: 61805 - DNA, 201 bp, Homo sapiens
aatcacttgaacctgggacgcggaggttgcagtgagctaagatcacacgactgtgctccagcctggatgacagagtgagatatcacctcaaaaaaaaaaamacacaaaaaacaagaaacaaaaataatttacatgtaattgaagcgggcttacaggagtataaatacagttgcctgccaggagctcatatgttgctgactc

SEQ ID NO: 61806 - DNA, 201 bp, Homo sapiens
ggactctcatgtaccacgagatcaacacatcctcttgaaaggccccatgcactataaacctcagaagtgggcatgtattttaacctacttcttagaatttrtacttaggaaataatcacacactttttaaagcagtttggtataaacttttcattgcagcattatttatattagttaaaatgttagagtaacctaaatatt

SEQ ID NO: 61807 - DNA, 201 bp, Homo sapiens
aatctcatgaggctgaggcaggagaatcacttgaacctgggacgcggaggttgcagtgagctaagatcacacgactgtgctccagcctggatgacagagtragatatcacctcaaaaaaaaaaaaacacaaaaaacaagaaacaaaaataatttacatgtaattgaagcgggcttacaggagtataaatacagttgcctgc

SEQ ID NO: 61808 - DNA, 201 bp, Homo sapiens
gaacctggactctcatgtaccacgagatcaacacatcctcttgaaaggccccatgcactataaacctcagaagtgggcatgtattttaacctacttcttaraatttatacttaggaaataatcacacactttttaaagcagtttggtataaacttttcattgcagcattatttatattagttaaaatgttagagtaaccta

SEQ ID NO: 61809 - DNA, 201 bp, Homo sapiens
aagttctaaataacacgcccctcaatttgcattgatgtgccccttaacttacctgtaattggctgggcatggtggcccatgcctgtaatcccagcactttkggaggccaagatgggcagatcacctgaggtcaggagttcaagaccagcctggccaacatggtgaaaccctgtctttactaaaaatacaaaaattatctga

SEQ ID NO: 61810 - DNA, 201 bp, Homo sapiens
atgagtatttgtttagggggagggatgtatgttgaggagggtgggaaagtaagttttgggggaagaagcatgaaattaagaatctggggtgtgcatgcacycatgcatatgtgtcttcattttgaaaagcaagaccttaattagccaagaaaactggtattttggactcacctattaatcaattgtcagggcaaagtacca

SEQ ID NO: 61811 - DNA, 201 bp, Homo sapiens
aggagatgagtatttgtttagggggagggatgtatgttgaggagggtgggaaagtaagttttgggggaagaagcatgaaattaagaatctggggtgtgcawgcacccatgcatatgtgtcttcattttgaaaagcaagaccttaattagccaagaaaactggtattttggactcacctattaatcaattgtcagggcaaag

SEQ ID NO: 61812 - DNA, 201 bp, Homo sapiens
cttctccgagaagccgggagcctgttgggcagccggcgcccggtctccccttctgctgcggaggatccctgctggcggtcgtggtgctgctcgcgctgccrgtggcctggggtgaaacgctggggggcgtggggaggcgcccgggctgacgaggcacccagggccccgcagagaactcgcgtgccgcgctgggctgcgctg

SEQ ID NO: 61813 - DNA, 201 bp, Homo sapiens
gtaattcaaactattaaggaagagactgttaggaggagtttaacaaggaggaggccctttaatgactcagaaagtagttgaagtaattttcatagacctaraaatgagtgggaagtgagaaataaaattgaaatatgtagatgtcagagtttatgttttgtggaagcaaaaaaggttttaaatagattggatagtgggaga

SEQ ID NO: 61814 - DNA, 201 bp, Homo sapiens
ttctgtagaatgattattttcaatatgaaattgattacaatatattcttcacattgttttgtgtttgacagcagtggactttgagtaccaaatttttttcraatagctactatgagggacatattgtgctgggtgttgtggccacatggatgaatggagtcggccttgttaactattaaactcaaaaacacgtgataatta

SEQ ID NO: 61815 - DNA, 201 bp, Homo sapiens
tgggattacaggtgcgacaccatgccaggctaatttttgtatttttaatagagatggggtttcaccatgttggccaggctggtctcgaactcctgacctcrtgatccacctgcctcagcctccaaaaatgctgggattacaggcgtgagccaccatgcctggcaaagaatgacactgggtgtattaaaaagtatgataagt

SEQ ID NO: 61816 - DNA, 201 bp, Homo sapiens
tgttctgtagaatgattattttcaatatgaaattgattacaatatattcttcacattgttttgtgtttgacagcagtggactttgagtaccaaatttttttcgaatagctactatgagggacatattgtgctgggtgttgtggccacatggatgaatggagtcggccttgttaactattaaactcaaaaacacgtgataat

SEQ ID NO: 61817 - DNA, 201 bp, Homo sapiens
agctgcttttttggacaaaacccccgatctcctgttgtgtgtggtctcttctgcctatttcaggtgttttccttattttcaatgaaagaagccaagaccartaagttcttattgcttcttagtttcctcactcggcatactacaatgcaaaaagagcagtccatatctggtcacctgccaggataccagaagactgggaga

SEQ ID NO: 61818 - DNA, 201 bp, Homo sapiens
tctcacaaagataaggttttgtaagcaggtggtgctgtgcatgggagacctgccctctcaaaggtagttgccaaatggttccagatagcagaaggaaacatgtgtcaaatttcaggccagtctcattcattcctccagaagaggagctgcttttttggacaaaacccccgatctcctgttgtgtgtggtctcttctgccta

SEQ ID NO: 61819 - DNA, 201 bp, Homo sapiens
cggctggctttcggtttctctgctcacctccggataaatcacggggtctcccgcgccgctcatggcgcctcccgtccgtctcgagcgtccctttccttccyggcgctttcctgggttgcttctggcggccctggtgttgctgctgtcctccttctccggtaggaccccggggtggattcgcgcgtccgcggcgaggctaga

SEQ ID NO: 61820 - DNA, 201 bp, Homo sapiens
ttttccttaaatgaagttgtggagtttaggtgtcagcctggctttgtcatgaaaggaccccccgcaccgtgtgcaatgccaggccctgaacaaatgggagmcagagctaccaagctgctccaggggtgtgtttgcctgaggcctagaagggccctgcaagtgacatgcattgctgttggatcaggagatgagtatttgttt

SEQ ID NO: 61821 - DNA, 201 bp, Homo sapiens
aagtacatacagcctgggcatcataaggagagcccacctctacagaatattaaaaacaaaaaattagccaggtgtgatgttgcatgcctgtggtcccagcyacttgggaggctgaagggcgtgaagggggaggatcactggagcccccatggtcaaggctgcagtgagccctaatcataccactgcactccagcttgggtg

SEQ ID NO: 61822 - DNA, 201 bp, Homo sapiens
ttcaagtacctcttgtaatcacccttttaaagtgatcttttctgttctctgtctctccccatcagaatgcaggaatcttctgtcttcccccatttgtggtyccaaaagccccatttgtttgcttctgtatgaaccctaactcagtatccatatagacatctgttaaatatcagaaaattaaatatactatttggctggggc

SEQ ID NO: 61823 - DNA, 201 bp, Homo sapiens
cctagtgagaaattagtatcctaacaaaggaaggcagataatgttaatcttgttttcccctacagctcataaactgaagcttaaggcctatcccactgttytgtatttcattgaatggaatcaatatttttaaaaatgcatgctaggccaggcccagttgctcacacctgtgatcccagcactttgggaggcccaagttgg

SEQ ID NO: 61824 - DNA, 201 bp, Homo sapiens
cgagcgcggactctgcggctagggagggcatgttgagtgagagcaggctctcagtgcctggggttagagaggtggtaagggcgcaccatgcttttagtgcyttctgtgaacagtgtccgtgttgcctgagatcgtattggtcttgaattttaagtggctgcttttttggggggtgggtgggccatcgagtcatcttcctgt

SEQ ID NO: 61825 - DNA, 201 bp, Homo sapiens
aaatttcttattttagtaatgtttggttgtgaatcaatgtgtacatcacctgtctttggaactatctgatctgtctctgtcattttgtattctatgttctmttgcgataaatcctatggtcgtgtgcttctaggtcaggagagattagataatgtgaagcttttacaatttgctttctttctctacttcttttctttcttc

SEQ ID NO: 61826 - DNA, 201 bp, Homo sapiens
atgctgagcgtacccaaagggacaaggacaacttttcacccgggcaggaagtgttctacagctgtgagcccggctacgacctcagaggatctacgtatttrcactgcacaccccagggagactggagccctgcagcccccagatgtgaaggtgactagactcttatctggcttggtatttttagcttgcgtctttattctc

SEQ ID NO: 61827 - DNA, 201 bp, Homo sapiens
tgcacgcctccaaatgtggaaaatggaatattggtatctgacaacagaagcttattttccttaaatgaagttgtggagtttaggtgtcagcctggctttgkcatgaaagggccctcccatgtgaagtgccaggccctgaacaaatgggagccagagttaccaagctgctccaggggtgagtctgactgaggcctagaaggg

SEQ ID NO: 61828 - DNA, 201 bp, Homo sapiens
aatcttggaagcagagggaaaaaggtgtttgagcttgtgggtgagccctccatatactgcaccagcaaagatgatcaagtgggcatctggagtggcccagyccctcagtgcattatacctaacaaatgcacgcctccaaatgtggaaaatggaatattggtatctgacaacagaagcttattttccttaaatgaagttgtg

SEQ ID NO: 61829 - DNA, 201 bp, Homo sapiens
tcccaagaatgtgaaatttgggaaggtgatagacaattctttgacaagtggaaaatgtccctctgaattctataagagtgtaatctctggaagtagtaatytaattgggtagttgacctgtgtatttagaatgtaacattccttattttttgcctctagataccgactcattggttcctcgtctgccacatgcatcatctc

SEQ ID NO: 61830 - DNA, 201 bp, Homo sapiens
tgtggaagaacctggactctcatgtaccacgagatcaacacatcctcttgaaaggccccatgcactataaacctcagaagtgggcatgtattttaacctayttcttagaatttatacttaggaaataatcacacactttttaaagcagtttggtataaacttttcattgcagcattatttatattagttaaaatgttagag

SEQ ID NO: 61831 - DNA, 201 bp, Homo sapiens
tgtgacagtgagttgaaatatgcattcctatttcttttaccgatacattctaatttttctctggaataataaaaatcttaaccgaattccttctgtgcaawctgtacttcacatggctgaagacagccataatgttctcagatattcctatggggttcctggcaactctttctttaagttctttcttatcctgggatgtgt

SEQ ID NO: 61832 - DNA, 201 bp, Homo sapiens
cactgtgaatggcctactttgatgaatcttactgataaaagcccatccatgcatccatatattaatacttataaggcatagaaatacatacaacaggactrcatacacacatacatatgtatatatatgacagcttccctgcactcaagaagcttgtgttgtcttttaaaaaaatgaaatttataggaaaaactgtaactc

SEQ ID NO: 61833 - DNA, 201 bp, Homo sapiens
ggagtcttgccatattgcccaggctggtctcaaactcctgggctcaagctatcctcccaccttggcctccaaaagtgttaggattacaagtgtgagccacygtacccagccaaatttttatgttcttttatcccctcacttatcataaacaatttagtcagcttgttttttagcctgcagtattgaatgacatagggcttc

SEQ ID NO: 61834 - DNA, 201 bp, Homo sapiens
taatcccagcactttgggagtcctaggtgagcagatcgcttgagcccaggaggtcgagaccagcctgtacaacatggtgaaaccctgtctctacaaaaaakacaaaaattaaatgggcatactggcacacgcctgtagtcccaactattcgggagactgagaggtgggaggattgcttgagccagagaggtcaaggctgca

SEQ ID NO: 61835 - DNA, 201 bp, Homo sapiens
tgcagcctcaatctcccaggctcaagcgatcttcctgcctcagccttctgagtagctaggactacaggaatgtgccaccatgcgtggctttttaataaaawttttgttgagacagggtctcactatgttgcccaggcttctctcgaactcctgagctcaagcagtcctcctacctcagcctccaaacgtgctgggattaca

SEQ ID NO: 61836 - DNA, 201 bp, Homo sapiens
aatgagcaattgcaagctaataaggaatataaaatgtgtataatcctgggtttagtgatggtgtgaggaaatcagcaatttcaaacccatctggtgggagrataagtgggaacaaactttgtagaagggcaatatactggctgggcactgccctacagtagagtaggacacagtattcagttcttccaagatcagatgaaa

SEQ ID NO: 61837 - DNA, 201 bp, Homo sapiens
ggtcagcttggattgcctttggttctagttataaatcattttctttctttctttctttctttctttctttttttctttctttttctttctttctttctttytctttctttccttccttccttccttccctccttccttccttctttctttctttctctttctttctttctctctttctctttctctctctctctccctctg

SEQ ID NO: 61838 - DNA, 201 bp, Homo sapiens
ataaaataagtgttcagttctttttggtcagcttggattgcctttggttctagttataaatcattttctttctttctttctttctttctttctttttttctttctttttctttctttctttctttttctttctttccttccttccttccttccctccttccttccttctttctttctttctctttctttctttctctcttt

SEQ ID NO: 61839 - DNA, 201 bp, Homo sapiens
acaataggtaaagtttaggctaggccttagacttctcctatattgtaatccctctggtttgccacatatgcatgctgtcaggaagttgatgaggtatgtamagcacaattattttccattttttgcctttaggcaccgactcattggtcactcatctgctgaatgtatcctctcgggcaatactgcccattggagcatgaa

SEQ ID NO: 61840 - DNA, 201 bp, Homo sapiens
taacattttaagtataaaataagtgttcagttctttttggtcagcttggattgcctttggttctagttataaatcattttctttctttctttctttctttytttctttttttctttctttttctttctttctttctttttctttctttccttccttccttccttccctccttccttccttctttctttctttctctttctt

SEQ ID NO: 61841 - DNA, 201 bp, Homo sapiens
agcactttcattatatagtatgttgtttaagaaaccacccccctcaaattactgcagcgtagaaaataaaccatataaaaagttccttcattattatgtgkcttattaattgctatacaaaacagtaaccctttcttttcccatttagttattacttaattggtaaagaaattctatattgtgaacttaaaggatcagtag

SEQ ID NO: 61842 - DNA, 201 bp, Homo sapiens
gaaatctccaagaaatctttttcttggcaatagattgcctgggtgaacatgaaactgaaatttgcccttataataggtaaagaaagaaaataatatgcccwtgcattcaaaaccgcaatgcagaattttgaccttgattccaatctgtttagaaactggattgaaaaaatctcaaaattattttcttttaggaaaaacatg

SEQ ID NO: 61843 - DNA, 201 bp, Homo sapiens
gaacaataggtaaagtttaggctaggccttagacttctcctatattgtaatccctctggtttgccacatatgcatgctgtcaggaagttgatgaggtatgkacagcacaattattttccattttttgcctttaggcaccgactcattggtcactcatctgctgaatgtatcctctcgggcaatactgcccattggagcatg

SEQ ID NO: 61844 - DNA, 201 bp, Homo sapiens
ccagctacttgagaggctgaggcaggagaatcacttgaatctgggaggtggaggttgcagtgacattgcactccagcctgggcgacaagagtgaaactctmtctcaaaaataataataataataaataaccaaaatgatatcgaagtcactaataattacaacataatagctactataatgtaacaatgtgtcaagtgtct

SEQ ID NO: 61845 - DNA, 201 bp, Homo sapiens
gtgagagcagaaaaagaagtagaaaagctgggaacaataggtaaagtttaggctaggccttagacttctcctatattgtaatccctctggtttgccacatrtgcatgctgtcaggaagttgatgaggtatgtacagcacaattattttccattttttgcctttaggcaccgactcattggtcactcatctgctgaatgtat

SEQ ID NO: 61846 - DNA, 201 bp, Homo sapiens
catagtggcgtgcacctgtaatcccagctacttgagaggctgaggcaggagaatcacttgaatctgggaggtggaggttgcagtgacattgcactccagcytgggcgacaagagtgaaactctatctcaaaaataataataataataaataaccaaaatgatatcgaagtcactaataattacaacataatagctactata

SEQ ID NO: 61847 - DNA, 201 bp, Homo sapiens
ggatcaaaagcaacaaatcttgtatttataaaaaacatgcctcaagttaaatggcatagtattacacacacacacacacacacacacacacacacacacayattaagggaatacgcaaacaaaaaatggcagaaataatatgggaaaagacagaacttaagaaagaaattgtcaagcaggtctacaaaatgattgttttat

SEQ ID NO: 61848 - DNA, 201 bp, Homo sapiens
catcacactccggggcctgttggtgggtggggggctaggggcgggatagcactaggagaaatacctaatgtaggtgaccggttgacgggtgcagcaaaccrccatggcacatgtatacctatgtaacaaaactgcacattctgcacatgtaccccagaacttaaagtataataaaaattaattaattgattaattaatttt

SEQ ID NO: 61849 - DNA, 201 bp, Homo sapiens
caggatcaaaagcaacaaatcttgtatttataaaaaacatgcctcaagttaaatggcatagtattacacacacacacacacacacacacacacacacacayatattaagggaatacgcaaacaaaaaatggcagaaataatatgggaaaagacagaacttaagaaagaaattgtcaagcaggtctacaaaatgattgtttt

SEQ ID NO: 61850 - DNA, 201 bp, Homo sapiens
gcactccagcctgagcgacagagccagactccgtctaaaaaaacaaacaaacaaacaaagcaaatcaaatatataatttatttcaatccatttggtttaamcttcttgtcaaaaaaccaagtctactagacaggatcaaaagcaacaaatcttgtatttataaaaaacatgcctcaagttaaatggcatagtattacacac

SEQ ID NO: 61851 - DNA, 201 bp, Homo sapiens
acatagaataaacgggcatttcagttgtggaaacataacttgtttggggggcgtgtgtgtgtatgtgtatgtgtgtgtagagtcaaaagtggctcttgggyctccctttgttgtttgagctagagtgacacattccaagtagagctgtgtggggaggcaattgaatatgtagttttggcaccccagctagagatctgggat

SEQ ID NO: 61852 - DNA, 201 bp, Homo sapiens
tcttggaaaaaccttgattaccctgtcatataaatactgctctggtaatgtgaaaaatgaattgaatgaaaggtggcaagataggtatggagacctatttrgttatgtcgtggtaatccagataagaaatgatagtggcttgaatgaaaagtaaaggatacaactacatagaataaacgggcatttcagttgtggaaacat

SEQ ID NO: 61853 - DNA, 201 bp, Homo sapiens
ttccttaaatgaagttgtggagtttaggtgtcagcctggctttgtcatgaaaggaccccccgcaccgtgtgcaatgccaggccctgaacaaatgggagacrgagctaccaagctgctccaggggtgtgtttgcctgaggcctagaagggccctgcaagtgacatgcattgctgttggatcaggagatgagtatttgtttag

SEQ ID NO: 61854 - DNA, 201 bp, Homo sapiens
ggttattccggaagaccgttttctatcatctgcctaaaaaactcagtctggacaagtgctaaggacaagtgcaaacgtaagtaactctggagtgggaaccyctctgttagtcaaacatctgtaagatctgattcaatttgttcaaattttgtaactgagttgcatacaacaattagtttgctaaggtgcaatacatatgag

SEQ ID NO: 61855 - DNA, 201 bp, Homo sapiens
ttcccattgggacatatctgaactatgaatgccgccctggttattccggaagaccgttttctatcatctgcctaaaaaactcagtctggacaagtgctaasgacaagtgcaaacgtaagtaactctggagtgggaacccctctgttagtcaaacatctgtaagatctgattcaatttgttcaaattttgtaactgagttgc

SEQ ID NO: 61856 - DNA, 201 bp, Homo sapiens
gaattctataagagtgtaatctctggaagtagtaatctaattgggtagttgacctgtgtatttagaatgtaacattccttattttttgcctctagataccractcattggttcctcgtctgccacatgcatcatctcaggcaacactgtcatttgggataataaaacacctgtttgtgacagtgagttgaaatatgcattc

SEQ ID NO: 61857 - DNA, 201 bp, Homo sapiens
cgtggtgagagtttgccctgtgttcccttggtgccttggtgagtagggtgttcattagggcttggacagtacccgcggtaagggttgcagtgcgtctgctktgccccatgggctgggctggcctgggctgggctgggcgagcaggggcctggccaggtgttgctgggagcgtgctgtgcgcaagtggcctgtgtgcggagt

SEQ ID NO: 61858 - DNA, 201 bp, Homo sapiens
ctgtatgtggtttctggaaacgaaatgatcatggcatttcctgaaccatggcttaactttgtgaatccacaactctctcttccccaggagatccaaaaagrtagggtaggatgtaaaggcttcaatctgtttaaatggatatgagagtccctggctctccttaaaataagtagcatggattttgtctctctgccttacttc

SEQ ID NO: 61859 - DNA, 201 bp, Homo sapiens
tcaaagcacacaatcagccttaacacagattagacattgctcaaagaaagggaaggccattgagcagctgtgtgagagaaatcttaatggtcatagcacaratagtttgctagggctgctgtaacagagtactccaaaacaggcggcttaatacaaacaaagtttttggagttctgttccggaggctggaagtacaaaatc

SEQ ID NO: 61860 - DNA, 201 bp, Homo sapiens
gaaccaacatctcttggttcaagggttctaacacagccatactaccttctagtcacatctcagaaaggacaactaaactattaccatctgctctttaaagrcttcaacacaggtgcttagctcctgactgaaatggacaaaggtatgacaagatcagggggaaaatcatctgtatccttgctggaaaccaaggcagagcat

SEQ ID NO: 61861 - DNA, 201 bp, Homo sapiens
tcaggagaattgcttgaactcgggaggcagaggttgcagtgagcagatattgcaccattgcactccagcctgagcgacagagccagactccgtctaaaaamacaaacaaacaaacaaagcaaatcaaatatataatttatttcaatccatttggtttaaacttcttgtcaaaaaaccaagtctactagacaggatcaaaag

SEQ ID NO: 61862 - DNA, 201 bp, Homo sapiens
ctgggggtctcccactttcatgactaaaattaagtaatgaatgacttgggacaagaaagagaagtggattaaataactaaaagatgcgacaatcttgggcyttgagatctttggattatatcagttgaattgaattacagataataacgaagtttacatttttctgggaggcataatatggggatgaaacagatctgaaag

SEQ ID NO: 61863 - DNA, 201 bp, Homo sapiens
tgagtatgagcttgcctgacctgctggacattgaaattggggttaggaattagtccaaaaaggggagatttgatgtggcttaaaaaaagacagacagacasacacacacacacacacacacaatcagagagatgaacttttgaaagtatatataggaagaaaggaaagacacatatggaactaataacatgagatatgaag

SEQ ID NO: 61864 - DNA, 201 bp, Homo sapiens
tcacacatggctacctgtctcagatgagccctgttatagtaaataaactagcctttttttttttgttttctgcttgctctagagatttgcacacattttakggtacatattccactatggagatgatgatttttttttcttgtgaaatgaggtttaagatagcaatgcatttttgcagactttgagaaattgaaatctcca

SEQ ID NO: 61865 - DNA, 201 bp, Homo sapiens
tggcaatgtaatcataatttagtaataatctctgtgaagtcatagaatatatcaatagaagtagaaaatgtgagaaagcaggaaaaggtaggctagacttrcagaaaagatgagtagactgactgtacagaatttgactctgaaattgagaaaataggtttaaatatatgtatcaagtgtatatatctacaatatacatgc

SEQ ID NO: 61866 - DNA, 201 bp, Homo sapiens
gctttgagttcctggcaccttcattacaagtttatttcatgagaaaccgtcattgcaggacatgattgagggaaaacccccattcactgggggtctcccaytttcatgactaaaattaagtaatgaatgacttgggacaagaaagagaagtggattaaataactaaaagatgcgacaatcttgggctttgagatctttgga

SEQ ID NO: 61867 - DNA, 201 bp, Homo sapiens
aaaaaggagaatgatgaattcctaaagaaatctcaatgagatagaaaagtggtaaaaacaaacaacaacaacaaaaaaccataaacacaaaaactggcaawgtaatcataatttagtaataatctctgtgaagtcatagaatatatcaatagaagtagaaaatgtgagaaagcaggaaaaggtaggctagacttacagaaa

SEQ ID NO: 61868 - DNA, 201 bp, Homo sapiens
tcttgtagatcataccttgttactgctttgagttcctggcaccttcattacaagtttatttcatgagaaaccgtcattgcaggacatgattgagggaaaayccccattcactgggggtctcccactttcatgactaaaattaagtaatgaatgacttgggacaagaaagagaagtggattaaataactaaaagatgcgaca

SEQ ID NO: 61869 - DNA, 201 bp, Homo sapiens
atacacattaaagaataagcaaagacacaaaaattgtaccatttaagtatgtttcccaggcaattaataagcaaatttttaaaaaggagaatgatgaattsctaaagaaatctcaatgagatagaaaagtggtaaaaacaaacaacaacaacaaaaaaccataaacacaaaaactggcaatgtaatcataatttagtaata

SEQ ID NO: 61870 - DNA, 201 bp, Homo sapiens
gagggatctaggttgcatgttccctatgagaatctaatgcctgatgatctgagtggaacagttccatctcaaaaccatttccctgcaccctccattcacgkaaaaattgtcttccacaaaacgagtctcaggtgccaaaaagattggggaccaaagttctaaaggaatcaatctctttgctattattgttattattattgt

SEQ ID NO: 61871 - DNA, 201 bp, Homo sapiens
cttctgttgagccaagctaatattcacatctagaggctccagatacacattaaagaataagcaaagacacaaaaattgtaccatttaagtatgtttcccargcaattaataagcaaatttttaaaaaggagaatgatgaattcctaaagaaatctcaatgagatagaaaagtggtaaaaacaaacaacaacaacaaaaaac

SEQ ID NO: 61872 - DNA, 201 bp, Homo sapiens
agatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccataga

SEQ ID NO: 61873 - DNA, 201 bp, Homo sapiens
aggccgaagcaagagaatcacttgaccccaggacctcgagaccagcctgggcaataaggcaaaaccccatctctacaaaaaagtataaaaattagctgggygtggtggcgtgtgcctgtagtcacagctacacaggagactgaggtgaaaggatcacctcagcccgagaggctgaggcttcagtgagccgtgatggcaccc

SEQ ID NO: 61874 - DNA, 201 bp, Homo sapiens
tagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccatag

SEQ ID NO: 61875 - DNA, 201 bp, Homo sapiens
tatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtgggca

SEQ ID NO: 61876 - DNA, 201 bp, Homo sapiens
atagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccata

SEQ ID NO: 61877 - DNA, 201 bp, Homo sapiens
atatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtgggc

SEQ ID NO: 61878 - DNA, 201 bp, Homo sapiens
tgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtg

SEQ ID NO: 61879 - DNA, 201 bp, Homo sapiens
aatgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagatagg

SEQ ID NO: 61880 - DNA, 201 bp, Homo sapiens
gaaatctttttcttggcaatagattgcctgggtgaacatgaaactgaaatttgcccttataataggtaaagaaagaaaataatatgcccatgcattcaaarccgcaatgcagaattttgaccttgattccaatctgtttagaaactggattgaaaaaatctcaaaattattttcttttaggaaaaacatgtccatgtatag

SEQ ID NO: 61881 - DNA, 201 bp, Homo sapiens
aaatctttttcttggcaatagattgcctgggtgaacatgaaactgaaatttgcccttataataggtaaagaaagaaaataatatgcccatgcattcaaaaycgcaatgcagaattttgaccttgattccaatctgtttagaaactggattgaaaaaatctcaaaattattttcttttaggaaaaacatgtccatgtatagg

SEQ ID NO: 61882 - DNA, 201 bp, Homo sapiens
gatttaaaagtctctaagctatgttaggaagccttagacattatcctgaggtcattggagagccatcgaaaggtatctgtcttggaaaaaccttgattacyctgtcatataaatactgctctggtaatgtgaaaaatgaattgaatgaaaggtggcaagataggtatggagacctatttggttatgtcgtggtaatccaga

SEQ ID NO: 61883 - DNA, 201 bp, Homo sapiens
tgattacatactgtttgactctgtgatttttgttgctttaaattaaatctacaaggccttaaggggcctagctgagtctactatataatatgaaatatctrtgagaaaatacgtcttctttatggtaaagtatagctttagttgttgagctttgttcactctttgtgctcaagattgacgtggcgacagacttccaacatt

SEQ ID NO: 61884 - DNA, 201 bp, Homo sapiens
ggtggcctggggtgaaacgctggggggcgtggggaggcgcccgggctgacgaggcacccagggccccgcagagaactcgcgtgccgcgctgggctgcgctrctctgcgcgcccgggtccaaaggcagcgcgatgggtgggctgagcgcgctacctggcagggcggcgggtctgggatccttctgcgcactggagaccctcg

SEQ ID NO: 61885 - DNA, 201 bp, Homo sapiens
tctttgcactgcgcttttcctcttatcaaatctggtttgtagatgtgcttcgggaggatgggggtctcttctccgagaagccgggagcctgttgggcagcsggcgcccggtctccccttctgctgcggaggatccctgctggcggtcgtggtgctgctcgcgctgccggtggcctggggtgaaacgctggggggcgtgggg

SEQ ID NO: 61886 - DNA, 201 bp, Homo sapiens
aatttaggggcatgcctgtccccaaacagtatgactgtactttagtcattggtgtgcaatcagagaaatatggggaaatctgtaaaacagacttggtctcmggtgacagtctcattacctgaataatgatggtacaaatacctccctaggaaatatgtagatggagaatccaccaatactaataactccacactggatatc

SEQ ID NO: 61887 - DNA, 201 bp, Homo sapiens
acacatatcaaaattgtatttcatcccacatatcaactagaggaaaggtgaatgcataacactgaaagtcacggaactgttttattcgtttttttttttttatacagtggttctcaaagtgctgttatctatccaaatcagctgtgaaacttttaaaaaatatagactcctgggctctaacccagacccactaaatcagag

SEQ ID NO: 61888 - DNA, 201 bp, Homo sapiens
caatgcataagacacatatcaaaattgtatttcatcccacatatcaactagaggaaaggtgaatgcataacactgaaagtcacggaactgttttattcgtktttttttttttatacagtggttctcaaagtgctgttatctatccaaatcagctgtgaaacttttaaaaaatatagactcctgggctctaacccagaccca

SEQ ID NO: 61889 - DNA, 201 bp, Homo sapiens
cgaatgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagata

SEQ ID NO: 61890 - DNA, 201 bp, Homo sapiens
aacttctttctttccaagaatggttcattatatttgctttgttgctttgatctagttctaacctctcattgcaagctttgttgtgacgtttaccctctctyaatacagcttttggcgctaggagagctccacttggaatctcttcctttgtctagcatcaatgcataagacacatatcaaaattgtatttcatcccacata

SEQ ID NO: 61891 - DNA, 201 bp, Homo sapiens
cacgaatgaatatatgtagtcagtgtgtttatatatttcatttcatatatgtgtcatatatatgtgtgtgtgtatgtatatatatatatatatatatatayatatataaaacactgaatattgcagaaaattaaagcaaagagtaagaagagttaaccaaattttccctcaatgcagtgggaaaagatgaaaaggagaaga

SEQ ID NO: 61892 - DNA, 201 bp, Homo sapiens
aagagggaaaggaaactacatcaagcattctttgttgaaggctcatatgttccttttttgggctactatgcaaatttatattattacctatactatgcatwtactactataaaggtaagaatattaggtaattaaggggaaggaacttctttctttccaagaatggttcattatatttgctttgttgctttgatctagttc

SEQ ID NO: 61893 - DNA, 201 bp, Homo sapiens
tgcacacgaatgaatatatgtagtcagtgtgtttatatatttcatttcatatatgtgtcatatatatgtgtgtgtgtatgtatatatatatatatatatayatatatatataaaacactgaatattgcagaaaattaaagcaaagagtaagaagagttaaccaaattttccctcaatgcagtgggaaaagatgaaaaggag

SEQ ID NO: 61894 - DNA, 201 bp, Homo sapiens
agaaccagccacaaattgagggattggtaataaagagggaaaggaaactacatcaagcattctttgttgaaggctcatatgttccttttttgggctactaygcaaatttatattattacctatactatgcatatactactataaaggtaagaatattaggtaattaaggggaaggaacttctttctttccaagaatggttc

SEQ ID NO: 61895 - DNA, 201 bp, Homo sapiens
tttgcacacgaatgaatatatgtagtcagtgtgtttatatatttcatttcatatatgtgtcatatatatgtgtgtgtgtatgtatatatatatatatatayatatatatatataaaacactgaatattgcagaaaattaaagcaaagagtaagaagagttaaccaaattttccctcaatgcagtgggaaaagatgaaaagg

SEQ ID NO: 61896 - DNA, 201 bp, Homo sapiens
caattgaatattacccagcaacaaaaggaaacaatttgtatatgtgcagcaacctagatagaactctaattatgctgtgtgaaggctaaaacatttaaaamaatcggagtgatttcctttatatgataggatataaacgaagtgattcgggttatatgaaattttagaaagtcaaatcaatctgtagtaagagaaaacagg

SEQ ID NO: 61897 - DNA, 201 bp, Homo sapiens
agtttgcacacgaatgaatatatgtagtcagtgtgtttatatatttcatttcatatatgtgtcatatatatgtgtgtgtgtatgtatatatatatatatayatatatatatatataaaacactgaatattgcagaaaattaaagcaaagagtaagaagagttaaccaaattttccctcaatgcagtgggaaaagatgaaaa

SEQ ID NO: 61898 - DNA, 201 bp, Homo sapiens
agttcaaccgtttcttaaaaccttacacacacacctgtcatattactcagcattttactcttaggtttttacccaagagaaatgaaatcatatgtccacamaaagacttgtacatgaattttcataacagttttgtttgtaatagccaacgagtgggaacaatccaaatgtccctcaacaagtgaatggataaactaaatt

SEQ ID NO: 61899 - DNA, 201 bp, Homo sapiens
aacgctgcaacaagcatgtcagttggcatcatttatccaacagtgtgtgttgacttcgtgtctctgtgtagcattttggttattctcacaatatcccagakgttttcattattatcatgtctgtgatagtgatctgtcttcagtgatctttgatgttactattttcattgtttggagtccctacgaactgcacccatataa

SEQ ID NO: 61900 - DNA, 201 bp, Homo sapiens
tgaaactagccatgaagtttgcacacgaatgaatatatgtagtcagtgtgtttatatatttcatttcatatatgtgtcatatatatgtgtgtgtgtatgtrtatatatatatatatatatatatatatataaaacactgaatattgcagaaaattaaagcaaagagtaagaagagttaaccaaattttccctcaatgcagt

SEQ ID NO: 61901 - DNA, 201 bp, Homo sapiens
gtggagaagctggaattataatatactgctattcggcaggtaaaattacaacataactttagaaaatagttcaaccgtttcttaaaaccttacacacacayctgtcatattactcagcattttactcttaggtttttacccaagagaaatgaaatcatatgtccacaaaaagacttgtacatgaattttcataacagtttt

SEQ ID NO: 61902 - DNA, 201 bp, Homo sapiens
attgaaggtcagataatctttagcattttttaccaataaaccattttttaaagtatgacctttttttcacataattctatttcacacttaatagactatartatattacaaacacaacttttagactcactgaaaaatcaaaaaattcatatgacttggtttgttgtgatatttgttttattgtggtgttctggaactgaa

SEQ ID NO: 61903 - DNA, 201 bp, Homo sapiens
acagacatgcctaagcaaagcaagtgcaagtctgttccttaaagggtaagtatgcagaatggaaagcagagtgtacttcgggttgacagctcatatttgcrcagacatgaaagtgatgatgtgttaattgtgcgtatagcacagaataaatcagcttgctttgaatggaagatctgaaccaggagtgcatgaaattgggct

SEQ ID NO: 61904 - DNA, 201 bp, Homo sapiens
aaagaaaaggaaaaaaaaatacattttgtaaggctatagttcccacagacagtaattcctctgatggatctgaacaaagtaagttgaaaactgcaggaaakaattaatcattctacatactgttaagaacactcatgattcatgggaagaggttaaaatatcaacattaacaggagtttggtagaagttgattccgaccct

SEQ ID NO: 61905 - DNA, 201 bp, Homo sapiens
agctgcagcaagttgtcctgatgatctaactaagatcattgatgaaggtgttaaaataaatagcagattctccatgtagacaaaacagccatctattggamcttcatagctagagaggagaagccaatgcctgggttcaaagcttcaaaggataggctgcctttttaggagctaatctcgttggtgagtttgagttgaagc

SEQ ID NO: 61906 - DNA, 201 bp, Homo sapiens
acctgaacctaagacccaaatgatagtcaaggaggaaatggtagtgaggaagctgagcatctattagtgaagaaatcaagggagagatgggaattgctcayacatttgctaccacttttttttttctttaggttctgattaaaaggcaggtctgctagtcattgtgtcttggctggaatgaaagccctttggaatagcagt

SEQ ID NO: 61907 - DNA, 201 bp, Homo sapiens
gcattcagggtggtatggctgtagatcagtatccagttatttgtattacttctgaatctgtaagtatcatgtttattatatgtaatattgtatatttgtgyttgctttgtctttattagttctgccagagcttttgttcttattatttaataaagatgttatactgggccaggtgtggtggctcacacctgtaatcccagc

SEQ ID NO: 61908 - DNA, 201 bp, Homo sapiens
cagattcttgtcttaggagccatagaactccaaaggtttatggctataactgtgttttgacataattggctttctttatagtcctacgtgatttacttatrcattacaaaaaacagctctgagaagggattcataattctgaccagccaggcaaaggtgtatacatgatacataaagatattaagaacccctcatgactat

SEQ ID NO: 61909 - DNA, 201 bp, Homo sapiens
ggtagcagcctgtagtcccagctactctggaggctgaggcaggagaatggcgtgaacccgggaggcggagcttgcagcgagccgagatcgcgccactgcaytccagcctgggcgacagagcgagattccgtctcaaaatcaatcaatcaatcaatcaatcaatcactatacacttataaggatgagagtgaaaaaagacaa

SEQ ID NO: 61910 - DNA, 201 bp, Homo sapiens
ttcactgtccctcttcgggccctggggaggagactcccaaaagtctagacatgttcacccacatcctgtatgtggtttctggaaacgaaatgatcatggcwtttcctgaaccatggcttaactttgtgaatccacaactctctcttccccaggagatccaaaaagatagggtaggatgtaaaggcttcaatctgtttaaat

SEQ ID NO: 61911 - DNA, 201 bp, Homo sapiens
ttattctcattttttcctaacccaaccacctggttcaaggcacatagattaagaaggaaaatggaaatgggactaatatcccaggcttcactgtccctctycgggccctggggaggagactcccaaaagtctagacatgttcacccacatcctgtatgtggtttctggaaacgaaatgatcatggcatttcctgaaccatg

SEQ ID NO: 61912 - DNA, 201 bp, Homo sapiens
agcctgggcgacagagcgagattccgtctcaaaatcaatcaatcaatcaatcaatcaatcactatacacttataaggatgagagtgaaaaaagacaatatkttggtggtattgtgaatcaccaatttagaaaatggatatatttaaaaattgcaaaggatttctcagctagcgctcagttaagcatattttctcattaaat

SEQ ID NO: 61913 - DNA, 201 bp, Homo sapiens
atattttctgaatctcattatttaaggttaacaatgtgctaacctaaacaattcacaggatttgttttttattctcattttttcctaacccaaccacctgkttcaaggcacatagattaagaaggaaaatggaaatgggactaatatcccaggcttcactgtccctcttcgggccctggggaggagactcccaaaagtcta

SEQ ID NO: 61914 - DNA, 201 bp, Homo sapiens
gaacacaggtattaactcctgattgaaatgaacaaagataggagaagattaggggaaaaatctgtgtccttgctggaaaccagggcagtgcacacataaakagtatgccgttcactggatgggaaggaaaaaaaattaggagtatagtagtcaaagcacacaaacaaccctaacccagagtagacattgctggaagaaagg

SEQ ID NO: 61915 - DNA, 201 bp, Homo sapiens
cccattcatttggagttggtgtcttccaggtggctacccttaagctgtgtgctcaaataaactctatccttaaatatattttctgaatctcattatttaargttaacaatgtgctaacctaaacaattcacaggatttgttttttattctcattttttcctaacccaaccacctggttcaaggcacatagattaagaagga

SEQ ID NO: 61916 - DNA, 201 bp, Homo sapiens
ggcgctttcctgggttgcttctggcggccctggtgttgctgctgtcctccttctccggtaggaccccggggtggattcgcgcgtccgcggcgaggctagarctctgctcagtcagtcgggcaggaggcgcggggcgaagctcactgcacgtcgtgcctgcttgggatagagagcgaggccagggttctccgaggggtgccg

SEQ ID NO: 61917 - DNA, 201 bp, Homo sapiens
ccctgctctgcaaagggcaatgcctttctaaaagatcgctgtctagcaccactggctcatccgtgaattctgtcctgagtgaggcaagaacccttccagartaagccccaatttaggggcatgcctgtccccaaacagtatgactgtactttagtcattggtgtgcaatcagagaaatatggggaaatctgtaaaacagac

SEQ ID NO: 61918 - DNA, 201 bp, Homo sapiens
tatgcatgctgtcaggaagttgatgaggtatgtacagcacaattattttccattttttgcctttaggcaccgactcattggtcactcatctgctgaatgtrtcctctcgggcaatactgcccattggagcatgaagccaccaatttgtcaacgtgagttgaaatctctttccccattcaccccaccatttaaccctagagt

SEQ ID NO: 61919 - DNA, 201 bp, Homo sapiens
atgcaggttgagaccttacgtactgaagagagttcagattactctacctggctccaaaacattttctttcccacaggtaaatcatgtgaaactcctccagwtccagtgaatggcatggtgcatgtgatcacagacatccatgttggatccagaatcaactattcttgtactacagggtgagttggcagcaacatctcttgg

SEQ ID NO: 61920 - DNA, 201 bp, Homo sapiens
cctacacagaaatactgggtgaagatcacttaataagacgaactccagaaaacaagaaaatggcagagttgacaatccctctcaccctccctgcaaagacrcatgtatacaaatttcttttgtcagagacattaagagaaacaaatgctgtcaatctaatcacaactgatcacaacttgatgaaaccaaaaaatctagaaa

SEQ ID NO: 61921 - DNA, 201 bp, Homo sapiens
taattccaatttgctttctgtgctttgtgatgtattctggtttacatatgctcggatgagtagatgtatgatttatattatctactgttatctaaaataawcttcacattcggacaggcaacatcaaaactgtcctacacagaaatactgggtgaagatcacttaataagacgaactccagaaaacaagaaaatggcagag

SEQ ID NO: 61922 - DNA, 201 bp, Homo sapiens
tagctgaccttcccacacacattcttgcaaagaggaaaagtcaagcagggtgtttggaggtgagttgccatcatccaccgcctttgtctggaaggaagcgyagggcctcacacgcgggatccatcggaagcccaagcattgtcaagctctgctgctgcacctgggtcagcaaggtgggctctgccagcgaaactcgttaga

SEQ ID NO: 61923 - DNA, 201 bp, Homo sapiens
ctaactctcttcaattctgtgaaggctgacagaggtgaggaagctgcagaaaaaaagctggaagcagctgggcactgtggctcatgcctgtaattccagcwctttgggaggcagaggcaggtggatcacctgaggtcaggtgttcaagaccagcctgaccaatatggtgaaacctcatatctactgaaaatgcaaaaatta

SEQ ID NO: 61924 - DNA, 201 bp, Homo sapiens
ggcatttcattagctgaccttcccacacacattcttgcaaagaggaaaagtcaagcagggtgtttggaggtgagttgccatcatccaccgcctttgtctgkaaggaagcgcagggcctcacacgcgggatccatcggaagcccaagcattgtcaagctctgctgctgcacctgggtcagcaaggtgggctctgccagcgaa

SEQ ID NO: 61925 - DNA, 201 bp, Homo sapiens
aggcctcatgtgccaaacagctagcgagttgcaaaggcaaagcaaaagtacttgaaggaaacttaaagtgctattccagtgaacacatgaatgataagaargtgaaacagccttattgctgatatggaagaagttttagtggtctagatacaagatcaaactagacatatttccttaagctaaagcctaatcctgagcaag

SEQ ID NO: 61926 - DNA, 201 bp, Homo sapiens
taactcttgattgctttcttctcactactaaccttaagaaaggaagtaaccaaaatccaatacatgagcaactgttcattccatctccaatatctttgttmattgtccactttatccacccagtcagggccaccatcaaacctcacttggatgtcagcaaaagctccctggctggtctcccctctccattattgctttaat

SEQ ID NO: 61927 - DNA, 201 bp, Homo sapiens
aaatgaacaaagataggagaagattaggggaaaaatctgtgtccttgctggaaaccagggcagtgcacacataaagagtatgccgttcactggatgggaargaaaaaaaattaggagtatagtagtcaaagcacacaaacaaccctaacccagagtagacattgctggaagaaagggaagggcatgtagcagctgtgtgag

SEQ ID NO: 61928 - DNA, 201 bp, Homo sapiens
aaacctaaatacagtcactgatcttgggtacacagttggaacttgaaatgaatgggtacgtatttatttggaggcaaaagaacataattttataaaatgtrtgctagaaaaaaaagatgaatgagatggaaattgtttgcctcataataaggcaaaggttgttttaggaaacttaaaaccagtcaataatggaatctgtaa

SEQ ID NO: 61929 - DNA, 201 bp, Homo sapiens
agaatactggttaccagaggttggggtagggagagacaatgggagatggagagagattggttaaagggcacagggtcacagatacataagaataaattcayccttgaatacttaaccctctgccctacatctgtcactcctacatccatattcattgctaatcctggggctaactcttgattgctttcttctcactactaa

SEQ ID NO: 61930 - DNA, 201 bp, Homo sapiens
tctaaaaaagctcatctcatagaagtagagagtagaatactggttaccagaggttggggtagggagagacaatgggagatggagagagattggttaaaggrcacagggtcacagatacataagaataaattcatccttgaatacttaaccctctgccctacatctgtcactcctacatccatattcattgctaatcctggg

SEQ ID NO: 61931 - DNA, 201 bp, Homo sapiens
ctaaatctagatctagatagatctggagggaaggtctttttgaaagtggggcttagtaggtggctgatcctgaggctctctgatgagttttctcaaggtgscaaaatctgtggaactatcagaactgcgtgttttcttcaggaagctacatgcaggttgagaccttacgtactgaagagagttcagattactctacctggc

SEQ ID NO: 61932 - DNA, 201 bp, Homo sapiens
aatgtggtatatatacacaagggaatactattcagccataagaaagaatgaaatcctatcatttgcagcaacatggatgaatctaggggatattatattawatgaagtaaatcaggcacagaaagacaaatcctgtatgatatcagtcatgtgcaatctaaaaaagctcatctcatagaagtagagagtagaatactggtt

SEQ ID NO: 61933 - DNA, 201 bp, Homo sapiens
aatgctcacttcatgagaatgtttcaaggaatatttgtagagaaaatcttcattccttatgggaaaataaataataaatgactctatatcaggaaataaarattgtgtaggaagacaaattctgtttgaataactaggtgggaagaaatcctttgaaaactttattggtagtaaataatgccataaatgacctttacattt

SEQ ID NO: 61934 - DNA, 201 bp, Homo sapiens
agtgggcacaagacctgaacagacatcactcaaaagaagacatagaaatggccaacgaatataaaacaaaatgctcaacattcttagtcatcagagaaatmcaaaataaaaccagagagagatatcacctcaccctagttatcagagctcttatcaaaaagataaaagataacaaatgctgctgaggatgtggaaaataga

SEQ ID NO: 61935 - DNA, 201 bp, Homo sapiens
gtgggataagagaaaccttttttcaaaagcgttcagataggtggatgtaagagtttttcttgcaggtcgtctttgattattgcttgaaatgctcacttcaygagaatgtttcaaggaatatttgtagagaaaatcttcattccttatgggaaaataaataataaatgactctatatcaggaaataaagattgtgtaggaag

SEQ ID NO: 61936 - DNA, 201 bp, Homo sapiens
gctaacacgtgtactgaaatatctgctacattatctactcaaccctaattctactcacctttctacagcctttgatatttagagttactccgtcctcacasaactctttccaactccagcactggaaacaattgactcctgtctctaccaaactgtacgtcccagattcttgtcttaggagccatagaactccaaaggttt

SEQ ID NO: 61937 - DNA, 201 bp, Homo sapiens
atttgagaaatatttcccaagaacgtaggccccttcctcagcactgtgtccccaggatcctgatgagtggctgacacaggataagtgctaaattaagaaakattgactaaatgaatgagtaacccttcaaaacggttatttttcttcttcaaatgttttgctacttcattaaagttgtaaagtaagtaaacttgcattgga

SEQ ID NO: 61938 - DNA, 201 bp, Homo sapiens
ctcagactttgatattattccctgtccttttagggcagcttgagcccttttgtttgacttagcacaacgtgactccaaactagggttgttttaatttcccragacacagtagtaggcaatttcttgaggacctaattgcagatagagtttgtcggtctcagcatgtgggagctccagatgaatggcagtaatgggaagcag

SEQ ID NO: 61939 - DNA, 201 bp, Homo sapiens
atacatttgagaaatatttcccaagaacgtaggccccttcctcagcactgtgtccccaggatcctgatgagtggctgacacaggataagtgctaaattaakaaagattgactaaatgaatgagtaacccttcaaaacggttatttttcttcttcaaatgttttgctacttcattaaagttgtaaagtaagtaaacttgcat

SEQ ID NO: 61940 - DNA, 201 bp, Homo sapiens
gacaacaaagaagggagaggaataaatcacagggtgagcagttctaaaaagcaacagtcttgtcaggaataaacaatcaccatcgtaaactcagactttgrtattattccctgtccttttagggcagcttgagcccttttgtttgacttagcacaacgtgactccaaactagggttgttttaatttcccaagacacagtag

SEQ ID NO: 61941 - DNA, 201 bp, Homo sapiens
tgatgatcaatatcagtaagtaatcagtgaaagttttcacctatttaagatgattagcacacatatatacatttgagaaatatttcccaagaacgtaggcyccttcctcagcactgtgtccccaggatcctgatgagtggctgacacaggataagtgctaaattaagaaagattgactaaatgaatgagtaacccttcaaa

SEQ ID NO: 61942 - DNA, 201 bp, Homo sapiens
ttacatcagaggcctgattcatttcaaaaccttcctcagagcaaggggtaattgccaggtaccctttaaagccagaattaatacatataacccatatttaygctgtctcaagactaattagcatggtgttgcatgctagacaaataagttcaactccagaaaacatgtaaaaactaacagaagtttcaacttgaatatctt

SEQ ID NO: 61943 - DNA, 201 bp, Homo sapiens
atgccaccacacctggctaattttttatattttgtagagatggagtcttgccatattgcccaggctggtctcaaactcctgggctcaagctatcctcccaycttggcctccaaaagtgttaggattacaagtgtgagccaccgtacccagccaaatttttatgttcttttatcccctcacttatcataaacaatttagtca

SEQ ID NO: 61944 - DNA, 201 bp, Homo sapiens
cttaagctttcatataaactttatttaattttgctttctatgtgacaagttatacttctagccaaacaactcttggatgttttatggagacagcaaagacrtagagtaaatagaaattgatattgaaggaaagcataactacttgctatttctgacaataagtctgttgaaagcattaagaatgtagtaatcatgagaatt

SEQ ID NO: 61945 - DNA, 201 bp, Homo sapiens
ggtgcgacaccatgccaggctaatttttgtatttttaatagagatggggtttcaccatgttggccaggctggtctcgaactcctgacctcatgatccaccygcctcagcctccaaaaatgctgggattacaggcgtgagccaccatgcctggcaaagaatgacactgggtgtattaaaaagtatgataagtgacatgatca

SEQ ID NO: 61946 - DNA, 201 bp, Homo sapiens
cacacacacatattaagggaatacgcaaacaaaaaatggcagaaataatatgggaaaagacagaacttaagaaagaaattgtcaagcaggtctacaaaatrattgttttattttggtgccaggtacagtccacaatgaagtcaagatattaagaagtaaagtggaccaggagaagttagagcagaaatatctcttttcaat

SEQ ID NO: 61947 - DNA, 201 bp, Homo sapiens
gatttccattataaaatatgaaacgtagtgagcatttttttggtttttttttgagacggagtctcgctctgttgcccaggctggagtgcagtggcatgatytcggctcactgcaagctctgcctcccgggttcccgccattctcctgcctcagcctcccgagtagctggggctacaggcacccgccaccatgccaggctaa

SEQ ID NO: 61948 - DNA, 201 bp, Homo sapiens
accccaagcacattacttttatgatttattactggttatcttctaggatttccattataaaatatgaaacgtagtgagcatttttttggtttttttttgaracggagtctcgctctgttgcccaggctggagtgcagtggcatgatctcggctcactgcaagctctgcctcccgggttcccgccattctcctgcctcagcc

SEQ ID NO: 61949 - DNA, 201 bp, Homo sapiens
aaagaggaagatgtaaattatgtagtataataccacttaacagttttttaaaaagatacatatgtttaccccaagcacattacttttatgatttattactkgttatcttctaggatttccattataaaatatgaaacgtagtgagcatttttttggtttttttttgagacggagtctcgctctgttgcccaggctggagtg

SEQ ID NO: 61950 - DNA, 201 bp, Homo sapiens
gcagggctattgttatcactgagactgatgatcaatatcagtaagtaatcagtgaaagttttcacctatttaagatgattagcacacatatatacatttgwgaaatatttcccaagaacgtaggccccttcctcagcactgtgtccccaggatcctgatgagtggctgacacaggataagtgctaaattaagaaagattga

SEQ ID NO: 61951 - DNA, 201 bp, Homo sapiens
cggaagggattattgtcctgatttcagcactgctatctctggtttcactttccttgcagcagaagcaagagactaattgtaggaagagcattagcctgcgyagactatgcttaattaacatcatttctgtggtcttcagtttccatttagtttaatgagattgttgaactcaaatctcaatcactggattctaatttgttt

SEQ ID NO: 61952 - DNA, 201 bp, Homo sapiens
cactgtggcagggctattgttatcactgagactgatgatcaatatcagtaagtaatcagtgaaagttttcacctatttaagatgattagcacacatatatacatttgagaaatatttcccaagaacgtaggccccttcctcagcactgtgtccccaggatcctgatgagtggctgacacaggataagtgctaaattaagaa

SEQ ID NO: 61953 - DNA, 201 bp, Homo sapiens
tgtgctagggagaattgtgttctatttctctaccttttactaactatgaggccttcagcaggcataggatatagcaaaagaaattcccccataactaacargtactctggaactgtcctttctacaatgtgtcagccgcctccagaaatcctgcatggtgagcataccctaagccatcaggacaactttttacctgggcag

SEQ ID NO: 61954 - DNA, 201 bp, Homo sapiens
atcagcagctgtgcttatgactggagagattattttgatatgacggaagggattattgtcctgatttcagcactgctatctctggtttcactttccttgcrgcagaagcaagagactaattgtaggaagagcattagcctgcgcagactatgcttaattaacatcatttctgtggtcttcagtttccatttagtttaatga

SEQ ID NO: 61955 - DNA, 201 bp, Homo sapiens
tcactgtggcagggctattgttatcactgagactgatgatcaatatcagtaagtaatcagtgaaagttttcacctatttaagatgattagcacacatatatacatttgagaaatatttcccaagaacgtaggccccttcctcagcactgtgtccccaggatcctgatgagtggctgacacaggataagtgctaaattaaga

SEQ ID NO: 61956 - DNA, 201 bp, Homo sapiens
gcaggaaaagtccttatttactgagatgaaatagaggactttttgcagggactcctgatcagcagctgtgcttatgactggagagattattttgatatgayggaagggattattgtcctgatttcagcactgctatctctggtttcactttccttgcagcagaagcaagagactaattgtaggaagagcattagcctgcgc

SEQ ID NO: 61957 - DNA, 201 bp, Homo sapiens
aggaagagactattataaacaaatcagtagatgctagaaaggagtaacaacttgaaacctgacccagaaagtaaaaaaagaaaataaatcatcaacagacsttgacattttcaaaagcaaagcaatctgaatccatttggagttttttataatggcctgaatatgtttcaattcactgtggcagggctattgttatcactg

SEQ ID NO: 61958 - DNA, 201 bp, Homo sapiens
atctgttgacacctttactgagtttgttcctattgcaggactctttgattttctggagtgcaaccagtttgagtcttttgatgtaacacatttaaacagggaaatttctgctgtctgcagaacacgacctatatttctgtctcttccctgcctgcagtcttccacacctcataatgttattctttttttctctttactggg

SEQ ID NO: 61959 - DNA, 201 bp, Homo sapiens
attgatcacatactttgtgcctctgttcatctagatactggagttatagcaatgaacaagatgagtgaagtccctgtccccatgttgtttttactcaggtrgggagaaggacaaggaaaaaaataagcaaattaaatgctacggataatagatcaaagcaatgaagaatgagggaaaagtggggagtaacattagacaggg

SEQ ID NO: 61960 - DNA, 201 bp, Homo sapiens
tttttcaattcaagcaggactatcatgtgaccaagctactgcattttgccactctatattgctcccttctggaggctgtgatttttccagaataacgtagyctgtgcaactctgccacctgctggcctcaggtcctcaaaatcctgaaattggggctgggccttagattgtgaactaagtgtcctcttggctgaaacagct

SEQ ID NO: 61961 - DNA, 201 bp, Homo sapiens
aaaattagctgggcatgttggtgcatgcctgtaatcccagccactcaggaggatgagtcaggagaattgcttgaactcgggaggcagaggttgcagtgagyagatattgcaccattgcactccagcctgagcgacagagccagactccgtctaaaaaaacaaacaaacaaacaaagcaaatcaaatatataatttatttca

SEQ ID NO: 61962 - DNA, 201 bp, Homo sapiens
ctgtagactggagctgttcctatttggccatcttggctcctccctcctattttattcttttcagagtgatctgttgacacctttactgagtttgttcctaytgcaggactctttgattttctggagtgcaaccagtttgagtcttttgatgtaacacatttaaacagggaaatttctgctgtctgcagaacacgacctata

SEQ ID NO: 61963 - DNA, 201 bp, Homo sapiens
gagttacgaaggcattgcattagaagactgggtttctaataatgacaatgagtaatcagtgaaactccaagcctgggtcctgggtcaaggagatggtggcyattttgtgaccacctttttcaattcaagcaggactatcatgtgaccaagctactgcattttgccactctatattgctcccttctggaggctgtgattttt

SEQ ID NO: 61964 - DNA, 201 bp, Homo sapiens
caaggccgagcacagtggctcacgcctgtagtcccagcactttgggaggccgaggtgggagggtcacctcagatcaggagttcaagaccagtctggccaamgtggtgaaacaccatctctactaaaaatacaaaaattagctgggcatgttggtgcatgcctgtaatcccagccactcaggaggatgagtcaggagaattg

SEQ ID NO: 61965 - DNA, 201 bp, Homo sapiens
tccccagtgagatgaacccggtacctcagttggaaatgcagaaatcacccgtcttctgtgtcgctcacactgggagctgtagactggagctgttcctattyggccatcttggctcctccctcctattttattcttttcagagtgatctgttgacacctttactgagtttgttcctattgcaggactctttgattttctgga

SEQ ID NO: 61966 - DNA, 201 bp, Homo sapiens
ccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatct

SEQ ID NO: 61967 - DNA, 201 bp, Homo sapiens
tccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatc

SEQ ID NO: 61968 - DNA, 201 bp, Homo sapiens
ctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaat

SEQ ID NO: 61969 - DNA, 201 bp, Homo sapiens
aaaattaaacccagtattttttccctaagacttgggatagattgcttaagataccagtcctaggccttcctaaaatggaagatgaggaactaacctggggyggtggtccaggcttggagtgacatgccatagagggttttgagacagaatagcaatccaaagagaaaaaggaacctttgagtactagcatcagagcaggaa

SEQ ID NO: 61970 - DNA, 201 bp, Homo sapiens
gacatcttactgctttgtagtgagaagagacaaagaaaatttcatgatcttagagactatcgaaacagaaaaaattaaacccagtattttttccctaagayttgggatagattgcttaagataccagtcctaggccttcctaaaatggaagatgaggaactaacctggggcggtggtccaggcttggagtgacatgccata

SEQ ID NO: 61971 - DNA, 201 bp, Homo sapiens
ttactctacctggctccaaaacattttctttcccacaggtaaatcatgtgaaactcctccagttccagtgaatggcatggtgcatgtgatcacagacatcyatgttggatccagaatcaactattcttgtactacagggtgagttggcagcaacatctcttggttccagagttccagcacagcaatactaccttctagcca

SEQ ID NO: 61972 - DNA, 201 bp, Homo sapiens
tagaaactgagacacagagggtttaggtaacttgcacaagaccacagaatggggtagcctgggttcagccaagcaatctacttatctgtagagactgtgcwctttaacaataaataaatggtcaacggacctaaatatataattcaacaagagagaatatttaagtactgtcataatgaaatggaaagctatcaggcaagg

SEQ ID NO: 61973 - DNA, 201 bp, Homo sapiens
gaaagcctttggaatagcagtgttccagtgtgtgaacgtaagtaataggagtaacatttcaggccaatctctcctcttcatctgttcagtatttgacccaygacctcccctaatgtggttcttcaattttctaatctgaattattgatttgaaaatttcttattttagtaatgtttggttgtgaatcaatgtgtacatcac

SEQ ID NO: 61974 - DNA, 201 bp, Homo sapiens
tgtaacgaatattgttgtatattgaaggtactattgtaaattggcaaaatctcttatgaaaaacaattatgcaatgtgtgtggacaataatacaaatattctgccagttagcctcctagaactgcaacctaagaaaatagtgtaaaatataaaatagtttatgcattttattaagggtttcatgagaaagaaaactagaaa

SEQ ID NO: 61975 - DNA, 201 bp, Homo sapiens
cttttgctgtgcagaagctctttagtttaattagatcccatttgtcaattttgtcttttgttgccgttgcttttggtgttttagacatgaagtccttgcchatgcctatgtcctgaatggtaatgcctaggttttcttctagggtttttatggttttaggtctaatgtttaagtctttaatccatcttgaattgatttttg

SEQ ID NO: 61976 - DNA, 201 bp, Homo sapiens
tttactgagaatgatgttttccaatttcatccatgtccctacaaaggacatgaactcatcattttttatggctgcatagtattccatggtgtatatgtgcmacattttcttaatccagtctatcattgttggacatttgggttggttccaagtctttgctattgtgaataatgccacaataaacatacgtgtgcatgtgtc

SEQ ID NO: 61977 - DNA, 201 bp, Homo sapiens
ttcacaagaagtctccatgccatttctaaggtaaatggagtttcttcagttctgcatagttcgatgcaacacagccttgaaagtttctgcagggaaatgcrgaaactatcttaggatgcaagatttagagaaagggtgtaaatatctttctactttggcacataaatatacagaaactgtttaacctcactagaactaaag

SEQ ID NO: 61978 - DNA, 201 bp, Homo sapiens
gtgaaactctaatagaacttaaaagctcttgttttctttctagaaatcttttgtccaaatcctccagctatccttaatgggagacacacaggaactccccytggagatattccctatggaaaagaagtatcttacacatgtgacccccacccagacagagggatgaccttcaacctcattggggagagcaccatccgccgc

SEQ ID NO: 61979 - DNA, 201 bp, Homo sapiens
ataagccccatcatgtttgggtcaggtcattttattcattgctttctcctcatcctcatcatgggacatcgtgaaatcatgaaaaaggtagtgaaagaatkatgacaaggccgagcacagtggctcacgcctgtagtcccagcactttgggaggccgaggtgggagggtcacctcagatcaggagttcaagaccagtctgg

SEQ ID NO: 61980 - DNA, 201 bp, Homo sapiens
tgtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactctttg

SEQ ID NO: 61981 - DNA, 201 bp, Homo sapiens
gaaagattgactaaatgaatgagtaacccttcaaaacggttatttttcttcttcaaatgttttgctacttcattaaagttgtaaagtaagtaaacttgcaytggatctttcccatgtctgcaaaagcttcttattgaattttttcaattgtgggataagagaaaccttttttcaaaagcgttcagataggtggatgtaaga

SEQ ID NO: 61982 - DNA, 201 bp, Homo sapiens
ctgtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactcttt

SEQ ID NO: 61983 - DNA, 201 bp, Homo sapiens
ggctagtcatgggctctgggctctgagctggggttctgatggctgctgttaatatttccagcaaggtcattaccttgtttatgtccacctagtgctcttcrcagggtgcacatctctacacgggagctgaccagcatgggcaacaaagcacctgatcccaaaatgtaacacagaatcttggcaggctccaaaagccagcac

SEQ ID NO: 61984 - DNA, 201 bp, Homo sapiens
ttggaaaagcacagtattagggtgggagtgacccaattttccaggtgccatctgtcacccctttctttgactaggaaagggaattccctgaccccttgtgmttcccaggtgaggcgatgcctcgccctgcttcggctcatgcacagtgcgctgcacccactgtcctgcactccccagtgagatgaacccggtacctcagtt

SEQ ID NO: 61985 - DNA, 201 bp, Homo sapiens
gaatagatgtatgtttgttgcaccagtgtgataggtgatggagggacctattagatgagacatgggcaggggcactcctttatggcctaaaatgcaagackaaattggtgatgcctttctagaaaggaagcatggagatataaaaatccatcatccctcccaattttgtactgggtgaacagtaattggaagcattctaga

SEQ ID NO: 61986 - DNA, 201 bp, Homo sapiens
ccccagaggtggagcctacagaggcaggcaggcctccttgagctgtgatgggctccacccagttcgagcttcccgcagctttgtttacctactcaagcctmggcaatggtgggcgcccctcccccagcctcactgctgccttgcagtttgatctcagactgctgtgctagcaatgagcgagactccgtgggcgtaggaccc

SEQ ID NO: 61987 - DNA, 201 bp, Homo sapiens
atactggtgaactgcaaatgctgctgcctgatcttcctttggaagttttgtctcagaggagtacccgctgtgtgaggtgtcagtccgcccctactgggggktgcctcccagttaggctatttgggggtcagggacccacttgaggaggtagtctgcccgttctcagatctcaagctgcgtgctgggagaaccactactctc

SEQ ID NO: 61988 - DNA, 201 bp, Homo sapiens
gtgggtaacccgacctttctctctggctgcccttaacatttttttccttcatttcaactttggtgaatctgacaattatgtgtcttggagttgctcttctygaggagtatctttgtggtgttctctgtatttcctgaatttgaatgttggcctgccttgctagactggggaagttctcctggataatatcctgcagagtgt

SEQ ID NO: 61989 - DNA, 201 bp, Homo sapiens
ctagttactgtgttttggctggaatggaaagcctttggaatagcagtgttccagtgtgtgaacgtaagtaataggagtaacatttcaggccaatctctccycttcatctgttcagtatttgacccatgacctcccctaatgtggttcttcaattttctaatctgaattattgatttgaaaatttcttattttagtaatgtt

SEQ ID NO: 61990 - DNA, 201 bp, Homo sapiens
aaaatctctcagcatttgcttgtctgtaaagtattttatttctccttcacttatgaagcttagtttggctggatatgaaattctgggttgaaaattctttyctttaagaatgttgaatattggccctcactctcttctggcttgtagagtttctgctgagagatccgctgttagtctgatgggcgtccctttgtgggtaac

SEQ ID NO: 61991 - DNA, 201 bp, Homo sapiens
gtgacaaaatctctcagcatttgcttgtctgtaaagtattttatttctccttcacttatgaagcttagtttggctggatatgaaattctgggttgaaaatyctttcctttaagaatgttgaatattggccctcactctcttctggcttgtagagtttctgctgagagatccgctgttagtctgatgggcgtccctttgtgg

SEQ ID NO: 61992 - DNA, 201 bp, Homo sapiens
gtgtcttttaattggagcatttagcccatttacatttaaggttaatattgttatgtgtgaatttgatcctgtcattatgatgttagctggttattttgctygttagttgatgcagtttcttcctagccttgatggtctttacaatttggcatgtttttgcagtggctggtaccgattgttcctttccatgtttagtgcttc

SEQ ID NO: 61993 - DNA, 201 bp, Homo sapiens
tgcactgtggtctgagagacagtttgttataatttctgttcttttacatttgctgtggagcgctttacttccaactatgtggtcaattttggaataagtgyggtgtggtgctgaaaagaatgtatattctgttgatttggggtggagagttctgtagatgtctattaggtctgcttggtgcagagctgggttcaattcctg

SEQ ID NO: 61994 - DNA, 201 bp, Homo sapiens
cttggcttcaaatttctgtttctttcctgtaggtaaatcatgtcgtaatcctccagatcctgtgaatggcatggcacatgtgatcaaagacatccagttcrgatcccaaattaaatattcttgtcctaaagggtgagttggcatctcttgaaccaacatctcttggttcaagggttctaacacagccatactaccttctag

SEQ ID NO: 61995 - DNA, 201 bp, Homo sapiens
gctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaa

SEQ ID NO: 61996 - DNA, 201 bp, Homo sapiens
aggctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggac

SEQ ID NO: 61997 - DNA, 201 bp, Homo sapiens
agacagacagacagacacacacacacacacacacaatcagagagatgaacttttgaaagtatatataggaagaaaggaaagacacatatggaactaataayatgagatatgaagaggacactgggccatatattaactggcaaattcaaagacaagtataattacttgttattaatatataggtaacacagtaagtttaaa

SEQ ID NO: 61998 - DNA, 201 bp, Homo sapiens
tgtcaactcaggaatcttactatgcctgatttaaagtagacaaccaaatgggtgtttgtaaaaaaattaaaaaaaattactttccaaattcattatgaacrtagctacctggatggtccaaaaacactgtctttgggcttttgcaatagactgtaatttaggtctcacaacagttagttgcctctcaacaaaagccttaca

SEQ ID NO: 61999 - DNA, 201 bp, Homo sapiens
atgagccactgtgcctggcctctatgttttgcagagaaaatgtgccttagagaaatcggataactttctaagatattaacttgcagactgaagactgaaaygcaagtccacccgactccagagacttggctttgctagtcagcatccagtcaggaaatcaaaacttactctagatactttcaaggagggagggatttcatg

SEQ ID NO: 62000 - DNA, 201 bp, Homo sapiens
atctcttcctaaattcatatcaaattagaagcatcaagtgcttttagggaaggaactgttctaaacagaagaaaagaaggaagaaatgatggctaataatytggaagaaagaaaaaaagcctctttggcaccatttaatctgtgtaaaaagagccttaccaatgtagtctgatgacaccactggaaatttggtattggtcc

SEQ ID NO: 62001 - DNA, 201 bp, Homo sapiens
gggctcaagctatcctcccaccttggcctccaaaagtgttaggattacaagtgtgagccaccgtacccagccaaatttttatgttcttttatcccctcacktatcataaacaatttagtcagcttgttttttagcctgcagtattgaatgacatagggcttcccatgtgctaggactttccatgtgtagaaaatgcaatga

SEQ ID NO: 62002 - DNA, 201 bp, Homo sapiens
aggtgagatcatggcttactgcaaccgccacctccctggctcaagcaattctcctgcctgagcctcccaagcagctgggactacaggtgcatgctaccacrcctggttaaattttttatattttttttatagagatcgaatctcaccatgtttcccaggcttgtctcgaacacctgagctgaagcaatccacccacctggg

SEQ ID NO: 62003 - DNA, 201 bp, Homo sapiens
agggtcttgatctgtcactcaagttggactgcagaggtgagatcatggcttactgcaaccgccacctccctggctcaagcaattctcctgcctgagcctcycaagcagctgggactacaggtgcatgctaccacacctggttaaattttttatattttttttatagagatcgaatctcaccatgtttcccaggcttgtctc

SEQ ID NO: 62004 - DNA, 201 bp, Homo sapiens
gcccaggctggtctcaaactcctgggctcaagctatcctcccaccttggcctccaaaagtgttaggattacaagtgtgagccaccgtacccagccaaattyttatgttcttttatcccctcacttatcataaacaatttagtcagcttgttttttagcctgcagtattgaatgacatagggcttcccatgtgctaggactt

SEQ ID NO: 62005 - DNA, 201 bp, Homo sapiens
ttatggagacagcaaagacgtagagtaaatagaaattgatattgaaggaaagcataactacttgctatttctgacaataagtctgttgaaagcattaagartgtagtaatcatgagaattcatccttcacaactgagtgtcccctatttaaatctgcaaactcttagagttaaagtagggctgacagaaatgagaaataga

SEQ ID NO: 62006 - DNA, 201 bp, Homo sapiens
ttgaaagttcaatagagcttatctttttttttttattcttacatgtttgttgggtaattctagctttctaaatctttttgaatgaatattggcaatttatrtttccatttatatcatttagattttcaaaatatttaacccccagtagtctacagttttataaatattctcatattcataaaaatgtttaaattccttttc

SEQ ID NO: 62007 - DNA, 201 bp, Homo sapiens
ctgattaaaaggcaggtctgctagtcattgtgtcttggctggaatgaaagccctttggaatagcagtgttccagtgtgtgaacgtgagtagaaagaactaygtagtttggatagctctccttatttttgttttccagtgttttactgcacggaatcacttgtctggatctttacttaactaaattactgattaaaatactt

SEQ ID NO: 62008 - DNA, 201 bp, Homo sapiens
tggatccccttctctctctctctctacgttcctcgcactgaccaacctctttgtgatcttcaggcgtgccatacccccagcccgtaataaaatctttactkccatcttgtgtttcttgtaatgactgaagaggttttctctatcataaagatcctaaatgaaaacatacccgcatatgagctctttctggtgtgtttcctt

SEQ ID NO: 62009 - DNA, 201 bp, Homo sapiens
agggagagatgggaattgctcacacatttgctaccacttttttttttctttaggttctgattaaaaggcaggtctgctagtcattgtgtcttggctggaaygaaagccctttggaatagcagtgttccagtgtgtgaacgtgagtagaaagaactatgtagtttggatagctctccttatttttgttttccagtgttttac

SEQ ID NO: 62010 - DNA, 201 bp, Homo sapiens
gtaatatattacattgattgatctttaaagggcaaacaaactctgaattcctagaatcaacctatgttgcttgtgatgtgttatagatgattatcctatcwatgaaatgtgtgtgagtgtgtgtgtggtgtgtgtgtgcaggattgctcatatttttattgtaacgttgtaacattgatttaatatttaaaatcagtcaag

SEQ ID NO: 62011 - DNA, 201 bp, Homo sapiens
tagaagggtgaggagggtggagaagagttttattgagtgacaaaacagcttctcagcagagaagagacacaagggtggaccccagatgaagtcagggggtyattctctcagtgtggctggttctggagcctttatggactcagaattggaagtgtgtgttaattggttggtgagtatgcaaaaaaggctaaaacaaagcca

SEQ ID NO: 62012 - DNA, 201 bp, Homo sapiens
taatctaattgggtagttgacctgtgtatttagaatgtaacattccttattttttgcctctagataccgactcattggttcctcgtctgccacatgcatcrtctcaggcaacactgtcatttgggataataaaacacctgtttgtgacagtgagttgaaatatgcattcctatttcttttaccgatacattctaatttttc

SEQ ID NO: 62013 - DNA, 201 bp, Homo sapiens
tttataaaatgtatgctagaaaaaaaagatgaatgagatggaaattgtttgcctcataataaggcaaaggttgttttaggaaacttaaaaccagtcaatartggaatctgtaatagtgtatgaataactatgttttaacccaattacatatcttcatgtcaagaatggccagtgtaattgttttgatgcaagatttttctc

SEQ ID NO: 62014 - DNA, 201 bp, Homo sapiens
cagagagattaatttatggaagggtagttttgaaataagggtagggactaagtggcaccgccttcagaaaacaatgaaaaaatggcacatacaactcaatrtcagatacaaacctaaatacagtcactgatcttgggtacacagttggaacttgaaatgaatgggtacgtatttatttggaggcaaaagaacataatttta

SEQ ID NO: 62015 - DNA, 201 bp, Homo sapiens
acctgggatctttctgtgctattccctacaactgcatgggaatctgattatctcaaaataaaatttttttttttttaagttactactaaatttccaagggsatgggcttcctaccaaagaattgtatattgtgaaattaaatcattcgaacttaaaacaattcaaacttatagctgggagaactttaaattattctgagcc

SEQ ID NO: 62016 - DNA, 201 bp, Homo sapiens
aaatgttattattaggggaaaattgagtaaagtgtacctgggatctttctgtgctattccctacaactgcatgggaatctgattatctcaaaataaaattwttttttttttaagttactactaaatttccaaggggatgggcttcctaccaaagaattgtatattgtgaaattaaatcattcgaacttaaaacaattcaaa

SEQ ID NO: 62017 - DNA, 201 bp, Homo sapiens
gttggtttcaaagaacatctttatttctgctttcatttcgttatgtacccagtagtcattcaggagcgggttgttcagtttccatgtagttgagctgtttygagtgagtttcttaatcctgagttctagtttgattgcactgtggtctgagagacagtttgttataatttctgttcttttacatttgctgtggagcgcttt

SEQ ID NO: 62018 - DNA, 201 bp, Homo sapiens
tgctcgctgctagtgcagcagtgtgagatccacctgggatgctggaacttggctgggggaggagcatccgacattgctaaggcttgactgggcggttctakgctcacagtgtaaacaaagcgccagggaagcctgaactgggtggagcccactgcagctcagcaaggcctactgcctctctagattccacctctgggtgca

SEQ ID NO: 62019 - DNA, 201 bp, Homo sapiens
tgcctggctggggaggtcccacgcccacggagccttgctcgctgctagtgcagcagtgtgagatccacctgggatgctggaacttggctgggggaggagcrtccgacattgctaaggcttgactgggcggttctaggctcacagtgtaaacaaagcgccagggaagcctgaactgggtggagcccactgcagctcagcaag

SEQ ID NO: 62020 - DNA, 201 bp, Homo sapiens
gtattgtgaatcaccaatttagaaaatggatatatttaaaaattgcaaaggatttctcagctagcgctcagttaagcatattttctcattaaattgtcagyatttcttgtgataactagaagaaaacttagcatggccttgcaaataaatataggcgtattaggccgttttcgtattgctataaagaaatgcctgagactg

SEQ ID NO: 62021 - DNA, 201 bp, Homo sapiens
actctacctggctccaaaacattttctttcccacaggtaaatcatgtgaaactcctccagttccagtgaatggcatggtgcatgtgatcacagacatccakgttggatccagaatcaactattcttgtactacagggtgagttggcagcaacatctcttggttccagagttccagcacagcaatactaccttctagccaca

SEQ ID NO: 62022 - DNA, 201 bp, Homo sapiens
acctaactgatgactttgagtttcccattgggacatatctgaactatgaatgccgccctggttattccggaagaccgttttctatcatctgcctaaaaaaytcagtctggacaagtgctaaggacaagtgcaaacgtaagtaactctggagtgggaacccctctgttagtcaaacatctgtaagatctgattcaatttgtt

SEQ ID NO: 62023 - DNA, 201 bp, Homo sapiens
gcggagcttgcagcgagccgagatcgcgccactgcactccagcctgggcgacagagcgagattccgtctcaaaatcaatcaatcaatcaatcaatcaatchctatacacttataaggatgagagtgaaaaaagacaatatgttggtggtattgtgaatcaccaatttagaaaatggatatatttaaaaattgcaaaggatt

SEQ ID NO: 62024 - DNA, 201 bp, Homo sapiens
agccacatctacagctaccaccagcggaatggctttgcctgcatcttgctggaggatgtcttccagctggggtgagacgcttagcccgggcccggaactcrgtcccctgggcccatggcttccttctgtcattttgcttccttaattgtgccagctgcttccatcccatgctttcccgagcagcccaagggctcagcaggg

SEQ ID NO: 62025 - DNA, 201 bp, Homo sapiens
cattagtattatttggaaaaagtttgactttgcacatttgtgaaggccacttcagcacccaccccctgccccgggctctaccttgagagctgctggtctasctagatccccctcctcatgatggtttttcctcactcccgaagtctggtctgcctctttctcaggcgcccacctttctcccccactgcccgcccaacccca

SEQ ID NO: 62026 - DNA, 201 bp, Homo sapiens
tcgcttgcctctcgggagcagacctgagttccagccctggctccattgcttgctacctgtgccgttgagcgggtcacttcccttcctgtgctctcgtgccytcgtctgtcagatggcaacaatggcaatgtgctctccagagcacagccaaggccaggcttgtgaacacacagattatgtctgtatagcctatgatggagt

SEQ ID NO: 62027 - DNA, 201 bp, Homo sapiens; identical to SEQ ID NO: 24187

SEQ ID NO: 62028 - DNA, 201 bp, Homo sapiens
taagcagtaaagcttgctcatggctgttgcacatctctgtgactcttgtttctggcaggccccactcctggcagctgagtgctgcacctgccttctcgatyacgagcctgagaactgcacgggggagcagcccagactggctggaaaccatgttttcagagtgcagggtcaagtggcgtgtaggactctgtcaaaagaatg

SEQ ID NO: 62029 - DNA, 201 bp, Homo sapiens
cacagattatgtctgtatagcctatgatggagttgctggcacatagtaacgtcagtaaatgggagcaaagaccacctgggggtgaggaatgggcttggccrgtgggtggggctgagtaaggactggtgcctggaccaaggctgtcaggatcaccctgggcaaagcactgaggctcagccctatccccgagctggcaatcag

SEQ ID NO: 62030 - DNA, 201 bp, Homo sapiens
cttctcgatcacgagcctgagaactgcacgggggagcagcccagactggctggaaaccatgttttcagagtgcagggtcaagtggcgtgtaggactctgtyaaaagaatgacccctttccccaccacatacccacaactgcacaggttaaaacagaaatcttgtcattttataattgtaatccacgccgggtgcagtagct

SEQ ID NO: 62031 - DNA, 201 bp, Homo sapiens
ctgccctccttggggtgcagccctcattcctcctcctttccatgcagcttcaccagcagcagcagcagcaggagccgtggggtgaggctgcagcctccatsctgtccaggccctgctccagcccctcacagccaccctcgcctgatgaggagaagccatcctggtcaagtgacggtgaggagggtggggcctgcaggggac

SEQ ID NO: 62032 - DNA, 201 bp, Homo sapiens
acaccctcaggtcagagccgttccctggccctgggggtttgggctgggtgggagttcgcttgcctctcgggagcagacctgagttccagccctggctccaytgcttgctacctgtgccgttgagcgggtcacttcccttcctgtgctctcgtgccctcgtctgtcagatggcaacaatggcaatgtgctctccagagcaca

SEQ ID NO: 62033 - DNA, 201 bp, Homo sapiens
acgcttagcccgggcccggaactcggtcccctgggcccatggcttccttctgtcattttgcttccttaattgtgccagctgcttccatcccatgctttccygagcagcccaagggctcagcaggggcagggtcagggaggataaccatgggctgctctgggggctggggcaggagcccacctggctgtccctgatcactgc

SEQ ID NO: 62034 - DNA, 201 bp, Homo sapiens
ccatgcagcttcaccagcagcagcagcagcaggagccgtggggtgaggctgcagcctccatcctgtccaggccctgctccagcccctcacagccaccctcrcctgatgaggagaagccatcctggtcaagtgacggtgaggagggtggggcctgcaggggacagagcctggtggacactgggcatcatggaactgcccagc

SEQ ID NO: 62035 - DNA, 201 bp, Homo sapiens
ccagacaacagtggggaacccagaaggcccggaatctgttccccggagggtttcaggtgaccacagacacccagaaggagcctgaccgggcctcttgcackgactgagacgactcctcagggtcagtattgcctcctgtgaggggagggagaaaggacggcataggtagttggtttggagtccgacttgaagcgatgggag

SEQ ID NO: 62036 - DNA, 201 bp, Homo sapiens
gagcgggtcacttcccttcctgtgctctcgtgccctcgtctgtcagatggcaacaatggcaatgtgctctccagagcacagccaaggccaggcttgtgaasacacagattatgtctgtatagcctatgatggagttgctggcacatagtaacgtcagtaaatgggagcaaagaccacctgggggtgaggaatgggcttggc

SEQ ID NO: 62037 - DNA, 201 bp, Homo sapiens
tcgtgccctcgtctgtcagatggcaacaatggcaatgtgctctccagagcacagccaaggccaggcttgtgaacacacagattatgtctgtatagcctatratggagttgctggcacatagtaacgtcagtaaatgggagcaaagaccacctgggggtgaggaatgggcttggccggtgggtggggctgagtaaggactgg

SEQ ID NO: 62038 - DNA, 201 bp, Homo sapiens
ctccagcctgggcgacacagcaagactccatctcaaaaaaaaaaaaaaagagtgtacaagcacacatttcatcagctgtcagtgtgatgtgacatgttcaygtgtcttgtagcctctggaaaactccactgtactctcagagtacaagaatgaaaacatcagaaagcattagtattatttggaaaaagtttgactttgcac

SEQ ID NO: 62039 - DNA, 201 bp, Homo sapiens
agtggggaacccagaaggcccggaatctgttccccggagggtttcaggtgaccacagacacccagaaggagcctgaccgggcctcttgcactgactgagaygactcctcagggtcagtattgcctcctgtgaggggagggagaaaggacggcataggtagttggtttggagtccgacttgaagcgatgggagcagtggtgg

SEQ ID NO: 62040 - DNA, 201 bp, Homo sapiens
agttctcaaagcttttggtcttaggaccaaaaatacacttaatatactttaagttgtacttaagtgtattaagttgtacttaaagtgtattaagtatatcttttttttttttaagacagagtttcactcttgttgctcaggctggagtgcaatggtgaggtcttggctcactgcaacctccacctcccaggttcaagcaat

SEQ ID NO: 62041 - DNA, 201 bp, Homo sapiens
gggtaacagagagagaccttgtttcaataaaaaggaaaaaaaaaaaagaaggaaattgtagctgagaacaactttaaaatgtaagagtgcggctgggcgtrgtggctcacacctgtaatctcagcactttgggaggccgaggcgggcggatcacaaggtcaggagatcaaaaccattctggccaacatggtgaaaccctgt

SEQ ID NO: 62042 - DNA, 201 bp, Homo sapiens
tgagacaggagaatcatttgaacccgggaggtggaggttgcagtgagccaagattgcgccactgcactccagcctgggcgacacagcaagactccatctcaaaaaaaaaaaaaaagagtgtacaagcacacatttcatcagctgtcagtgtgatgtgacatgttcacgtgtcttgtagcctctggaaaactccactgtact

SEQ ID NO: 62043 - DNA, 201 bp, Homo sapiens
agcaggggcagggtcagggaggataaccatgggctgctctgggggctggggcaggagcccacctggctgtccctgatcactgcagcatcccggcacccccmcttcctcccggcagacaatttattttcattgtcaccttcacaaccttcctccttcgatgcgtggattacaatgttctctttgccaaccaaccaagtaacc

SEQ ID NO: 62044 - DNA, 201 bp, Homo sapiens
tcctttgcccttatggatgtgaagcgccacggacaccctcaggtcagagccgttccctggccctgggggtttgggctgggtgggagttcgcttgcctctcrggagcagacctgagttccagccctggctccattgcttgctacctgtgccgttgagcgggtcacttcccttcctgtgctctcgtgccctcgtctgtcagat

SEQ ID NO: 62045 - DNA, 201 bp, Homo sapiens
ctctcctcttgcacccagcctgaggccttcctggccaacctcttcgtgcaccctctcctgcctccgagagatctgagcccgacagccccctgtccagctgyggccacagccagcctccttgcctccatttcccgaattgcccaggaccccaggtgaggagtggaggctgagatgcaggggcatgtggaggggggtgggctg

SEQ ID NO: 62046 - DNA, 201 bp, Homo sapiens
tgtcagatgccatcctaccctcagcccagtgtgctgagaggttagtgacaacctggtggggccctgggggtgaagcatgggcagtgggtagaggagtagaygggagccccactttgtcccgtcatctagatcagcagttctcaaagcttttggtcttaggaccaaaaatacacttaatatactttaagttgtacttaagtg

SEQ ID NO: 62047 - DNA, 201 bp, Homo sapiens
ccttgctcccctgggaggtccggagccctctgcacagcctttatgtgcagcaaggggagaggtcttagaaggcccctgagcagaggagagggaggaggccrgggaagcagaggtggtgagagcggaagctggacctcggattggctctggcgggagactgctcacccgtctcgttctcctcctcccttctttcccctcctc

SEQ ID NO: 62048 - DNA, 201 bp, Homo sapiens
ccagctcagtgtcacagacctttgtggaagcaacaacagctcccatccttccaacctttctggagaagccgtggcctgatggtgagccgaatgggctgggrggggagaagaaggcggctggggcggtggggagatctggggcccggatcggtgcccctcctccccatgccactgccacctcctcctcctccttcatgccgg

SEQ ID NO: 62049 - DNA, 201 bp, Homo sapiens
gcccggaatctgttccccggagggtttcaggtgaccacagacacccagaaggagcctgaccgggcctcttgcactgactgagacgactcctcagggtcagyattgcctcctgtgaggggagggagaaaggacggcataggtagttggtttggagtccgacttgaagcgatgggagcagtggtgggaatttggggtgatggg

SEQ ID NO: 62050 - DNA, 201 bp, Homo sapiens
tccactctggcgccccccagggcacagctctaagtttcttgggcacctctggggccgagtacaacaagatgcagctgcctggggtgccacctcggctcgcrgcccctccaccccgggggtgctcagcaactgcacctcgcccctggtgagtcccaagcctggcctccccttctgccttcacccccacaactcctctccaaa

SEQ ID NO: 62051 - DNA, 201 bp, Homo sapiens
tggcccgcgcctaccgccccgccgccgccttcctgcgcaccgctgcgccccccgcgcccctgcgcacgctgctggcccgccagctcgttttcttcgcgggygcactcttcgccgcgctgcttgtgctcaccgtctacgacgaggacgtgctagccgtggagcacgtgctcaccgccatgaccgcgctcggggtcaccgcca

SEQ ID NO: 62052 - DNA, 201 bp, Homo sapiens
cttcccctctaggctcaccttaggtagtaacctgcctcaccagcccccgcccccagcctgctctcctgccttctttaggcctctgcttcctccctactccrtttctgtcctctcttctgactccctctttggctttccctctcctcttgcacccagcctgaggccttcctggccaacctcttcgtgcaccctctcctgcct

SEQ ID NO: 62053 - DNA, 201 bp, Homo sapiens
gggtgggctgatcctgtaggagtggggagctggggcgctgaggggggattcagaaggggagtcctctggggtgtggcgggaggagggcatgacttttgacstgcttcatgttatgttccagctctgtgtccccaggaggcactgggggccagaagctggcccagctcccagaacttgcttctgccgagatgagtctccatg

SEQ ID NO: 62054 - DNA, 201 bp, Homo sapiens
cagctgcaggattccctatcagcaaagactgaatgatgtcaaacgttcagaaaaggagaaactaagtgggtgcagcacaatcaatcactttgcatttcaasgtgaacttgcagctcttatggggagggaattctctatgtcattttccacgtaaataaagtaatgagaccactttgttgtagcaaagaaattcagtttgtt

SEQ ID NO: 62055 - DNA, 201 bp, Homo sapiens
aggagcttatcagagccacagcaccacgttccaagggcaaagaaggagaaagagctccacatttacatcccagccttggatttaagcctagagatcttccytcctctaccctcccacccccatcacttccccttccagcacccatcattgctccccctggttgaacctcgtccttgtgaggtccaagtgaaaatttcccct

SEQ ID NO: 62056 - DNA, 201 bp, Homo sapiens
agtaagaaggtgtcaactcaatagggcctggcagcccattgtaatgactggggctttcacactgagtgaaagatggtaagcatccaagggagaaacaggasagcaattaaaagagtggcaaaaatctagacttggagagtaattaccaccgattataagaagtggtcaggttccagatgtcttcaaaggcagagccaacag

SEQ ID NO: 62057 - DNA, 201 bp, Homo sapiens
gggtaatatccttttaactctgattgaattatatgttaattccttgcggtggtcttagatttcagacgctattagcaaattatggaggaaaagcaagatcrtatgattcatgaactatcacagcagcaacagtttctaatttccacccatcctctgtgtcatgtgatatgtttcagaaactcacttaaaattgagaaaata

SEQ ID NO: 62058 - DNA, 201 bp, Homo sapiens
cccggtttgggtgggcaggactccaaagcctttaggatcgatggaccagaacagagaaatgaaaatgcaacaagaacagctgtggggaaaaggcagaaggkgggtaggaagcgaagagggtgtgtacttttcctttctgatctgagaaagggaaattttgtgctgggaagagttacgcgggaggaggaaggaaaggcgcca

SEQ ID NO: 62059 - DNA, 201 bp, Homo sapiens
tcgactcccagctcgacagggacctttcttctcctagccagctggaatgcaagctttaaaaaaaaaggaagtgtggggagggctattttttttaataagaygtctcagaaatgatcatgaacacagtaaagctggttttcaaaaaaggaaagtgagaaaagtagtgacaacttgaagctggtagttgaggaagaaggagaa

SEQ ID NO: 62060 - DNA, 201 bp, Homo sapiens
atagcatgctcggggagtgaggagagaagctagagaagactgagatgagtgaaatgcaggcttgattgagaaactaagcagaatttctactaacagtgagsattgagggagaagcgttcctgtaatggaggggaaatgaataaaacctcgactcccagctcgacagggacctttcttctcctagccagctggaatgcaagc

SEQ ID NO: 62061 - DNA, 201 bp, Homo sapiens
gcagacctctttcagcccctgtatttcttactcaggtcatgactggagatacgtgggttggggggctctaatcaccacactcactcttctgtctcacactkcatccctcgtgaatgggtttagttttagtaagaatgtttacaggagagtgttggctacatgtccccaacatcccgggtttgagtcccatctgagccacca

SEQ ID NO: 62062 - DNA, 201 bp, Homo sapiens
aagcacatatcaaaagtactcaggtcaatgaattttccaaagtgagcacacctatgtagccagcaccccaaatccctccttatagccccttttaccacccytaccactgaaatgtaaccactatcctgagaccagcaccataggtttgttttgcctttttctgaactttatatagatggaaatatacagttcatactcaat

SEQ ID NO: 62063 - DNA, 201 bp, Homo sapiens
gaacgcattcgtgagaaggagagttctgctcagttatgaacaaagcaactgcattcaataaatatttgttgagtacctactgtgttccagcagagagctcrcattctagctggggagacagaaaacaaataagtgcatttataattggatgtctgcttgtgatatgtgtgtatcccaggcagagggtccacagaacaaaca

SEQ ID NO: 62064 - DNA, 201 bp, Homo sapiens
attttcaatgtttgagattattcatgaacctgaactgcccttcaacctgtaaatctgaataagtgaggttttactatgatttacaaaaccataaaacaagrcagaaagaggtctgttcatctaatagtggctgtttgtttctcctttcctttttggagaggagggaaaaaaagagcaaatgtctatctagcaagatgacgt

SEQ ID NO: 62065 - DNA, 201 bp, Homo sapiens
gacagctacctgcccagatgatgtaccttagccccaggaaggaggaggaagaagaggcagacagaatgatgcccaaacccctgcggcccggagacgaggtrgtgcctgagtcaggaagctgggagagcccagctcagtggaagaggcatgtggatcctggttaggtgtgaagccaggagggcttcttagccacagcctgaa

SEQ ID NO: 62066 - DNA, 201 bp, Homo sapiens
aaccaacaagaaacacactaaatacaaatggcgtttctcaattcattagagcaagcctgcaagaaccttgacctgggagtagtgaggccactttctcagcsactagttcatgccattatatatacataccagttttaacaatacattatttttataattttcaatgtttgagattattcatgaacctgaactgcccttcaa

SEQ ID NO: 62067 - DNA, 201 bp, Homo sapiens
caccaccaggtgtctggctagaaagatgtcatcttcccaagacagctacctgcccagatgatgtaccttagccccaggaaggaggaggaagaagaggcagrcagaatgatgcccaaacccctgcggcccggagacgaggtggtgcctgagtcaggaagctgggagagcccagctcagtggaagaggcatgtggatcctggt

SEQ ID NO: 62068 - DNA, 201 bp, Homo sapiens
caggattatgcacacaaatgtttcaagcctttataatttttttaagtccaaatggcataggtccatttataaaatattttctgaatttatattatgatttmaactagcaatatcctattaattaacttatttaaaattcataaggagacaagttatttaaaaaaaaaaacactcttgaactgagtaaaaaatagcacgaag

SEQ ID NO: 62069 - DNA, 201 bp, Homo sapiens
cctcccaaagcactgggattacaggcccgagaaccacacacagcctgctgtgagtgattttaagagaagctgttagagattggggccctagcatctcattraatcactggttgacaccaccacagcctcccagctctcaagcaattcctaggaaaacaggaattcatcgggaaaatattcttgatcctgataccaaaatta

SEQ ID NO: 62070 - DNA, 201 bp, Homo sapiens
gaaagagaaaagcaaatgcaaatatcttcaaacgtcataagaaaaggcaaaagtgaatccgataaatatattttaaaacaataataaaagaggcattttgytgacagataaattcatgaaacaagactgacttttttgaatgccattcatagaactgccaggtcagctgtgtagtgtgaggtatatttcaatgcaaaatac

SEQ ID NO: 62071 - DNA, 201 bp, Homo sapiens
tctcattatcttctttctctgaccctctttggactaaataaactcccagtattcttgaccaacagaggtagggttggaacagaacctcaaaagtcatcatyagacttcctactaatagggcattggaagttcaagcgactaactaggaaacaggttagtatttgtacccctacactgtgcaacagattacataccatttgc

SEQ ID NO: 62072 - DNA, 201 bp, Homo sapiens
gtgccatgttggtgtgctgtacccattaactcgtcacttagcattaggtatatatcctaatgctatccctcccccctccccacaccccacaacagtccccsgtgtgtgatgttccccttcctgtgtccatgtgttctcattgttcaattcccacctatgagtgagaacatggggtgttcggttttctgtccttgcaatagt

SEQ ID NO: 62073 - DNA, 201 bp, Homo sapiens
gagtaccacagtcggagcactgtgtcctgctaaatgtgaggagcattctcctctctgatgttatcatcataaggccagggcctgtggcttaagctcctccrttcccttagagtctcccacaccacacaacaagtttggagacagagaaagtagctaatatttccccctaagtgccaggcactgttttctattttttacatt

SEQ ID NO: 62074 - DNA, 201 bp, Homo sapiens
attagttttgataggtgtgattaatggtattgtgtttatgtaagaaaacaccactatttttagcaatcaacacttagatacagaaagctaaaatgacacarttctgggattcggttatcatacatcagccaaaataaaggaggaaggaaggaaaaatgtacagaagtaaaagtaggaaaatactgataattctggaattta

SEQ ID NO: 62075 - DNA, 201 bp, Homo sapiens
tgcgatcttggctcactgaaatctccacctcccaggttcaagcaattctcctgcctcggcctcccatgtagctgggatttcaggcacacaccaacaccccygactaatttttttgaatttttagtagagacaggattttaccatgttagtcaggctggtctcaaactcctggcctcaagtaatccgcccaccttggcctcc

SEQ ID NO: 62076 - DNA, 201 bp, Homo sapiens
tcccagctctcccttactaaaggccagggaggaaattgtctcgaatgctctccagtccaaaatggaaagttagattcaatggtctgtactcttgggctgastaacctccgtttttccttttcccattgtgctgagtcagccacggggggtgggttgtgcattttaagggtttgaatgcagaaggaaggaaggcttcccagt

SEQ ID NO: 62077 - DNA, 201 bp, Homo sapiens
tttgaatttgacccatctttcactaggatctacagatggtgaaatattaatgaacaggtgggttgcacaatattccaagattgcgttagaattgatttttrtaggctaaattattaacaccagagttgctgacatatattctcatatgattagcaaacccagaagccttaatatcaacacagaatacattcagaaccatca

SEQ ID NO: 62078 - DNA, 201 bp, Homo sapiens
atagttacacaaccttgtgaatatactactgcacaccttaacatggtgaattttatggtacgtaaattacatctcaataacatttaaaaaaaaaaaaaaaagcagcagcagatggctgctggaggaggctgagcttaaatacccctggttacacttcctcctttccttgtatttactggaaggagaaggatttgtcctaag

SEQ ID NO: 62079 - DNA, 201 bp, Homo sapiens
gacgcaacgctatccagcttcccagaaaacaccgcctttttttcttacattacagctctgagtcaaagtgtactgtggcctcagacctggggcatacagcycatttgacagccacaatgagggaaacagcctacttctggagcctgtaccagaaggcagaacgggagactcccagctctcccttactaaaggccagggagg

SEQ ID NO: 62080 - DNA, 201 bp, Homo sapiens
ataccacgaagtagaggttaggtcagggaatctggcctaaatatatgggggggtcagggagatggaggttagtcattccattggaggacagaagaaaaagkaacaagaagttcttttatagtgactgaccataaagttttgaaaaaagaggtattcaaatagcactttaatccacactgcatgttatgagaggctatgggg

SEQ ID NO: 62081 - DNA, 201 bp, Homo sapiens
tatatggagattgttatgtgaattaactcatgcaattacagaagccaagaagtcccacaatatgccactgcaagctggagacccaggataggtgtcattcmgttagagtcctaaggcctgagaactgtcatgggaagactttggattcagccatgactcaagtgtaccagtggacttttcagttacatgagaaaatgcatt

SEQ ID NO: 62082 - DNA, 201 bp, Homo sapiens
ctacaaaaataacctggacatggtggtgggcacctgtaatcccagctactcaggaggtgaggcaggagaatcacttgaacccaggaggcggaggttgcagygagccgagatcgcgccactgcactccagcgtgggcgacaagagcaaaactctgtctcaaaaaaaaaaaaaaaaaaaaaaaaaaaaggagtagaaaacaga

SEQ ID NO: 62083 - DNA, 201 bp, Homo sapiens
atatgagagctgagtgaagacagagaatgtatgaggctttgggtacaggttcctgaggcgtgctcaaatgtacgttaagagaaaagactggaatagggaawgagagaaggaattgatggatgttaaaatgaacatattaattttgcctgtgggcatgtttccattaattggcttttggatctgaaccaagaatagcagaat

SEQ ID NO: 62084 - DNA, 201 bp, Homo sapiens
cttactcagtcttcacacaacccacagagggggacaagatatcaccatccgtacttaacagaggaagaaatgcgctgaagtttacacaattaggacgtgtraggatatgattcagggtgtgtctggattcagaactgcacactgcacctgctgtgctttattgcattagctgctgctgctgctctgacctgggctgacgtt

SEQ ID NO: 62085 - DNA, 201 bp, Homo sapiens
actacagatgctttttaagacacttatgagaattgttctttctacagtttaaagtgcctggcacatatttggtgcctaatactggctaaataaggagatgytggctgtgcgcagtggctcacgcctgtaattccaggactttgggaggccaaggcgggtggatcacgaggtcaggaggttgagaccatcctggctaacacg

SEQ ID NO: 62086 - DNA, 201 bp, Homo sapiens
aagccccttacatatgaaatcttactcagtcttcacacaacccacagagggggacaagatatcaccatccgtacttaacagaggaagaaatgcgctgaagwttacacaattaggacgtgtgaggatatgattcagggtgtgtctggattcagaactgcacactgcacctgctgtgctttattgcattagctgctgctgctg

SEQ ID NO: 62087 - DNA, 201 bp, Homo sapiens
tcagttctgcagatttaaatgagtcatttctgaactgttggcataaggcctatccttttcactcaaatattcccttgaggcatcattttttttttttttttcaaaattgggaaagcgaaggatacaagaagttggaaggaaagcccatgaaagaaaaacacatttactataattaagaaagaaaattaaacagatgatgat

SEQ ID NO: 62088 - DNA, 201 bp, Homo sapiens
attgccttggttttcctctagggcttttatggttttgggttttacatttaagactttaatccatcttgagttaatttttgtataaggagggggtccagttygttttctgcatatggctagccagttttcccagcaccgtttattaaatagggagtcctttccccactgcttgtttttgtcaagtttgttgaatagcagatg

SEQ ID NO: 62089 - DNA, 201 bp, Homo sapiens
ccccagtgtgtgatgttcccctccctgtgtccatgtgttctcattgttcaactccaacttataagtgagaacatgaagtgtttggttttctgttcctgtgktagtttgctgagaatgatggcttccggtttcatccatgtccctgcaaagaacacgaattcttttttatggctgcatagtattccatgatgtatatatggc

SEQ ID NO: 62090 - DNA, 201 bp, Homo sapiens
tgccagcagaggaatactacctgggactaggcatgttcaaaatggcggttccatcttctcttccttttttttttttttttttttttttttttggttagttwgtttgtttttgttgttgttgctgttgtttgagacggagtctcgctctgtcgcccaggctggagtgcaatggcatggtggaggctcattgcaacctccacc

SEQ ID NO: 62091 - DNA, 201 bp, Homo sapiens
cttctgacataaacagcctcctttcatcaaaggatcgtgccatcctttctattttctaagcattaaaaggcagtttaagcagatcagtgaattaggcaaaygtttatattctcccttgcccttttctttttgcatctggtagaatttctcctgttctattgttgatctctttgtaaaagcccgtacattcttagctgccag

SEQ ID NO: 62092 - DNA, 201 bp, Homo sapiens
gctatttttattgacctaaattaatctaagaaaagatagtcacttgctaagtagttgcagcttaaaacaagtttcctactcctgctccccttccaatctcrttgcccatgagctctgtctggtattagtgaaagtgacagaaatacatgtagtgaaagctacatgtattctagttcctcaccaaaatgcatatttagaggt

SEQ ID NO: 62093 - DNA, 201 bp, Homo sapiens
gaatggttgtgttgttcgttgaagtatggtttctacaaatacatattgcctttgtgccatcataaagtcaagaaattgttaagtcaaatcatgagtgaggkatcatctgtacattcatacacacacggtatgaatacatgggggtgtgtgtgtgcatgtgtctatgcatgtaaatgtgtgtttcaaagctctggggtcctt

SEQ ID NO: 62094 - DNA, 201 bp, Homo sapiens
tgatggcttagcttgggctcaggggcctaacaatacaggctgacaaggattctttctttgtattaagcactttctagatttcttggagtggttagcaccawgggtattggctaccaatcctcatttctattaatattatttcatgtagacaaatgtagacaattgatgttttctcaatcctatgtaaagttggtgagaagg

SEQ ID NO: 62095 - DNA, 201 bp, Homo sapiens
cctaaaggcagtgttacatggatatccaaatgtttagagaggacaatcttaaatatacaaaagaatgataaataaataaataaataaataaataaataaawaaataaaagatttcctaatttgtcaccacttgcatgctggaaaccgacagcgctaacttgggtaatatccttttaactctgattgaattatatgttaatt

SEQ ID NO: 62096 - DNA, 201 bp, Homo sapiens
ctgaggagagttcagaaaactccatgctgtgcagtgcaattgggaggaaactcaagggagtgctgtcgtgggacctcccggtggtgatttgtacaaatgamgcaacgctatccagcttcccagaaaacaccgcctttttttcttacattacagctctgagtcaaagtgtactgtggcctcagacctggggcatacagccca

SEQ ID NO: 62097 - DNA, 201 bp, Homo sapiens
agaataaaatgagaaaactcacactcccaccccttcccagagtaaccatgggtaccatgtgccttctatttatgtacatgcatacggttgtacatatagakagatagatagatctacttcatgattttaaactactgcatggtatgaccatgacattattattgtcattactattattattgagacagggtcttgctctgt

SEQ ID NO: 62098 - DNA, 201 bp, Homo sapiens
tcttagaacttaaaatgggaacgtcagagacattaatatctcattcctaccacctaccgcttaatcagtgtgttgctaagccccttacatatgaaatcttwctcagtcttcacacaacccacagagggggacaagatatcaccatccgtacttaacagaggaagaaatgcgctgaagtttacacaattaggacgtgtgagg

SEQ ID NO: 62099 - DNA, 201 bp, Homo sapiens
tgtgcttctctgaacttgtttccctaaccacaaacagaacaagttctctagaggttgagtcagaagaatttttgtggtaaagaggacattgaaagggggtwggtctactaaatgtcttgtgttagggttctccagagaaacagagaaatatatatatatttctatatatatgtatatatattttttatatgtgtgtgtata

SEQ ID NO: 62100 - DNA, 201 bp, Homo sapiens
acacacacatgttttatgtaaggtgcatcatttgcaatgggctggtggaccctgatatcgagttgggggtcaccagtacatgttccccttccctaatggtyagtagtcctgccctgccacatggccttagttaggaccagatttgaccatcagatagttaaataaatcagaactgcaaatccatcaagatcctttctcctt

SEQ ID NO: 62101 - DNA, 201 bp, Homo sapiens
ccccattttctcctccctgtgcttctctgaacttgtttccctaaccacaaacagaacaagttctctagaggttgagtcagaagaatttttgtggtaaagargacattgaaagggggtaggtctactaaatgtcttgtgttagggttctccagagaaacagagaaatatatatatatttctatatatatgtatatatatttt

SEQ ID NO: 62102 - DNA, 201 bp, Homo sapiens
aagaaatgttaaatctgaccccagttgctaaaggcagaagaataacacgagatttgagaccaagccagttcctgtttgactattttgaccccatttatagwcatgtcaaatgtcccccatttctgctggctccagccccatcttgttgctgcttccttgagatgtgaggaacaatcattctttcttctgttctaggccagg

SEQ ID NO: 62103 - DNA, 201 bp, Homo sapiens
cacagagggggacaagatatcaccatccgtacttaacagaggaagaaatgcgctgaagtttacacaattaggacgtgtgaggatatgattcagggtgtgtstggattcagaactgcacactgcacctgctgtgctttattgcattagctgctgctgctgctctgacctgggctgacgttgcagtgagtctggagaaaccct

SEQ ID NO: 62104 - DNA, 201 bp, Homo sapiens
ccaggaggcagaggttgcagtgagccaagatcgtgccgttgcactccagcctgggcaacagaacaagactccaactcaacaacaacaataaaaaagttcamtgtgacctttttaaaagaaatgttaaatctgaccccagttgctaaaggcagaagaataacacgagatttgagaccaagccagttcctgtttgactatttt

SEQ ID NO: 62105 - DNA, 201 bp, Homo sapiens
tgccagcgcagcactgggaaagttaattactgtcgacagtcctcgagcctgttttcataactggtaatgactgttaatatgtcaccactgaagttagagaytcagaaaagtcttttgtcctaggactattaaatgtcatggaagaataacccccaaatttgcctttgggtagataaagttcaatgggactggctgggtgcg

SEQ ID NO: 62106 - DNA, 201 bp, Homo sapiens
gtcctcggtaaggttttccttttaatgaaaaccagccccaaatacttttcctttctaacaaagagcagcctgtgaaatcaagctacagacatagatgccascagaggaatactacctgggactaggcatgttcaaaatggcggttccatcttctcttccttttttttttttttttttttttttttttggttagttagtttg

SEQ ID NO: 62107 - DNA, 201 bp, Homo sapiens
ataatataccgaaggctattctctacatagagtaagaatttctagactaaaataaagtcagaatgtcagaaataaaacaggtgttaaaaatcatccaactygagctactgattttataaatgaacactccaggtcctgcatgataaagtgactccccaaggtcacctagctaggagtgacagggcctggggccagtgaaaa

SEQ ID NO: 62108 - DNA, 201 bp, Homo sapiens
gctactcggcaggctgaggcaggagaatggcgtgaacccgggaggcagagcttgcagtgagccaagattgtgccactgcactctggcctgggcaacagagygagactccatctcaaaaaaataaaaaaataataaaataaaaataaaaaataaatctgtttaatcttcacaataattctacaacgaaaaaattgttatctc

SEQ ID NO: 62109 - DNA, 201 bp, Homo sapiens
gcttcatttggttaaccctactcatccgtgaaggctcggccaggggacttccctggctgattgctcccaaaatatgctgtgatggatagcaccatcagtgygcttccatgaggtatcgtaactaactgtgcaatggttctctcctcaccgaggactgtgagatcctagagaacagggaatgggtattagtcatcacatccc

SEQ ID NO: 62110 - DNA, 201 bp, Homo sapiens
gttagccaagaagagaaaagttttcagtcctagaagaaagaaggtctctgctatcacctcataatagctttggggctactccctccaagatcatagagctygtcagcataaatcatagaggagctgtttgcatgcagcagagggacccagagtgccacctggcatggtccaacctaagaacctaggtgagaagcatgggaa

SEQ ID NO: 62111 - DNA, 201 bp, Homo sapiens
tgggcatagtggcaggtgcctgtagtcccagctactcggcaggctgaggcaggagaatggcgtgaacccgggaggcagagcttgcagtgagccaagattgygccactgcactctggcctgggcaacagagtgagactccatctcaaaaaaataaaaaaataataaaataaaaataaaaaataaatctgtttaatcttcaca

SEQ ID NO: 62112 - DNA, 201 bp, Homo sapiens
aatgtaacttcatcacatatatataaatgatatatagtgtacttcatataaaaatgatttgttatatatacatacacacacatatatatatataatggttwgtgtaccttccctgagaatgtgggcaactggagaactctggccatgggtgcaaaagggcctcccttgctgttccatgatggtgctccctcaggcccctct

SEQ ID NO: 62113 - DNA, 201 bp, Homo sapiens
aattagctgggcatagtggcaggtgcctgtagtcccagctactcggcaggctgaggcaggagaatggcgtgaacccgggaggcagagcttgcagtgagccragattgtgccactgcactctggcctgggcaacagagtgagactccatctcaaaaaaataaaaaaataataaaataaaaataaaaaataaatctgtttaat

SEQ ID NO: 62114 - DNA, 201 bp, Homo sapiens
ggttaatcaccttctcattgaatgtaacttcatcacatatatataaatgatatatagtgtacttcatataaaaatgatttgttatatatacatacacacayatatatatatataatggttagtgtaccttccctgagaatgtgggcaactggagaactctggccatgggtgcaaaagggcctcccttgctgttccatgatg

SEQ ID NO: 62115 - DNA, 201 bp, Homo sapiens
ctagcggctgataaaggaaactctgggcagaagagcctgagatgaatgggatattagtgagaggagctgagccggtcacatagccaagttttgcaggaggraaaaagagaatgggaaattaattataatcaattcctactaaaaccctgagaattggagacaacacataggctattgagagggcgatttctcctaattctt

SEQ ID NO: 62116 - DNA, 201 bp, Homo sapiens
aatggagctgggggccactatccttagtaaattcacgcagaaacagaaaaccaaatacctcatgttctcacttataaggaggagctaaatgatgagaacayacggacacaaagaggggagcaacagacattgggacctatttgagggtggagtgtggcaggaaggcgaggatcagaagaaataacttttgggtactaggct

SEQ ID NO: 62117 - DNA, 201 bp, Homo sapiens
gtattttcaggagagaggaatacacttacttgctctaaggccacacatcttaaaccgagatacatctactctgggaggtttgcagctggagttttcagctraacttttaaaaactttgtttaaaataagttgctttacattggaacttaatatcctcagtggattgagatcgacattctgggaattgaaattgtgtctgga

SEQ ID NO: 62118 - DNA, 201 bp, Homo sapiens
ctggacaatttttcagttcatttttgagaagtaggcatggccttgggagaacattttttaccctctccgcactctcattccatctcacatacaaatacatyaagaaaatgaagccaactgaagcagaggtcaggagtgaaagaaaagttgatataagagcttcagcaacagcagctggccccaggcactagcggctgataa

SEQ ID NO: 62119 - DNA, 201 bp, Homo sapiens
agtgatttttgtacattcattttatatcatgaaactttgctgaagttgtttatcagctgggatctaatgaaacttaagagcttctgcacagcaaaagaaaytaccaacagagtaaacaacaatgatctacagtatgggagaaaatatttgcaaactatacatctgataaagatctaatattcagcatctataaggaattta

SEQ ID NO: 62120 - DNA, 201 bp, Homo sapiens
tttattcttttgtggcaattgtgaatgaaattgcattcctgatttggctctcagcttggctgttgctgatgtatagaaatgccagtgatttttgtacattsattttatatcatgaaactttgctgaagttgtttatcagctgggatctaatgaaacttaagagcttctgcacagcaaaagaaattaccaacagagtaaaca

SEQ ID NO: 62121 - DNA, 201 bp, Homo sapiens
ttctgcaatgggttctcttatttgatgggtagctgagaaaaagagaggcaagggggctttagatcttctggaaatcttgattcgtcagagttgattgactygtctcttccctggagtcagtgacaggcaaattcacaatttcactcaatgctcgcactgaatagctaaaaaatggccagtattctgggctagaacctgatg

SEQ ID NO: 62122 - DNA, 201 bp, Homo sapiens
ttttgtcgaagatcagatggttataggcgtgcaggcttatttctgggctctttatcctgtttcattggtctgtgtgtctctttgtaccagtaccaggtggytgtggttactgtagccctgtagtatagtttgacgtgatgcttccagctttgttctttttgcatacaattgccttggctatgtaggctcttttttgattcc

SEQ ID NO: 62123 - DNA, 201 bp, Homo sapiens
ggggctttagatcttctggaaatcttgattcgtcagagttgattgactcgtctcttccctggagtcagtgacaggcaaattcacaatttcactcaatgctygcactgaatagctaaaaaatggccagtattctgggctagaacctgatgacagaaagagatatggaaggaaaacagtgtcctaccacaaagtagcaaagac

SEQ ID NO: 62124 - DNA, 201 bp, Homo sapiens
cttttgttattgttgtttttggtgtctttgtcatgaaatctttgctagttcctatgtacagaatggtattgcctaggttgtcttccagggtttttataatyttgggttttacatttaagtttttaattcatcttgagttgatttttgtatatggtgtatatgtagtcttctacatatggctagcgagttatcccagcacca

SEQ ID NO: 62125 - DNA, 201 bp, Homo sapiens
aaatcatcttatgtaatttattgactaccataccgaaagtgaaaatcgaatggttgtgttgttcgttgaagtatggtttctacaaatacatattgcctttrtgccatcataaagtcaagaaattgttaagtcaaatcatgagtgagggatcatctgtacattcatacacacacggtatgaatacatgggggtgtgtgtgtg

SEQ ID NO: 62126 - DNA, 201 bp, Homo sapiens
gattggataaattctgaaacatacaatgggatattttgcagctattaaagactgtctgtctatattcattgatatgatgaataggtatgatgagttattgagtgaaaaaaatgcagttttcaaactagcacatagtgtaaaacccttttttaaaagtcgtttacactcatgtattttagcataaagaaagacatggaagga

SEQ ID NO: 62127 - DNA, 201 bp, Homo sapiens
gacctactgaacatcatagcttagcctcgcctaccttaaacatgctcagaacacttagattagcctacagttgagcaaaatcatcttatgtaatttattgrctaccataccgaaagtgaaaatcgaatggttgtgttgttcgttgaagtatggtttctacaaatacatattgcctttgtgccatcataaagtcaagaaatt

SEQ ID NO: 62128 - DNA, 201 bp, Homo sapiens
tgcagtctttctcctcagcactatggattataacctgtactttctgtgccgtccttgttctttgaatggcttgagtgtatcttgtctcttttatcttaggstttcttcaattccttttgaaagcagaagaaatatgatataaggcagtgtcatgcccttagttctactgtgcccctgtgttaaggggcataatctactcag

SEQ ID NO: 62129 - DNA, 201 bp, Homo sapiens
ggctcagctaagatcacaacatctagccatggacatgttgactggtacagcctccaggtttttggatggttagcatccagattctagtctttctttctctstctgtctgtctgtctgtctgtctgtctgtctgtctgtctgtctctctctctctctctctctctctctctccctctctccctctctctctctctccctctc

SEQ ID NO: 62130 - DNA, 201 bp, Homo sapiens
aaataaagatctcctaatatttatagtacttgaggttagaatagtcttctaggtagagtactaatatcttgctgataaagcttttgatgctgaatccttgrttattctcttaatataatatcttctgtgcgaataaggctaaaatgcttgcatacactcttgtactcacttaggaatgtaatagagcagtttgggagagtg

SEQ ID NO: 62131 - DNA, 201 bp, Homo sapiens
ttcttatactcatgcttagctctcactctacctttctaacaaatggcctaagcagaggaagatgctaaaggggctgctaaggcagcaagaaaatcaagtarcacagaaacagagtcagttggttctttgcacttaggattctcagaagaattttttgcttctgccttcaaaattaaactggaatattaaaactgatctttt

SEQ ID NO: 62132 - DNA, 201 bp, Homo sapiens
tcctgagcattctctttgatacggaaaataaaacggactaggggagaaggtatagaatgtaacgcactaggggttttttggagggaggataatctctgggmagttccctactcttgaaacctagcctggaatgggctttcacctctgtgctatttatactaaaactgaattggccttagggatgggatggaaagtaattag

SEQ ID NO: 62133 - DNA, 201 bp, Homo sapiens
ctacaggcaggaagaaaatggcaaatggagacaattatttgctgaatttggtctccgtagactcatactttttgcttagttttcattatttgaggataaarattgcttttaggcctaagagactcagctaactggacaatttttcagttcatttttgagaagtaggcatggccttgggagaacattttttaccctctccgc

SEQ ID NO: 62134 - DNA, 201 bp, Homo sapiens
ccaaccccttttattggcagtgaagcaagtcaaatacttactaggaacactagccctttcttagaagcgactcttgttgaaaaaaacatcctgtgctttgygaagtgatttgtccctgaagaactctatgagtaaaagagactctagctgtgactttggccaagtcaggtggtcttgctactgatgagggggctgaatcct

SEQ ID NO: 62135 - DNA, 201 bp, Homo sapiens
tacttgatggccggaagcaaatatcatctcaaggctcccttcctcacaggtctggttcctatgctaataggactcaaagacgaggataggtgactcattamctacccatggcctctatacatgggttggtgttttcacaacatggtggcctaggtattcagactcaaggctccaagaactagtgttctagaaaactaagag

SEQ ID NO: 62136 - DNA, 201 bp, Homo sapiens
taatcaattcctactaaaaccctgagaattggagacaacacataggctattgagagggcgatttctcctaattctttctgcaaggtcttagagtgcttctwacccacaacagaaggtacgagaacctctgccaagcatatggaattgccaacttcaagtcaggagaacttacttgtgagcctcctggagatggttatgtgg

SEQ ID NO: 62137 - DNA, 201 bp, Homo sapiens
gtattcaataaggacacagtagaaatggcttgtctctgttccacaatgtcttggaccttagctggaaagaagcaaaggccaatggttacttgatggccggragcaaatatcatctcaaggctcccttcctcacaggtctggttcctatgctaataggactcaaagacgaggataggtgactcattacctacccatggcctc

SEQ ID NO: 62138 - DNA, 201 bp, Homo sapiens
ggaaattaattataatcaattcctactaaaaccctgagaattggagacaacacataggctattgagagggcgatttctcctaattctttctgcaaggtctwagagtgcttcttacccacaacagaaggtacgagaacctctgccaagcatatggaattgccaacttcaagtcaggagaacttacttgtgagcctcctggag

SEQ ID NO: 62139 - DNA, 201 bp, Homo sapiens
caggtattcaataaggacacagtagaaatggcttgtctctgttccacaatgtcttggaccttagctggaaagaagcaaaggccaatggttacttgatggcyggaagcaaatatcatctcaaggctcccttcctcacaggtctggttcctatgctaataggactcaaagacgaggataggtgactcattacctacccatggc

SEQ ID NO: 62140 - DNA, 201 bp, Homo sapiens
tcttggtggtgcctagttctgtttttacatggaggcatcagataaaatgcaatgattccaataggattcagctatcatcacccattaacaggtcagttctragggaagcagctctctggggatttattgtggaatgagagaggagagaaaactttatagccaaagcaaaacgcaaagagatagatctatttgagaatcctg

SEQ ID NO: 62141 - DNA, 201 bp, Homo sapiens
tctgctttgaatgtgggatttttgcactctatgatatatacctttggagtggttttgttttctttgtggttttttttttgtttgttttttgttttttgttytttttgtgtgagacagtggatttttttatccatcattgcattattggagttttatgtgatttaatgtataaaaagtgaggctattctccaactagttgtt

SEQ ID NO: 62142 - DNA, 201 bp, Homo sapiens
ggactgaggagccaaatccaatgactggcatctttagaagagaagggaaaacagacccagagacccagagggagggccatgtgaagatgaaggcagacgtkggagttctgcacccccaagcccaaaacaccaaagactgccagcaccccgcagaagtctggagaagggcgtggaatgaattctccttcaagccttcagaat

SEQ ID NO: 62143 - DNA, 201 bp, Homo sapiens
ggatcctgacaagtaattcacctctgctttgaatgtgggatttttgcactctatgatatatacctttggagtggttttgttttctttgtggttttttttttgtttgttttttgttttttgttttttttgtgtgagacagtggatttttttatccatcattgcattattggagttttatgtgatttaatgtataaaaagtga

SEQ ID NO: 62144 - DNA, 201 bp, Homo sapiens
ggcggggagccaagctggggcgactgggggggcctgggggagctagcggggcgggacccgagcggggcggagagtggcaggaggaggcgaatctccgcgcyccggcgaactttatcgggttgaagtttctgctgtcgcctcccctttgcgtgcggagctgggctttgcgtgcgccgcttctggaaagtcggctccagtcat

SEQ ID NO: 62145 - DNA, 201 bp, Homo sapiens
ttgagctaggaacatttcaaattttctcttctggctattttgagatactcaatatgtttttgttaactatagtcaccctactttgaggctgaatactagcrcttattccgtctaactatatgtctgtacctattaaccaacctctcttcatcccacacacccttcatagcctctagtagctaccattcttttctctacctc

SEQ ID NO: 62146 - DNA, 201 bp, Homo sapiens
aaggcagtgttacatggatatccaaatgtttagagaggacaatcttaaatatacaaaagaatgataaataaataaataaataaataaataaataaataaawaaaagatttcctaatttgtcaccacttgcatgctggaaaccgacagcgctaacttgggtaatatccttttaactctgattgaattatatgttaattcctt

SEQ ID NO: 62147 - DNA, 201 bp, Homo sapiens
ggccttttttgttgttgttactattgttttctgtttctttaccaaaaaaaatggccagggtggacctcaataacaatcagataacagttgagacagctggkgaaagagatgaggaagaacactaagcgatttcccggaagacagcagaaagaacaaccagtacacaggctgaggatgtaaacaaacccgccatgttgtgga

SEQ ID NO: 62148 - DNA, 201 bp, Homo sapiens
agaggttgtgcaagaccagcctctgtgatctgcgaaggccctgagtcccagacatcgtctccaacactgacctagatccagtgccagcaggacaagaaagwcccctctgctttaacctttacatgaaaagaaactttgaaatgaccaatccacattttttttgtttgtttttttctgctttccacagcccttttctgtctg

SEQ ID NO: 62149 - DNA, 201 bp, Homo sapiens
agcctgagccagtaagacatggttccctctaagatgccaggaaaggacctagggcttccctgggctgagctcttaggtaagccatggcctggcctggcctyttagaggttgtgcaagaccagcctctgtgatctgcgaaggccctgagtcccagacatcgtctccaacactgacctagatccagtgccagcaggacaagaa

SEQ ID NO: 62150 - DNA, 201 bp, Homo sapiens
tcttgttttatactcaagtcatcattaaaatttatagaaaaagagagaatttaaaaaaaaaaacactaaaaaatcaccttgtacgcatatacctcagaagrtctttggcctaatggtaatctgtgacattaaggcaaataaccaaaaatatgtaatttttctatttatttctttgagtgggctcagttgcagatatatgaa

SEQ ID NO: 62151 - DNA, 201 bp, Homo sapiens
ccaacacctttaggaagataggtcttccctgaccctcagtctgaggtctagaagcccttctgccttgcctcacaggcatcttccctcctcccccgtccccyagaccagtccaacagcagcccgtgcagcctctgaagtccactcccagtgctagctgatgggaaccccatgggctcctgtctgctatacaaatggaacaga

SEQ ID NO: 62152 - DNA, 201 bp, Homo sapiens
aaatcaaagactgtctatgaggcaaaacatatactgcagccatttgggggaaagaacaaagcactgaactagagggcaaagaccaacattttggttctagstctgccaagtgtaggacattggactaggcacttaacttcagtaagcctcagtctgcttgtgtacaaaacagagtaaaagatttcttgcatttcctacttt

SEQ ID NO: 62153 - DNA, 201 bp, Homo sapiens
ggcgtgaaccccggaggcggagcttgcagtgagccgagagagcgccactgcagtccggcctgggcgaaagagcgagactccgtctcaaaaaaaaaaaaaaagtgtgttttttgtttttgtgtgtgtgtgtgtgtgtgtgtgtgaatgtctcttcatccaagaaaaatctaaatgggctattgtcttggcgtaggaagtagg

SEQ ID NO: 62154 - DNA, 201 bp, Homo sapiens
ctactcaggaggctgaggcaggagaatggcgtgaaccccggaggcggagcttgcagtgagccgagagagcgccactgcagtccggcctgggcgaaagagcsagactccgtctcaaaaaaaaaaaaaaagtgtgttttttgtttttgtgtgtgtgtgtgtgtgtgtgtgtgaatgtctcttcatccaagaaaaatctaaatg

SEQ ID NO: 62155 - DNA, 201 bp, Homo sapiens
tgggccgggcgcggtggctcacgcctgtaatcccagcactttgggaggccgaggcgggtggatcacgaggtcaggagatcgagaccatcttggctaacacrgtgaaaccccgtctctactaaaaaatacaaaaaattagcctggtgttgtggcgggcgcctgtaatcccagctactcaggaggctgaggcaggagaatggc

SEQ ID NO: 62156 - DNA, 201 bp, Homo sapiens
aatgaattttccaaagtgagcacacctatgtagccagcaccccaaatccctccttatagccccttttaccacccctaccactgaaatgtaaccactatccygagaccagcaccataggtttgttttgcctttttctgaactttatatagatggaaatatacagttcatactcaatacatgctgcatagattctttgattca

SEQ ID NO: 62157 - DNA, 201 bp, Homo sapiens
aaagcttcagccatgcaagaggagttagttctggagacctaatatacagcatagtaacgacagttaacaataccgtattgtagacttgaaatttgctacargggtagatcttaagtgttctcaccacaaaagaaaagaggcagctatgtgaggtgatgggtaagtcaactagtttgattgtggtgatcattttccaatgta

SEQ ID NO: 62158 - DNA, 201 bp, Homo sapiens
ggaggaaaagtgtggcatctttatatagaccagggctcaccggcatatactttgccatttcctgggaaaggaagcttctggctcctggaaaaatggcagamacttgaacagaggattggtgaagtcttttggtttatgtggccagatagtacaaggttcctatcaggaagaaaagcacatagtgtctttcttcactccttt

SEQ ID NO: 62159 - DNA, 201 bp, Homo sapiens
ctccctttattctctctccccttccccaaacccacaatagcctctaccatagtgcttattcttttgacctgttctgatctgctagcctaactattccccarcacctttaggaagataggtcttccctgaccctcagtctgaggtctagaagcccttctgccttgcctcacaggcatcttccctcctcccccgtcccctaga

SEQ ID NO: 62160 - DNA, 201 bp, Homo sapiens
agtggggcctaaacgttgaagacacatgatcacgaagatgggaacaataggcactggggatcactagatggggaaggaagggagcagggggcatgggctgragtgccacctgttgcgtcctatacttattccctgggtgatgggatcattgggatcccaagcctcagggtgatgcaatttacccatgtaataaacctgcat

SEQ ID NO: 62161 - DNA, 201 bp, Homo sapiens
cactctcccagtgccaggagccaggacaattatggggctttccctattgtgtgttcttgctgctaaccagctcccaggcctaggcttctgagaaacagtgyaggcacacaagctgcagatctctcctccctttattctctctccccttccccaaacccacaatagcctctaccatagtgcttattcttttgacctgttctg

SEQ ID NO: 62162 - DNA, 201 bp, Homo sapiens
aagtctcgcctgactagaatataagacccatgggagaagagactttctgctctacccttggcacataccgggtgctcaaaaaatattcaagtgctcgcttyggcagtacatgtactaaaactggaacaatacagagaacattagcacggccccttcacaaggatgacacacaaatttatgcagcattccataatttcgaga

SEQ ID NO: 62163 - DNA, 201 bp, Homo sapiens
ccaggtgtgctccttacatttctgcccgggtgatactctcagagagctcctcgccatgagaactaagtcactctcccagtgccaggagccaggacaattayggggctttccctattgtgtgttcttgctgctaaccagctcccaggcctaggcttctgagaaacagtgcaggcacacaagctgcagatctctcctcccttt

SEQ ID NO: 62164 - DNA, 201 bp, Homo sapiens
tattgcaaacatggcaatgactggccaaaaccaggtgtgctccttacatttctgcccgggtgatactctcagagagctcctcgccatgagaactaagtcastctcccagtgccaggagccaggacaattatggggctttccctattgtgtgttcttgctgctaaccagctcccaggcctaggcttctgagaaacagtgcag

SEQ ID NO: 62165 - DNA, 201 bp, Homo sapiens
aaactctaacataatgttattatacagtaagttctcacttaatgtcatcgacagtttcttggaaactatagctttaagcaaaatgacatgtaacaaaagcrtttttttctcatcaacgttataacaaaacgttaaaggaagtgacattatttatgaacctgctgcatgttgttttgcttaaagttacagattccaagaacc

SEQ ID NO: 62166 - DNA, 201 bp, Homo sapiens
gtaaagatatgtcttggtttcatctgtgttaaataaacctgcacgatgttacaagctggcattgcttcataagcttgaccttagctttcaaataggacctygatcattgctcaatgaccaagtcacaaagttgcctaatgatattggcccacagccatgttattgcaaacatggcaatgactggccaaaaccaggtgtgct

SEQ ID NO: 62167 - DNA, 201 bp, Homo sapiens
atctaagactgctccctcatggaaattaaggagaaggggaaagcctaggctacagatggagaaggatgagtcattccagcagccatggccaagggaactcytggagacgtagggactgtttatgtggccactcaccatcatgcaggcccccaatgggggtgaggcaaggaaggacatagaaagactgctcaagtgcatttc

SEQ ID NO: 62168 - DNA, 201 bp, Homo sapiens
ccacatgaccttaaatgactgtctaactcagtccttgagcccacagaatcttgtgagtctagcactcacagataaaaaaacaccctcaggctttctgtgtyccaactccaagttctagataaagatgtctgattggttaaagtgggtcatgtttaaagtgggtctactcccaattcagttattggtggccagggccatgag

SEQ ID NO: 62169 - DNA, 201 bp, Homo sapiens
agcatccagattctagtctttctttctctctctgtctgtctgtctgtctgtctgtctgtctgtctgtctgtctctctctctctctctctctctctctctcyctctctccctctctctctctctccctctctctctctccattcacctcttagtttttagcattagatctgcattccctcacaggtttttttctctttccac

SEQ ID NO: 62170 - DNA, 201 bp, Homo sapiens
ttagcatccagattctagtctttctttctctctctgtctgtctgtctgtctgtctgtctgtctgtctgtctgtctctctctctctctctctctctctctcyccctctctccctctctctctctctccctctctctctctccattcacctcttagtttttagcattagatctgcattccctcacaggtttttttctctttcc

SEQ ID NO: 62171 - DNA, 201 bp, Homo sapiens
gtgtagcatctcctttgcccctctcctgctgctaatggcctgtttccccttcaccttgtgccacgattgtaagtttcctgaggcctcccccagaagcagamgcctgtacagcccacaggaaccatgagctgactaaccatcttttctttataaattacccagttctttatggcaacgtaagaatggaccaatagagcacat

SEQ ID NO: 62172 - DNA, 201 bp, Homo sapiens
tcagtcaagaatttggtcctttaaaaaagaaagaggaagaaaagaaagcatgagctctatccctcttttgactaaatactaccactgactttcctgtttakaactaaaggctgtctcttgttccacaggtcaaatgcatactttttaaaatgccacttgaccccttgggttccccattctcagtagaaaaacaaaatggtc

SEQ ID NO: 62173 - DNA, 201 bp, Homo sapiens
actggtacagcctccaggtttttggatggttagcatccagattctagtctttctttctctctctgtctgtctgtctgtctgtctgtctgtctgtctgtctstctctctctctctctctctctctctctctccctctctccctctctctctctctccctctctctctctccattcacctcttagtttttagcattagatctg

SEQ ID NO: 62174 - DNA, 201 bp, Homo sapiens
cccccaatttcttaggaaatctgcttgtttgaaagtgtgtagcatctcctttgcccctctcctgctgctaatggcctgtttccccttcaccttgtgccacrattgtaagtttcctgaggcctcccccagaagcagacgcctgtacagcccacaggaaccatgagctgactaaccatcttttctttataaattacccagttc

SEQ ID NO: 62175 - DNA, 201 bp, Homo sapiens
tcctaggagtattttatttttctaagctaaacacttggtgcataggagcttaccacttgcatgtaattttcttgttttgtataaaataaactgaaaaaccrgttctttttttggctgaatttaatcatcaaacctatttttaaaatgctctttgtgtactttctttcctttttagaaaattccttttggtatttaggaaaa

SEQ ID NO: 62176 - DNA, 201 bp, Homo sapiens
taataaaaagtttgtgctcaattgcagtctttctcctcagcactatggattataacctgtactttctgtgccgtccttgttctttgaatggcttgagtgtrtcttgtctcttttatcttagggtttcttcaattccttttgaaagcagaagaaatatgatataaggcagtgtcatgcccttagttctactgtgcccctgtg

SEQ ID NO: 62177 - DNA, 201 bp, Homo sapiens
tttccattgtgcggtaaccgcgcttcatcacagccacctccaatcgaggccgcacggtgtccccagaaccacgctcggtacaacctgccccggccgctgckctcgacttgggagcgcgccccgccccgagcgcacgacctcccttccctctccgcgacttgagcttgcttcccggaaagccagtgtagtggcagcggtttg

SEQ ID NO: 62178 - DNA, 201 bp, Homo sapiens
tgcaattaaattgcttatgagggaggccaggggagtgtgcctcatagctgaccctggaatgactgattacattgtaaagaaacacaaaggagtgtctgaaragaatctgacttcttgagagattgaaaccagcaatcaatttgctgacctgataaagaaatgtcttttcgtgatggctttttttatttttatttttattta

SEQ ID NO: 62179 - DNA, 201 bp, Homo sapiens
acaggccattttcacttgttttgtggtggaatgtcatcagttaaggcaggaaccggcgatctggatgtgtgcgtgcaggtcacaggggatatgatggcttwgcttgggctcaggggcctaacaatacaggctgacaaggattctttctttgtattaagcactttctagatttcttggagtggttagcaccaagggtattgg

SEQ ID NO: 62180 - DNA, 201 bp, Homo sapiens
ttcaggaaaccacatctggaaagggacattgaccaattcaagaaaccccagaaagtgggaagagcacaaccatggtggaccatagacttctttagggcagsgtctgtgccatgcctttgctcacccccactgccctggcacagtgctttatacatagaccatgccgtaagatatttgttgaataaatgagtaaataattca

SEQ ID NO: 62181 - DNA, 201 bp, Homo sapiens
cttcagatccctcagctttcagattgacacagcaacagatcatagtctcctaaattctctggcttaaagcatggagccacacttatcctgccaggctgggkccccagttcttagatgaggctagcagtagccatgaggagtgggcatgtggctagtacaagagaaggaatgctaggtggcacttggtcagcaactttccaa

SEQ ID NO: 62182 - DNA, 201 bp, Homo sapiens
cacaagacaatgtcatcagttaaggcaggaacaggccattttcacttgttttgtggtggaatgtcatcagttaaggcaggaaccggcgatctggatgtgtrcgtgcaggtcacaggggatatgatggcttagcttgggctcaggggcctaacaatacaggctgacaaggattctttctttgtattaagcactttctagatt

SEQ ID NO: 62183 - DNA, 201 bp, Homo sapiens
aaggtactcagtgggggagcttttgagccaggatgagccaggagaaggaatttcacaagacaatgtcatcagttaaggcaggaacaggccattttcacttsttttgtggtggaatgtcatcagttaaggcaggaaccggcgatctggatgtgtgcgtgcaggtcacaggggatatgatggcttagcttgggctcaggggcc

SEQ ID NO: 62184 - DNA, 201 bp, Homo sapiens
gaaggggtttgggggttcttaccttccagaaaagcgggaaaggggttggggcacggagaagaggttggggcacggaaataagggatgggggcacagagatwagaggttggggtgtggaaataagggattggggcacagagatataagaggttggggcgcggaaataagagattgggcgcagagataagaggtcggggcacg

SEQ ID NO: 62185 - DNA, 201 bp, Homo sapiens
aatcctgggctgcaggcattccttggcctggtggccagatttctagcacttgtagcaagctcctaggggaggaggttctggaggaacgcctggccgctgcrgttcaggcgtttggaagttcttgtgtgctggagatgtggctggggtttgtctcacagtggaggcaaggaattgcaacttttttctattattgtacacctt

SEQ ID NO: 62186 - DNA, 201 bp, Homo sapiens
atttataatcctttgggtatatacccattaatgggattgctgggtcaaatggtatttctgattttagatccttaaggaattgccacactgtcttccacaayagaactaatttacactcccaccaacagtgtaaaagcgttcctatttctccacagcctcgccagcatctgttgtttcctgactttttaataatcaccattc

SEQ ID NO: 62187 - DNA, 201 bp, Homo sapiens
gctagaaagggaaaagaacatgaataagtggcaatccagggacagccagaaggaacctggacaatggctcaccggctgagcagagatagagttgcactggktggggggggcgggggtggggggcagttgacagcagcctggattgtgagcaaggagtacgaagaaataataattgaagtagcagaaggtagcaaggggtgc

SEQ ID NO: 62188 - DNA, 201 bp, Homo sapiens
ctagaaagggaaaagaacatgaataagtggcaatccagggacagccagaaggaacctggacaatggctcaccggctgagcagagatagagttgcactgggkggggggggcgggggtggggggcagttgacagcagcctggattgtgagcaaggagtacgaagaaataataattgaagtagcagaaggtagcaaggggtgca

SEQ ID NO: 62189 - DNA, 201 bp, Homo sapiens
agtggtaaccaggttaatagcactgacaaccatgttctttttacaggaaacacaaacgtgaatcacttgttcttacttttcttttacagtggtctcaaatrgtcaagaccccctgctgggaggagcttctatcctgctctgtggaagaaatgggcatgccagatgcctggaagatcagaggctcacattccaggtgggtca

SEQ ID NO: 62190 - DNA, 201 bp, Homo sapiens
ttttctatagaaattactttagagagaaaccctcttccaattgtatttaaatccaccccccaaatataatttattctcttatgaagctttgaaatggaaamttttccccagaagtaaccaggcattgtgcaaagtcgcatccattttgaacaccaaagcagctgtaacaaataagagatgacaaatgccattgtgtaattt

SEQ ID NO: 62191 - DNA, 201 bp, Homo sapiens
gagattggagattacctgtgatggtttggatttagattttgcctccaggtttaggcaatggtaaataggcaggagtttaataggaactaaggttatttgakaattcctgggccactgcaaatagaaagtgttggcaattttgtcttttgggctgcctctgattgaaggcacaggcctgtttcatgaagttctgaaacatga

SEQ ID NO: 62192 - DNA, 201 bp, Homo sapiens
agagcacagaaactccggatcttaattcttgatttcctggcagtgataccttcccattccattacataaggtataagtggcagaagatcagggagaaccayagggctgtaagatattttataagttgttaaataaggggacactgctttatttggggcatgtcactcaatctcttcaacattgtgttaggtaggtatcatg

SEQ ID NO: 62193 - DNA, 201 bp, Homo sapiens
tcaagattattttggagctttaagatttaatgaccgtcctgctgggtttcggacttgcatggggcctgtagcccctgtgttgtggctgagttctcctttcyggaaatggagtatttacccaatgcctgtactcccattgtatcttggaagtagctaacttgtttttgattttacaggctcataggtggaagggacttgcct

SEQ ID NO: 62194 - DNA, 201 bp, Homo sapiens
tttgtgagcactggcaacaatttagcagaacagaatgagttagattcccaattgtggtagatcacgtgtagtagcgaacagagcacagaaactccggatcytaattcttgatttcctggcagtgataccttcccattccattacataaggtataagtggcagaagatcagggagaaccatagggctgtaagatattttata

SEQ ID NO: 62195 - DNA, 201 bp, Homo sapiens
taaaaccatagcaatcattctatttgtttggtcacagtttaaaaaaggaaatttgctataagaaaaataaatacaaacaaacacaaaaagagttgaatgcyacctgcagaagaagcaccaatccaactattttaccctgcccacattcaccatgtttctcacaattgcctataaaaagtagtcaccatttattgtaccagg

SEQ ID NO: 62196 - DNA, 201 bp, Homo sapiens
gcatctagtgtctctatagtaactatttacactcctagggaaaattatctcacagaagcatagagagcctgaccttgtctataaagacagtaaggtataawgattaaaagaataggctctaaagtcaggcagacctgggtaaatctgccacctactagagagcttgggcaagcaagttcaccatgcctggtacctagtgag

SEQ ID NO: 62197 - DNA, 201 bp, Homo sapiens
gatctcatgtacacctagggtcgaagttggaacagagagtatgtggagagcctgggctaagactgaagccgccatgatgaaaaccaaactcaagcagtctygttttttaaaaccaatgggagtagtaaagtataaatgtaaatctcagttatcttatcatgccaccctataggtgtttccagtagttactttagagctatc

SEQ ID NO: 62198 - DNA, 201 bp, Homo sapiens
gtggcatctagtgtctctatagtaactatttacactcctagggaaaattatctcacagaagcatagagagcctgaccttgtctataaagacagtaaggtayaaagattaaaagaataggctctaaagtcaggcagacctgggtaaatctgccacctactagagagcttgggcaagcaagttcaccatgcctggtacctagt

SEQ ID NO: 62199 - DNA, 201 bp, Homo sapiens
cagtcagagagccttgggccagagttccaggggctctgggagtggctgccaggtgagttggacagtccgatttccagtggggtcccacacagatgggacayggcttaggaggaatcctgggctgcaggcattccttggcctggtggccagatttctagcacttgtagcaagctcctaggggaggaggttctggaggaacgc

SEQ ID NO: 62200 - DNA, 201 bp, Homo sapiens
gtagggaatcagacctttagtagacacggagctcttcaaatacagagtgaacttggggcatctgatcatgtgggtcaagatgaacactacagaatacaacygagagccacatgtgagtgaagctgtactcgagctgacaatactgacattcaaaaagcaacaggatgatgagaatgttctggaattagagggtagtgatag

SEQ ID NO: 62201 - DNA, 201 bp, Homo sapiens
ggcaagggaaacaggcccttgaaaagaaggtaatgtagagtgggtagcctccgtattgattaagaaggggacggacttactttccactgtgagagttacgygaagctcggcgtctgtgatggtctagggggcttccaaggcagtcgggcagcatcagtcttcagccgctaagccaagaagatctgggaagcagtcagagag

SEQ ID NO: 62202 - DNA, 201 bp, Homo sapiens
ctttttgccctgaaaattagccttggtggctgagttttgcttttcaggttctcattgctagtgcttattttgacgcttagtgaccatctcattcctactaytggcccgcagtagggaatcagacctttagtagacacggagctcttcaaatacagagtgaacttggggcatctgatcatgtgggtcaagatgaacactaca

SEQ ID NO: 62203 - DNA, 201 bp, Homo sapiens
attgaggataggagagtatatgggtttggcaccatggggtggataggcaaaacaatttggttgataaggcatagatcctgaactaacttgtaaggcttgcytggttttaggacaggtaaaatgggggaatggtaaggagagtttataggctttaaaaggccatgctgtagcaggcaagtgataacaggctttaaccctttc

SEQ ID NO: 62204 - DNA, 201 bp, Homo sapiens
caccctcggctgcgcacgcacagtcgcgcctgccaggccagcgaggcggacgcttgggccaccacccgcaggccgagcccgggcgcgtatcgccacctcgstgcgcaccggcggctctgtggtcttcctgggcgcgcttgcggtcgcgaagggggccctccctttataagggaagccggaggcgcttgggcgggggtggct

SEQ ID NO: 62205 - DNA, 201 bp, Homo sapiens
acccaagtctgactgagttctcccacatttatcccagctgtcacggatgagaggcactttctcttctgctgaccttctggctcctggtgatactgtctacwgcacagatggaaagtacccaggaaacagcataacaacaacaacaaaaaatcacattttttagcttcaaagcaaacaccaaagttaaaagcccaacgcctg

SEQ ID NO: 62206 - DNA, 201 bp, Homo sapiens
tgctgagcctaatgggtgtcagggtcagtccaagtgaaagcaaagagaggctgggatgaagggtgcaaaggaatagtaaagaaagcatgtttgagatccaraacagaataatggattgtggagggaggtattgaggataggagagtatatgggtttggcaccatggggtggataggcaaaacaatttggttgataaggcat

SEQ ID NO: 62207 - DNA, 201 bp, Homo sapiens
gttgttcctgggtctcctgaccacccaagtctgactgagttctcccacatttatcccagctgtcacggatgagaggcactttctcttctgctgaccttctrgctcctggtgatactgtctacagcacagatggaaagtacccaggaaacagcataacaacaacaacaaaaaatcacattttttagcttcaaagcaaacacc

SEQ ID NO: 62208 - DNA, 201 bp, Homo sapiens
taagaattctgaccgcactaaccatgcctaggaaggaaaggcgttgttgttttgtaagggattgaggtttgggagattaatcggacacgatcagcagggaragcacgtgtgtttttatgagaattatgctgagataggtaacagatgaggatgaaatttgggcttgactgaagtaatgggggctgtctgtgaagccttgcg

SEQ ID NO: 62209 - DNA, 201 bp, Homo sapiens
ctgctgcttcccagctgcaccagctaggcaaactcctgccagaggaaatctcacagttggagtgcagtaggcatagatttctcctacttaactggggggasgctgtagtcacagcgaagggaatattattgtgtcccatgggaagaaacatgaagacggagtggacgcttcattcctactccaatcagccatctggagggt

SEQ ID NO: 62210 - DNA, 201 bp, Homo sapiens
atagattttggaagttatgagaaatgtagagagtgagttgagcatagtttgtgatttttagggcctctaaaagtattagggcggcagcagccgctgcatgsagacatgagggctaggctaaaacagtaaggtcaagttgtttgcataggaaggctacagggtgcggtcctggctcttgtgtaagaattctgaccgcactaa

SEQ ID NO: 62211 - DNA, 201 bp, Homo sapiens
gggtctttcctgatgccgtgctgccgggcacaatctcaggagactccagcaccactgtttacaccacccttgtgtgtgtgtgtgtgtgtgtgtgtgtgtgtaagtggacctccaatggactatgtgctcctacagaacaggagctgtattttgaagttgttttgtttgtctacttgttttggttttgttgttagtgttctt

SEQ ID NO: 62212 - DNA, 201 bp, Homo sapiens
ccggattgaagtccgggccaggaacaatagtaattgtgggacttaacaaagactgagtacagctgaaggagctggggagcagaaagtatatgcgtcaggtrtgaggaagaaaatagattttggaagttatgagaaatgtagagagtgagttgagcatagtttgtgatttttagggcctctaaaagtattagggcggcagca

SEQ ID NO: 62213 - DNA, 201 bp, Homo sapiens
ggggtctttcctgatgccgtgctgccgggcacaatctcaggagactccagcaccactgtttacaccacccttgtgtgtgtgtgtgtgtgtgtgtgtgtgtgtaagtggacctccaatggactatgtgctcctacagaacaggagctgtattttgaagttgttttgtttgtctacttgttttggttttgttgttagtgttct

SEQ ID NO: 62214 - DNA, 201 bp, Homo sapiens
ggtgtggtatcaggaataatgtgggaggccggattgaagtccgggccaggaacaatagtaattgtgggacttaacaaagactgagtacagctgaaggagcyggggagcagaaagtatatgcgtcaggtatgaggaagaaaatagattttggaagttatgagaaatgtagagagtgagttgagcatagtttgtgatttttag

SEQ ID NO: 62215 - DNA, 201 bp, Homo sapiens
acaacacctagatacacaataccaggtatgttacaactgcatggaaaagccactttataggccaaatggcagcaattttcaatggctttttttttttttttataacttttgacctacaaaatgtcagtttcctgtgatgccaccctacctgctactagactggccatctgatccccactggagaagccacaatcataggga

SEQ ID NO: 62216 - DNA, 201 bp, Homo sapiens
tagaaaggaaatgagaggttctaagaggcgggctagtggcttgtactatagcatagcctgcctttgctggtgtgtggcgattaggcctggtggaactgccrtcaataaatcaagcgtgatcagggtgaggaacaggaaagaaggaaatatggggaaatggggtgaatgtcaggtggatcagagagatacagtcatgggggt

SEQ ID NO: 62217 - DNA, 201 bp, Homo sapiens
agagtacttttcagagagggacagtcaataaaaagccttcgtgtataactagtccattttcatgctgccgataaagacatacctgaaactgggtaatttayaaagaaaaagaggtttaatggactcacagttccacatggcaggggaagcctcacaatcatggtggaaggtgaatggcacgtcttacatggcggctgagaa

SEQ ID NO: 62218 - DNA, 201 bp, Homo sapiens
gaggtgtgtttttaaaagacctttagtccgttctacttttcctgaagacggaggaccataagggatataaaggtttcactgaatactaagagcctgaaaawctgcttggctgatttgactaataaaggctggtctgttatcagactgtatagaggtgggaaggctaaactgaggaattatgtctgacagaagggaagaaat

SEQ ID NO: 62219 - DNA, 201 bp, Homo sapiens
tgggctcaagtgaccctcccacctcagcctcccaagtagctggggctccaggtgcacaaccacatgttgctgatttttaaattttttgtagggatggggggtctcactgtgttccccaggttggtcttgaactcctggcctcaaacggtcctcccaacttgacctcccaaagcactgggattacaggcccgagaaccacac

SEQ ID NO: 62220 - DNA, 201 bp, Homo sapiens
ttcaggtaaagtagaattctatcaaaattgtcacaaaattgtctttgatgagagccatcatagtgcaaagttgatgactaaaaggagatggttaagttgtytaaagagcaaggccataggagagaagaaactaatattcaaagcttcctcccacagttcaaagttagagaaacctgagaggggtgtactggtatgaccacc

SEQ ID NO: 62221 - DNA, 201 bp, Homo sapiens
agaaacagagaaatatatatatatttctatatatatgtatatatattttttatatgtgtgtgtatatatatatgtgtgtgtgtgtatatatatatatatatggagattgttatgtgaattaactcatgcaattacagaagccaagaagtcccacaatatgccactgcaagctggagacccaggataggtgtcattcagtta

SEQ ID NO: 62222 - DNA, 201 bp, Homo sapiens
ccggccggcctcggagctctaccagcaggctttcatgggagcggaggtgcccacgtttccattgtgcggtaaccgcgcttcatcacagccacctccaatcraggccgcacggtgtccccagaaccacgctcggtacaacctgccccggccgctgcgctcgacttgggagcgcgccccgccccgagcgcacgacctcccttc

SEQ ID NO: 62223 - DNA, 201 bp, Homo sapiens
gggaggtcccccgatccgactcatggcaccaaatttcatgcatgtccgtgtgaagagaccatcaaacaggctttgtgtgagcaataaagcttttaatcacstgggtgcaggcgggctgagtccaaaaagagagtcagccaagggagacaggtggggccgttttatatgatttgggtaggtaaaggaaaaaggggggttgtt

SEQ ID NO: 62224 - DNA, 201 bp, Homo sapiens
aaaagaaggactggggtggtggatcatgcctgtaatcccaacactttgggaggccaaggcaggcagatcacttgaggccaggagttcgagaccagcctggmcaacatggtgaaaccccatctctattaaaaatgcaaaaattatccaggcaagtttccacacacctgaagtcccagagaatctcttgaacccaggagccgg

SEQ ID NO: 62225 - DNA, 201 bp, Homo sapiens
ctaaatgagattttagaaagtagcatagtttctgaaaggagcagccactggaaaccaaaaactttctcagggtactcaaacggtttgaagagaactgatayttgaaaacggaaatccttccatttgtgacaacatggacaaacctggagaacattatgctaagtgagataaaccagtcacagcaagacaaatactgcctga

SEQ ID NO: 62226 - DNA, 201 bp, Homo sapiens
ggagcacaaggaggtaaccagccactccactgaagctgtgtttaggtggtggatatgatctgccagcggcccctcagccaaaaccaccaatacaaatccaygtagacagtttcttaaacaaacttagtaaaatcaaatctagaatatctccccctttcaaacaatgcattttcccagtgccaaagtacagcactttcttag

SEQ ID NO: 62227 - DNA, 201 bp, Homo sapiens
catggacaaacctggagaacattatgctaagtgagataaaccagtcacagcaagacaaatactgcctgatcttttgtatatgtggaatctaaaatagttamtctcctagaagcagagagtagaatggtggttgtcagggctggggtatacaggaaatgaggagatgttggtcaaagggtacaaagcttcagccatgcaaga

SEQ ID NO: 62228 - DNA, 201 bp, Homo sapiens
agggcaatgttagtgagccacagtatgtgcgttgggaaccatgtagagaacaggaaactacagatgctttttaagacacttatgagaattgttctttctamagtttaaagtgcctggcacatatttggtgcctaatactggctaaataaggagatgctggctgtgcgcagtggctcacgcctgtaattccaggactttggg

SEQ ID NO: 62229 - DNA, 201 bp, Homo sapiens
cctggttaggtgtgaagccaggagggcttcttagccacagcctgaaatcgaagcccaggatcgagccacagtctgaaatttttggatcgcagctctgccarttaaaccaatggtaacaataataatgtactgtcatatatgtaagaactgccatatatggagcattttgagccaggcaatgtgccaagcacttgacagaaa

SEQ ID NO: 62230 - DNA, 201 bp, Homo sapiens
gaaatgactgcttgaacgtttcagccttaatgctgacatgtggtgacttgaagccaggtgaatgaaggttcctccagctagagaggtaagatgaacatgcmggaccaggaagaaagcaggtcatcatgttagacaggtgcaattatgtgcagagactataaaagaagagaaaaagacatttagtcatcagagagcagccat

SEQ ID NO: 62231 - DNA, 201 bp, Homo sapiens
ttcttttttccagatttctttggttgaggatatgtaacaaagaatatctttggtgagaacattgcaatcagaaaaaaatgtccgtgtaaccattttttaarattaattctattttcactaagaacactgattttcagacatagctataggtatcacagggttctatatggaatttctagaaatacagtggggagttcatgg

SEQ ID NO: 62232 - DNA, 201 bp, Homo sapiens
actttctcttgccccagaataagacaagaatgccgaggcctggtcagtatcccagggtaccaccgccagtgctggccagagcaggctctgagaggctaacrcaggccacagagcctagggccttgttttggagggtgaggtgaggcttaaagctggtaggataggcgccctctgagattcgccatctgagaagtcagtcag

SEQ ID NO: 62233 - DNA, 201 bp, Homo sapiens
agagttagaaacaataatttttaacccagtatatttttgtgaaaaaaaaatgggaataatgtgaaagtctaatagtatgcagttagtgaaatcaataatgrtacatacatacaatggaatactatgcagccattacaattataccacagaagaaaaggcaatggcctggaaaaatatattgttcataatatattgttacat

SEQ ID NO: 62234 - DNA, 201 bp, Homo sapiens
gtgacttccatgctagaaatcgcttctctgggtccagcttacacttaagtgaatggagatgtaaaatggagacgataccagtaccgattatgcagagttgyggtgaggactgaatgaactaatacatgtaaagcttttagaagggtgcctggcatgtggtgggtgctcaggcatcattagctgttatcattattctgtggg

SEQ ID NO: 62235 - DNA, 201 bp, Homo sapiens
catgggtcacagaagcaatggaaagttggaaaccattgccttctaattagcagatgtctcagtggctaacattatttgccagtagcagtgccagcgcagcrctgggaaagttaattactgtcgacagtcctcgagcctgttttcataactggtaatgactgttaatatgtcaccactgaagttagagactcagaaaagtct

SEQ ID NO: 62236 - DNA, 201 bp, Homo sapiens
tcactcaaatattcccttgaggcatcattttttttttttttttcaaaattgggaaagcgaaggatacaagaagttggaaggaaagcccatgaaagaaaaamacatttactataattaagaaagaaaattaaacagatgatgatcagaactgcggttataaattaaagttaactgattccaagagtgtacgccatcagaatt

SEQ ID NO: 62237 - DNA, 201 bp, Homo sapiens
agtccttacttctgtccagtaaaatccaagacatggcaaggacttgaacctcgcaggaataaaaacatggcccacttggttcagcgtgacagctctcaggrtggcgtgccgttacccacctgcaaattcctaacagcccaaagtggcaccagtcacttcctccttgcgtttctcaggcagcacattgagtggctgctagca

SEQ ID NO: 62238 - DNA, 201 bp, Homo sapiens
ctgaggtttctaaatattgttccagcataggaatttcagcttttattcttttccaacttttcatttatatggcatgcatgggtcacagaagcaatggaaakttggaaaccattgccttctaattagcagatgtctcagtggctaacattatttgccagtagcagtgccagcgcagcactgggaaagttaattactgtcgac

SEQ ID NO: 62239 - DNA, 201 bp, Homo sapiens
ccgacttgaaaaatcttctgattctatgaccaaactggaaggcctgggttgggctctctcagttctgcagatttaaatgagtcatttctgaactgttggcwtaaggcctatccttttcactcaaatattcccttgaggcatcattttttttttttttttcaaaattgggaaagcgaaggatacaagaagttggaaggaaag

SEQ ID NO: 62240 - DNA, 201 bp, Homo sapiens
aaacccccatgacacaagtttacctaggtaacaaacttatacatatactcctgaaccgaaaataaaagttaaaagaaaaaagaaagacccatctgtatagkgctctctctctctttctcttacttggtttattctcttccttatccattgcatgcattaaccctttagaacttccggtgttctggggaccctgaaagatca

SEQ ID NO: 62241 - DNA, 201 bp, Homo sapiens
gagcacccaataacagttagccattatcattattactactacttactaagtccttacttctgtccagtaaaatccaagacatggcaaggacttgaacctcrcaggaataaaaacatggcccacttggttcagcgtgacagctctcagggtggcgtgccgttacccacctgcaaattcctaacagcccaaagtggcaccagt

SEQ ID NO: 62242 - DNA, 201 bp, Homo sapiens
cctttttaagttggtagctgagcttggtgaggtgtgtttttaaaagacctttagtccgttctacttttcctgaagacggaggaccataagggatataaagrtttcactgaatactaagagcctgaaaatctgcttggctgatttgactaataaaggctggtctgttatcagactgtatagaggtgggaaggctaaactgag

SEQ ID NO: 62243 - DNA, 201 bp, Homo sapiens
tgaggttgtgggggtcagggcaagaataataaagggagaaaggacaagattcaatccaatccagttcttttctccacttaatccctggctaccactgactyggcactctgggagtaaagagcagtggagaaagctctagacctattggtgtatatttccaagaggaagatccttggaccagcatcaagttggctttttatc

SEQ ID NO: 62244 - DNA, 201 bp, Homo sapiens
accacggttaaaaatcactactattcacttcttaccatttgatctgttgacagtttcagccatcagtcactgccggctcccacttcatttagttaccatgyccctcactaacacaagatcgccgtctaggggccaatcgtagaactacaggctacacagaggagaagggagccaggccacctttcccatgcatcccactcc

SEQ ID NO: 62245 - DNA, 201 bp, Homo sapiens
cgcaggcccaaatgccttctgggcttgtctaatcctccagaggatatcaaaggcaatacagccagcatacccaatcattaggagtttggcttctgggaccrggcactcttgggtgtgagcaccagctctcttatttataagctgtaaccttggccatgttatttaacccttctgagcctgactttcctcacttgtacaaga

SEQ ID NO: 62246 - DNA, 201 bp, Homo sapiens
aggagctcaaatgggctgtaccttgtagcattctgaggacaggtctgacttctgagaaaggaaagtcgtaaaagtattgtccagtcctttttaagttggtrgctgagcttggtgaggtgtgtttttaaaagacctttagtccgttctacttttcctgaagacggaggaccataagggatataaaggtttcactgaatacta

SEQ ID NO: 62247 - DNA, 201 bp, Homo sapiens
ttaaatgtaagcacctgcagcagggtattggtgaactgtccaggggaagcacaaattagaaaaaatacaaaatacgcttccctgagcccatgaatttaccrtatcaggaatatgtaagatacattaattagttcatcagtaggctccaagacagacattgcagatggtggggaaggtgggggtgggggcaggtgggtgggc

SEQ ID NO: 62248 - DNA, 201 bp, Homo sapiens
gtaatgaaaattggcaggtcccacttgagaatattatactaagtgaaataagccagtgacaaaaagacaaatacttttttccacttctctgaggcactcawattcatagacatgggaagtagaatactgtttgccaggggctgggagaggaggtaacggaaagttgccgtttaatggatgcagagttccacctttgcaaga

SEQ ID NO: 62249 - DNA, 201 bp, Homo sapiens
ttctcttaaagaatacatatgcctgtgttcagattatctcctcttcctgacaaatgagggaaatccccagatgaaagctgataaaacattagacgggggtrattccggacctccacatccctatggaacacatcacagaagccaggattggagagccaactccacacacctccatatcccctcttagatgaatggcaattc

SEQ ID NO: 62250 - DNA, 201 bp, Homo sapiens
agagtggcagtttggggatagcaccaggagatatcagctgtgatggcttggagaaacagcgtaaaccggcagtgtaaataagagcagggcgtgtatgagtrgttgagaacggtgaataggagtatgactagacagaagataatagggatgataagtttttttggggcacagtctaagttggtctggtgtctggaatgagac

SEQ ID NO: 62251 - DNA, 201 bp, Homo sapiens
tgcttgtgcagaacccaaggacagctgcgcatttattgcacatttatattcactgcttcctgatgacattaaatgtaagcacctgcagcagggtattggtraactgtccaggggaagcacaaattagaaaaaatacaaaatacgcttccctgagcccatgaatttaccgtatcaggaatatgtaagatacattaattagtt

SEQ ID NO: 62252 - DNA, 201 bp, Homo sapiens
tattgcttcaccaagagtatactccaggtgatttttttgtgtgtccttaattttgtcattttgtggtcattaataacatcagttaacaataatattattawactgtccactacaatgtgcgtttgtgagcactggcaacaatttagcagaacagaatgagttagattcccaattgtggtagatcacgtgtagtagcgaaca

SEQ ID NO: 62253 - DNA, 201 bp, Homo sapiens
ttcttctcttaaagaatacatatgcctgtgttcagattatctcctcttcctgacaaatgagggaaatccccagatgaaagctgataaaacattagacgggsgtgattccggacctccacatccctatggaacacatcacagaagccaggattggagagccaactccacacacctccatatcccctcttagatgaatggcaa

SEQ ID NO: 62254 - DNA, 201 bp, Homo sapiens
taagagtggcagtttggggatagcaccaggagatatcagctgtgatggcttggagaaacagcgtaaaccggcagtgtaaataagagcagggcgtgtatgastagttgagaacggtgaataggagtatgactagacagaagataatagggatgataagtttttttggggcacagtctaagttggtctggtgtctggaatgag

SEQ ID NO: 62255 - DNA, 201 bp, Homo sapiens
caaaggtcctgtgcttttctgcctaaaatatgtacaatcctcagttggcactgtcaggaatggggaccgccctcatggagaagtggcacttccactcctarccagcctctgtgtgagctggactctaaggtcaggagaatgaggaggccgtgaaggtcttggccgtctctttttcccctcatctctactgagacatagatc

SEQ ID NO: 62256 - DNA, 201 bp, Homo sapiens
aaaggtttgccaattcccatctctatgaaccttggctttgtaccaagtagaatgtacctaaatacttttccttctataaaggatggttactttgacttagstttgccaacatggaacaaaacaaacaaaacaaaaattttacttgtctttcagacctatttcttctcttaaagaatacatatgcctgtgttcagattatct

SEQ ID NO: 62257 - DNA, 201 bp, Homo sapiens
taagtcagtttaatgggtagccactgtgcttttccagtcatctccaaacacacatacccacatgcactgaggagagtggaggagaataagccatctctggyaggctcttgacatttgggtgggcaggattcagtcatcaggcacatgctggtaggcaagaggagcagaaataaggagacacaccaagtggctgagggtgcg

SEQ ID NO: 62258 - DNA, 201 bp, Homo sapiens
tcccacctcagcctccaaagtgctgggattataggcgtgagccactgcgcctggccaacattattttttcaaccatcaacggcgacttagatggtcatttrtgttgttctcaactctattattagagactccactgcagtgatttcacttttctgtgcaattctgaatccatttgcaaatgttcccccagtatcgattctc

SEQ ID NO: 62259 - DNA, 201 bp, Homo sapiens
gcctgggggagctagcggggcgggacccgagcggggcggagagtggcaggaggaggcgaatctccgcgctccggcgaactttatcgggttgaagtttctgstgtcgcctcccctttgcgtgcggagctgggctttgcgtgcgccgcttctggaaagtcggctccagtcatatccctgggcgctgcctgcggccgctcctcc

SEQ ID NO: 62260 - DNA, 201 bp, Homo sapiens
cacaacactcctctgaaaatagggacagctaattttgtaatggattgccagcaaaagctgtgacaatgcctactctggaagtctctaaatttcttttcaayctgagaagggtgttccatgatatttactggagtaagaagtgatggaggaggtagaatagttctggaagtcaggtctctaaatagaacaaatcttgggatc

SEQ ID NO: 62261 - DNA, 201 bp, Homo sapiens
gtgtccccagaaccacgctcggtacaacctgccccggccgctgcgctcgacttgggagcgcgccccgccccgagcgcacgacctcccttccctctccgcgrcttgagcttgcttcccggaaagccagtgtagtggcagcggtttgcctcacagcgcccctggttggttgtttaaattttatcttaggttctcgcaaacaaa

SEQ ID NO: 62262 - DNA, 201 bp, Homo sapiens
ggcctgggggagctagcggggcgggacccgagcggggcggagagtggcaggaggaggcgaatctccgcgctccggcgaactttatcgggttgaagtttctsctgtcgcctcccctttgcgtgcggagctgggctttgcgtgcgccgcttctggaaagtcggctccagtcatatccctgggcgctgcctgcggccgctcctc

SEQ ID NO: 62263 - DNA, 201 bp, Homo sapiens
agaccctgaccagcagggaagagcagtagcaaggagataggagagaagggtggtataaagagtttaccttctttatttttctctgtccacagttcctttaygcggaaagctatttacagcagccacagtctctgtttggtttggcatgacactgactttctatggataagtcaggatctcatgtcctcatctaaaaatggt

SEQ ID NO: 62264 - DNA, 201 bp, Homo sapiens
tcaccctactttgaggctgaatactagcacttattccgtctaactatatgtctgtacctattaaccaacctctcttcatcccacacacccttcatagcctytagtagctaccattcttttctctacctccatgagatccatctttttagctcccacatatgagtaagaatatgcaatatttgtctttcggtgcctggctga

SEQ ID NO: 62265 - DNA, 201 bp, Homo sapiens
ccctatgtaaatcagacaccgcctcttcaaacctgcctaaaaatttggagaattccgccccagcaagtctttccctttcagaagccccgctctctcgctakagagaaagctgttctcctttctctttcttctgcctattaaacctgcgctcctaaaggcctcctttgtgtccctgtcctaaattttcttggcgccaggtaa

SEQ ID NO: 62266 - DNA, 201 bp, Homo sapiens
gaatgactgattacattgtaaagaaacacaaaggagtgtctgaagagaatctgacttcttgagagattgaaaccagcaatcaatttgctgacctgataaaraaatgtcttttcgtgatggctttttttatttttatttttatttatttattttttttgagatggagtctcactctgtcacctgggctgcagtgcaatggcg

SEQ ID NO: 62267 - DNA, 201 bp, Homo sapiens
ccaagctgtagttccttgggctcagctctttttctaggacatgactcaaaaatcagaggaactaggttggtaagtgctgtcagaaagataagcccttatcrgttatggcaaaccaaaatgactggctatggtaacactttttgcagagaatcttcaagcctggagttcttagggctttatggtgcaaacttcattgaatgc

SEQ ID NO: 62268 - DNA, 201 bp, Homo sapiens
tcctgaggcctcccccagaagcagacgcctgtacagcccacaggaaccatgagctgactaaccatcttttctttataaattacccagttctttatggcaaygtaagaatggaccaatagagcacatcactagggtagcacaaaggagagggcccagaagcagaggagagataaacagctcatttttttcatctttctcaat

SEQ ID NO: 62269 - DNA, 201 bp, Homo sapiens
tgtccctacccaaatctcatgttgaactgtgatcccgagtgctggagggagggtttggtgggaggtgattggatcacaggggtggtttttaatggtttagygccattcccccaatttcttaggaaatctgcttgtttgaaagtgtgtagcatctcctttgcccctctcctgctgctaatggcctgtttccccttcaccttg

SEQ ID NO: 62270 - DNA, 201 bp, Homo sapiens
tggtaacttggcaccagttgccagtggcttcatatgaacctatcagctgctgtgggatggcagagcagttaagagtccaagactagtccacgcaggcctgyagctcccacattctgatgcatcaaagccacagcaagttcctaaaacataggctctggatccagatgcttttggttcaaattttcacttcattatttctca

SEQ ID NO: 62271 - DNA, 201 bp, Homo sapiens
gggaacgctggctcacgcctgtaataccagcactttgggagcctgacgtgggtgaatcacgaggtatggagttcaagaccagcctggtcaagatgtgaaamcccgtctctactaaaactacaaaaatgagccaggtatggtggcgggcacccgtaatctcagctactcgggaggctgaggcagggaattgcttgaacccgg

SEQ ID NO: 62272 - DNA, 201 bp, Homo sapiens
gtcccatatcagtttaatacctattttccaatgtaatgccctgaaatcccagaagaggaaaaaagaatttttttctaacaattagaaacatgataaaaaawactatcaaaggtatattcattcagccatgcaaattgtaaaaccatagcaatcattctatttgtttggtcacagtttaaaaaaggaaatttgctataagaa

SEQ ID NO: 62273 - DNA, 201 bp, Homo sapiens
aaataaagtaatgagaccactttgttgtagcaaagaaattcagtttgtttctagaagcagatgtgtgtgcatgggtgagtgggcatgtgcatatttgcttwaaaacattttccaataactgctgacaacagcaacctgaagcctccaggcacccagtttctccccatcctgagatgatctttttgctcctggagcagcatt

SEQ ID NO: 62274 - DNA, 201 bp, Homo sapiens
actttcagcagaattgtacaatatgacattatattgctcaaaatgactcaattttctaatctttgagacttcttaaaaagaaatgaaccccaagtagagtraaggtggactgcaaaaaacagcttagtctgaatgaaaaaaattcatccttggctctgcatctaagaaactggctgtgtgtcctcagacaattcacttaat

SEQ ID NO: 62275 - DNA, 201 bp, Homo sapiens
atgtgtgcgtgcaggtcacaggggatatgatggcttagcttgggctcaggggcctaacaatacaggctgacaaggattctttctttgtattaagcactttytagatttcttggagtggttagcaccaagggtattggctaccaatcctcatttctattaatattatttcatgtagacaaatgtagacaattgatgttttct

SEQ ID NO: 62276 - DNA, 201 bp, Homo sapiens
ggaaaagagtgagggaaataagaagggggagcagagagatacagcaactaagaaaaagaaaaagaaaaaaatacccagccctggggctaaaagatagtcayggtggtcagtcactttgtctgggctctcaactggtgtacttacctctcctgctcaacgtttgagcatgtgcctctgctgcttaatatttgtggggtgaag

SEQ ID NO: 62277 - DNA, 201 bp, Homo sapiens
aacagtgaaagagggagcctactgtccacaactttggtcaatagggaaacactttacttccctaattctttgaccaaccatagaaaacctttaggcagatraaggatactagttttcctttttattttcattttctaaaaataaatatttaccaggttaccaagaaaatacataaagcaacaagtaaaacaccccaccacc

SEQ ID NO: 62278 - DNA, 201 bp, Homo sapiens
gctagttatgaaggggatggaagtgatctctatccaagggaagaacatttgaattgatgtttaaaggagttgtttagattcttatgaaggaatagaggaakagtagaggcaaagacagagaaggggatggatgagaataaagaacaagaaaagaagcagtaggagacaaatgagaaggttaaagctgataatttttacttt

SEQ ID NO: 62279 - DNA, 201 bp, Homo sapiens
ccaccctcggctgcgcacgcacagtcgcgcctgccaggccagcgaggcggacgcttgggccaccacccgcaggccgagcccgggcgcgtatcgccacctcsctgcgcaccggcggctctgtggtcttcctgggcgcgcttgcggtcgcgaagggggccctccctttataagggaagccggaggcgcttgggcgggggtggc

SEQ ID NO: 62280 - DNA, 201 bp, Homo sapiens
gtatcgccacctcgctgcgcaccggcggctctgtggtcttcctgggcgcgcttgcggtcgcgaagggggccctccctttataagggaagccggaggcgctygggcgggggtggcttcccccgcctggcgcgccctttcctacatgctgatgcataggattttcaagacagctaagagaacaaggacttcacgaggcggggg

SEQ ID NO: 62281 - DNA, 201 bp, Homo sapiens
ccagcctctgtgtgagctggactctaaggtcaggagaatgaggaggccgtgaaggtcttggccgtctctttttcccctcatctctactgagacatagatcragacagggacccataaatcaccttggagttaaatcaggggaaaaaagaaaagccctctcaggcaacagcatttcacagcagcaacaggaagttgtaggga

SEQ ID NO: 62282 - DNA, 201 bp, Homo sapiens
ggaattctaaaaaacaaaggtcctgtgcttttctgcctaaaatatgtacaatcctcagttggcactgtcaggaatggggaccgccctcatggagaagtggyacttccactcctagccagcctctgtgtgagctggactctaaggtcaggagaatgaggaggccgtgaaggtcttggccgtctctttttcccctcatctcta

SEQ ID NO: 62283 - DNA, 201 bp, Homo sapiens
ctattgtacccttcctgcctttttcatgcactgctctccacccaccctggcttcccggctttgcctccaacgtcagagtgatttctgggcttgcttttttkttttttttttgcctggaaacttcttctctgaagaactttcaaatggctgccttcttcatgtatctcctctcggagcatcattccctgaccttcctttcta

SEQ ID NO: 62284 - DNA, 201 bp, Homo sapiens
tacccttcctgcctttttcatgcactgctctccacccaccctggcttcccggctttgcctccaacgtcagagtgatttctgggcttgcttttttttttttyttttgcctggaaacttcttctctgaagaactttcaaatggctgccttcttcatgtatctcctctcggagcatcattccctgaccttcctttctagggctc

SEQ ID NO: 62285 - DNA, 201 bp, Homo sapiens
tgacaacctcttgtgaggtgtgtgcgctcttcctccaagttctttgttctaaggtcagagggctgatcacctcactgctgccctacatagtcccctcagcrccagaaaatgctcacttaccaccaaatttacttccaaactgtagtttatcagaatataattttattttctgaaagaagtgcttcaactttgtgtattggc

SEQ ID NO: 62286 - DNA, 201 bp, Homo sapiens
tatctcacggtctcttagaaacagacacgaattgtggtttgtaacccaatgtggaaatagttacggagaaagtgacaacctcttgtgaggtgtgtgcgctyttcctccaagttctttgttctaaggtcagagggctgatcacctcactgctgccctacatagtcccctcagcaccagaaaatgctcacttaccaccaaatt

SEQ ID NO: 62287 - DNA, 201 bp, Homo sapiens
tgatcgttccttataaaaaggccttcattcctcacaaaaatacaactttcagtcaagaatttggtcctttaaaaaagaaagaggaagaaaagaaagcatgwgctctatccctcttttgactaaatactaccactgactttcctgtttagaactaaaggctgtctcttgttccacaggtcaaatgcatactttttaaaatgc

SEQ ID NO: 62288 - DNA, 201 bp, Homo sapiens
acaggcaaagctaaaagaggttgtggtaaacatatagctgtgaacaatcgtcttattaacaaagtcctggtctagctgtaaagcctggttttccttccctrtctcagagagctctgtggaaggtagttggtagatctgaaagtccacaagcagattctccaggtgcaaggagaagtgtacagaggaaagcctttgtaaatc

SEQ ID NO: 62289 - DNA, 201 bp, Homo sapiens
tgatattctcgaacactcctttttttcagtccacaacaaaaagatgttccaagccatcctcgctttttttttccctaagactgcaattaactaacttccamgaaaatttgattgctttgagaaaagaatagcatcagaaatcacaattcaagcttctcacctgtgcatcagcagtgaagagaaatgctggtcctttcacta

SEQ ID NO: 62290 - DNA, 201 bp, Homo sapiens
cgcttcatcacagccacctccaatcgaggccgcacggtgtccccagaaccacgctcggtacaacctgccccggccgctgcgctcgacttgggagcgcgccycgccccgagcgcacgacctcccttccctctccgcgacttgagcttgcttcccggaaagccagtgtagtggcagcggtttgcctcacagcgcccctggttg

SEQ ID NO: 62291 - DNA, 201 bp, Homo sapiens
ctcttgagccccattcctttctaattattaaatggcacaatgccgaggaatccctcctgctcctgaaacagacttctccaggggcgtcatggctgactctyaggtccctcagtttattctctcctgcttgtgcagaacgaaacaaatacaaatcaatattttaaaacagacatatacttaatattttttaaaagccagaat

SEQ ID NO: 62292 - DNA, 201 bp, Homo sapiens
tctaccctcccacccccatcacttccccttccagcacccatcattgctccccctggttgaacctcgtccttgtgaggtccaagtgaaaatttcccctttgycctctgaaggtttactgaaaatcacagacaagaggtagattaataggagaaaaggcatgcaatttattgttaatgtgtacacgagagccttcagaatgaa

SEQ ID NO: 62293 - DNA, 201 bp, Homo sapiens
cctctcacctggatatattacaacactgtgcataggagagattcaccagatagctgatagagaactttacattcagtacttaaagctttcctattgtgagrgagaactccatccagcataggaaatagctccacagagtttttatctgagccacatactgcctcagagatcagaacccaagcaaaaactctgcttctttaa

SEQ ID NO: 62294 - DNA, 201 bp, Homo sapiens
gggaagttccctactcttgaaacctagcctggaatgggctttcacctctgtgctatttatactaaaactgaattggccttagggatgggatggaaagtaaktaggattccctattacctgatgattttgaacccaaactattcccttgtggacacaaatgggtatggtggagtcaaatgcattccgtgaattcttccccta

SEQ ID NO: 62295 - DNA, 201 bp, Homo sapiens
ccttttaaaagtttctgctttctgctccaaaagcaaagtggtacccataaggcaggcagcctgtacttccctaagctagctttggaatacaaaatcacatyccttataccagactccgctcttgttcattggactaagcaggtggcaagtgactaaacctgtattttggttacatttctactgagaggaatccagggacac

SEQ ID NO: 62296 - DNA, 201 bp, Homo sapiens
taatgttgagaactccatgaagttctgtaaccaagtaccccccattgtttctgagatagagaatgaattattttttattttctcttctctctttccccctrctcccctgttccccacttcctatttagctctttagaaatgcaatgatgataatattttaccttccctccaccagacatccctacagggcaagcttatctg

SEQ ID NO: 62297 - DNA, 201 bp, Homo sapiens
ctcaatagggcctggcagcccattgtaatgactggggctttcacactgagtgaaagatggtaagcatccaagggagaaacaggagagcaattaaaagagtkgcaaaaatctagacttggagagtaattaccaccgattataagaagtggtcaggttccagatgtcttcaaaggcagagccaacaggatttgccggtggatt

SEQ ID NO: 62298 - DNA, 201 bp, Homo sapiens
gttaaagtgctgttggctgtgagctcagtgctgatgaatcaacaatatatattaagtaaggcatctttaatcagaaacacacataaagtaaggttatctaytgatcagttggcaaaaatgtaactagaggctcactggaacctaaacctgcatttcccttaggagcagtggttcaatatttgctaattcattgtttgcagt

SEQ ID NO: 62299 - DNA, 201 bp, Homo sapiens
accaggtgtcaacaactgtagagttccatcaagagtcatcattttacagttacaagtcggaggggccttcacagatccgtcaggctcaacactgcctcctyagtgagcctgtgaaccacccaagacggctggtcatcagtgtcatcctcttccttttccggacaactatctttaaaagaaaaaaaaagagtgtctttgaat

SEQ ID NO: 62300 - DNA, 201 bp, Homo sapiens
taccctggtaaagtcacctgccttctttgagcttcagttttctcatctggcagttgttcaatgggtttagtcatttgcaatcatttttattaccttctaargtcccctttaggtactgtgatggagaggtagacagacagaaagatgatagatagatagatagatagatagatagatagatagatagatagatgatagata

SEQ ID NO: 62301 - DNA, 201 bp, Homo sapiens
cacatcccgaagtgtcctgcattcctctttctgccccttataggttctttacctgcaaactctctccctcttgtccaaaacattttacctgctctgtcacytttgcatgatcacaggtccttcgcgttccacaatcagttatttccgtaccaggtttgttttatcactttgaaccttaaaacacagggaacaaaattttac

SEQ ID NO: 62302 - DNA, 201 bp, Homo sapiens
cagctaaagcagaagaggcagtgttttaatctagacacaggtacctgcccttaatcactatgcttgacagcttcttaagctagaatgggtggtaggtgacyggggtctgaattaggaatttggaggtagtaatggaaaagagggatcaaattcttagaggtaggataggcaagacttcaccaacaggagcctacggaggtc

SEQ ID NO: 62303 - DNA, 201 bp, Homo sapiens
tcccggaagacagcagaaagaacaaccagtacacaggctgaggatgtaaacaaacccgccatgttgtggaaaccaggaggaggctcatgtgcccaaaatgsagtcagtaggagataaggtcagagaagtaagaaggtgtcaactcaatagggcctggcagcccattgtaatgactggggctttcacactgagtgaaagatg

SEQ ID NO: 62304 - DNA, 201 bp, Homo sapiens
cactacggtaaatagactaggtcatttgaggcagagattgctggcctgggccaccccaggtccacctaggctccccaaagactgaggaatacctattttgyatacaagtgagctgcatccactagttaagaagccaaatcaaagactgtctatgaggcaaaacatatactgcagccatttgggggaaagaacaaagcactg

SEQ ID NO: 62305 - DNA, 201 bp, Homo sapiens
accttttaccatatcttttggctattacttatagtgtaaattcaatgatcttattctacgttcttacccacttctcccattttaaaaattgtactgtttckattctgttagaaaatgcaatgtttaactaccattcttatacccatatctccaaccttgtgttagtcctagatctatatatgaaatatgtagaagcccacc

SEQ ID NO: 62306 - DNA, 201 bp, Homo sapiens
cttaatgttttcaaccttggctgcacccttagtgagatttctaaaatcgcagtgccacaccccatgccattgatatcagaatcttctgaactaggacccagcttcagtgttttttaaagctcccagttgactctaatgtgcagccaagcttgagaaccatggattcagaatattttcctaaattctcccataaacctctgc

SEQ ID NO: 62307 - DNA, 201 bp, Homo sapiens
gcacaaaaggcacaaccggatatacctgttatttcccaatgacctgagagcccgaagtttatgttaagccttgggttatggcacagcttgcacgcaaggcyctgcagctcctgcaggcaattgagaggtggtggtgtacaggacagaggaacaactctgaagtgacagcacataatttaattccccctaagctttccaagc

SEQ ID NO: 62308 - DNA, 201 bp, Homo sapiens
ctttttaaaatgccacttgaccccttgggttccccattctcagtagaaaaacaaaatggtcattaatttattttgacatgcaaactcagctgaacattttktggtgattcaaccccacagatgtaaagtgaaagagtgccagaaaagcaagtgagagccatgagattaccacaagtctgtgagcacatttttttcaaggct

SEQ ID NO: 62309 - DNA, 201 bp, Homo sapiens
tggtctattcagagattcaacttcttcctggtttagtcttgggaggatggatgtgtttgaggaatttatccatttcttctagattttctagtttatttgcrtagaggtgtttatagtattctctgatggtagtttgtatttctgtgggatcggtggtgatatctcctttatcattttttattgcatctatgcagttcttct

SEQ ID NO: 62310 - DNA, 201 bp, Homo sapiens
gaccactttgttgtagcaaagaaattcagtttgtttctagaagcagatgtgtgtgcatgggtgagtgggcatgtgcatatttgcttaaaaacattttccartaactgctgacaacagcaacctgaagcctccaggcacccagtttctccccatcctgagatgatctttttgctcctggagcagcattgacgtgttccatag

SEQ ID NO: 62311 - DNA, 201 bp, Homo sapiens
gttgtttcctactcttggttatctggagtcacactgagctcaaaacagatggccctgaaactgctctctgaagcagtgagcacacaccgtctaaacacacmaatatgcgcatgcacgtgcacacacacacacacacacacacacttgtatgtcaccactgaactagtaaccccaagcaagctgaccaagtgctcttctcct

SEQ ID NO: 62312 - DNA, 201 bp, Homo sapiens
agtatgtaaatgaatgagcatggccccatctggccctccacccacaggccatagtttgctgactcctgcaagagtaaaaccctttatgaactagagagttscaggcttgaacatgggtccagaaaatatgggaaggcaaacctcacacatttgtggttgtgtgcctcctaagtgctttgtgtcactgttggcttccaattc

SEQ ID NO: 62313 - DNA, 201 bp, Homo sapiens
tacctcgccagtgtggattgtctacactgcctgcctgctcctggaaaactgatcttcctaccaaccaaacagctggcttcagcttctcgccatgcaagtgyctgccacatgccacttctctacctaggaagttctccctcctttcacctgaacctgtccaaatgttactcttccttcaaaatagggctccaatctcaaaat

SEQ ID NO: 62314 - DNA, 201 bp, Homo sapiens
gcaaactgtttatgtggatgtccggatagtacattttttgcctgtgtgggccttccagtctgtcttagttactcaactctgtgatttttgagcaaccattrgacagtatgtaaatgaatgagcatggccccatctggccctccacccacaggccatagtttgctgactcctgcaagagtaaaaccctttatgaactagaga

SEQ ID NO: 62315 - DNA, 201 bp, Homo sapiens
ctacctcgccagtgtggattgtctacactgcctgcctgctcctggaaaactgatcttcctaccaaccaaacagctggcttcagcttctcgccatgcaagtktctgccacatgccacttctctacctaggaagttctccctcctttcacctgaacctgtccaaatgttactcttccttcaaaatagggctccaatctcaaaa

SEQ ID NO: 62316 - DNA, 201 bp, Homo sapiens
ggcattggtcaggctgaaagcaaagaaagacaatccattgcccccaggagaactggtcttactctaaatcagtggcctgcaaactgtttatgtggatgtcyggatagtacattttttgcctgtgtgggccttccagtctgtcttagttactcaactctgtgatttttgagcaaccattagacagtatgtaaatgaatgagc

SEQ ID NO: 62317 - DNA, 201 bp, Homo sapiens
aatcctgcattagggtgggccccagatccaatgagactgtccttaaagtcctccacagcctaactccaggctacctcgccagtgtggattgtctacactgmctgcctgctcctggaaaactgatcttcctaccaaccaaacagctggcttcagcttctcgccatgcaagtgtctgccacatgccacttctctacctaggaa

SEQ ID NO: 62318 - DNA, 201 bp, Homo sapiens
aaagggccccagatacttctcagactgctgctccagagagtgcaagccacaagccttggtggcttccatgtggtgttaagcctgcaagtacaaagaggatragagttgaggcttgggaacctccacctagatttcagaggatgtatggaaaggcctggatgtccaggcgggagtctcctgcaggggcagagccttcatgga

SEQ ID NO: 62319 - DNA, 201 bp, Homo sapiens
tggcattgtgctcctgctctagggatctgttgaactttgaccttgagagatgatttagggtatctggcagaagaaatttctaagcatcaaagtgctcaagrtgtggcctggctgcttccaaaagcctaactcatctgcataaacaaagaaatgacctgaaaagggaggcaaagcataaaagatagataggaaaatttgcag

SEQ ID NO: 62320 - DNA, 201 bp, Homo sapiens
aaaaaaagctgtcattctttctaaacactaaacttattgtcatcttaaggtcttgactgttggtgttccttctgcttatttacattcacatggcttcttcyttgtccttggtcaagtctcaactcaaatatgattccctccaaaaagcctttccttgttaccccaattatagcagtttataatcagccccaatcttaactc

SEQ ID NO: 62321 - DNA, 201 bp, Homo sapiens
gagaaacagagaaatatatatatatttctatatatatgtatatatattttttatatgtgtgtgtatatatatatgtgtgtgtgtgtatatatatatatatatggagattgttatgtgaattaactcatgcaattacagaagccaagaagtcccacaatatgccactgcaagctggagacccaggataggtgtcattcagtt

SEQ ID NO: 62322 - DNA, 201 bp, Homo sapiens
cgtggggcttggtgagaggtgatttgatcatgagggtgatttctaatggtttagcaccatccccacagtgctgccttatgatagagttctcaggcgatctrgttgtttgaaagcatgtagcacttccactgcccttctcctgctggccatgtgaaggtgtgcctgtttctcctttaccttctgccatgattgtaagtttcc

SEQ ID NO: 62323 - DNA, 201 bp, Homo sapiens
ctgcgaaggccagacaattcctggggcattctgtgaagctaggaagccagagttggaagggtcccactctgcctcagccctcacatgacctggtccaacaytgccttacagatgaggaaaactgaggcctagagaggtaaagagacttacctaaaaggcatggttggccactgttaaagttgggatttaaaacccaaattt

SEQ ID NO: 62324 - DNA, 201 bp, Homo sapiens
agactcagaaaagtcttttgtcctaggactattaaatgtcatggaagaataacccccaaatttgcctttgggtagataaagttcaatgggactggctgggygcggtggctcacgtctgtaatctcagcactttgggaggccaaggtgggtgggtcacgaggtcaggagttcaagaccagcatggtgaaaccccagctctac

SEQ ID NO: 62325 - DNA, 201 bp, Homo sapiens
ctcacttaatgtttcttcctaccactcccattctacagtgagcccatgattaagataacaacagcttaaatgagttagtgcatagtatggtttggctctgkgtccccacccaaatcccgtgttaaattgtaatcttgagtgttggacgtggggcttggtgagaggtgatttgatcatgagggtgatttctaatggtttagc

SEQ ID NO: 62326 - DNA, 201 bp, Homo sapiens
tgcttttgaggccacatgaggagatacacagctgcaggattccctatcagcaaagactgaatgatgtcaaacgttcagaaaaggagaaactaagtgggtgyagcacaatcaatcactttgcatttcaaggtgaacttgcagctcttatggggagggaattctctatgtcattttccacgtaaataaagtaatgagaccact

SEQ ID NO: 62327 - DNA, 201 bp, Homo sapiens
attggcagtgaagcaagtcaaatacttactaggaacactagccctttcttagaagcgactcttgttgaaaaaaacatcctgtgctttgtgaagtgatttgtccctgaagaactctatgagtaaaagagactctagctgtgactttggccaagtcaggtggtcttgctactgatgagggggctgaatcctgagcattctctt

SEQ ID NO: 62328 - DNA, 201 bp, Homo sapiens
cactcttggcttaggaaattttctcctctttttgccctgaaaattagccttggtggctgagttttgcttttcaggttctcattgctagtgcttattttgaygcttagtgaccatctcattcctactactggcccgcagtagggaatcagacctttagtagacacggagctcttcaaatacagagtgaacttggggcatctg

SEQ ID NO: 62329 - DNA, 201 bp, Homo sapiens
ccatccagcataggaaatagctccacagagtttttatctgagccacatactgcctcagagatcagaacccaagcaaaaactctgcttctttaattcatacsctcccttatttcctcaccttgggctcttcaaatgcccccagcttgactgtggagctggcttcctctccaaccatcattaatttcccagaggggcctgtgg

SEQ ID NO: 62330 - DNA, 201 bp, Homo sapiens
ttttgagctgtctggctggttgagacagatgatctgatggcaagaatgatttgcaaaaaattcaacactgaccaatcagagcagacagtctaaataaacaycgattcttacaaggctaccttccttaccagttaaatatcagtcctgcctcagagaaacataagatctaaagaggaaaatctacacaagattgtgtgtggg

SEQ ID NO: 62331 - DNA, 201 bp, Homo sapiens
aacccaacccaatttgacttgaataagtaaaggaatttattggctcttacaagtgtaaagtccagaggtttcagttgaggcatggtccaacagctcaacaktttcactgagcacctagtttccttttgtctaatctctgcccaatattgttcatagttccaagatgttcaccaagaggtccctgagctgtgtgctttctca

SEQ ID NO: 62332 - DNA, 201 bp, Homo sapiens
attccatacatgttcctgcaaatgatagaatttcattcttttttacggcttaatagtattccattgtgtgtgtgtgtgtgtgtgtgtgtgtgtgtgtgtgkatcacatttgctttatccattcatctgttgatggacacttagattgatactgtatcttggctattgtgaatagtgctgcaataaacatgggagtgcaggt

SEQ ID NO: 62333 - DNA, 201 bp, Homo sapiens
tcttttctctacctccatgagatccatctttttagctcccacatatgagtaagaatatgcaatatttgtctttcggtgcctggctgattttacttaacaaratgcccttcaattccatacatgttcctgcaaatgatagaatttcattcttttttacggcttaatagtattccattgtgtgtgtgtgtgtgtgtgtgtgtg

SEQ ID NO: 62334 - DNA, 201 bp, Homo sapiens
tcttctcttgcccacctttggtgctgcagagtggatcatcttgttttatactcaagtcatcattaaaatttatagaaaaagagagaatttaaaaaaaaaaacactaaaaaatcaccttgtacgcatatacctcagaaggtctttggcctaatggtaatctgtgacattaaggcaaataaccaaaaatatgtaatttttcta

SEQ ID NO: 62335 - DNA, 201 bp, Homo sapiens
gaaatacaaatcaaaaccacaatgagataacatctcacaccagtcagaatggctattattaaaaagacagaaaataagagttgctggtgaggctgcagagraaaggggaaagcttatatgctcttaatggaaacacaaactagttgagccactgtggaagacagtttggagatttctcaaggaactcaaaatagaacaacc

SEQ ID NO: 62336 - DNA, 201 bp, Homo sapiens
tcatgagggtgatttctaatggtttagcaccatccccacagtgctgccttatgatagagttctcaggcgatctggttgtttgaaagcatgtagcacttccrctgcccttctcctgctggccatgtgaaggtgtgcctgtttctcctttaccttctgccatgattgtaagtttcctgaggcctccccaaaagcagaagcctt

SEQ ID NO: 62337 - DNA, 201 bp, Homo sapiens
gactggtgactcactttgtccttccctcctgtaagccatgagaaggaatcagaatgattctgtcatcaagagcatcacaaatcctggatcttcacctgattaatgcttcacgtctagcacaagcactttcattttcaagggattccatactgtattgtctagcccctggctgggttgggatatagttatcttggtggcata

SEQ ID NO: 62338 - DNA, 201 bp, Homo sapiens
cattctagctggggagacagaaaacaaataagtgcatttataattggatgtctgcttgtgatatgtgtgtatcccaggcagagggtccacagaacaaacarcagcatctagtgtggctcggagatgtgctcactcaagttctatgccagatttgagaagcctgcttgactctaacatcccaaatctgcatttccagcactt

SEQ ID NO: 62339 - DNA, 201 bp, Homo sapiens
gtgagagtaatgacgtgagctaatccaatttgaagtataaacaaagaaatttcttcacgcaaagagactgacttattttgtttcagaactaaataccacgmagtagaggttaggtcagggaatctggcctaaatatatgggggggtcagggagatggaggttagtcattccattggaggacagaagaaaaaggaacaagaa

SEQ ID NO: 62340 - DNA, 201 bp, Homo sapiens
tggttactgtagccctgtagtatagtttgacgtgatgcttccagctttgttctttttgcatacaattgccttggctatgtaggctcttttttgattccatwtaaattttaaaatagtttttctttccagttctgtgaagaatatcattgatagtttgataggaatagcactgactctgtaaattgctttggacagtatggc

SEQ ID NO: 62341 - DNA, 201 bp, Homo sapiens
atgtgttaggttgatactgggtgggggcactgaggatttttaaaacgtgatcagggctgccttgttgaaggtaaacctagcggtggtaagtcaaatgaaawggagtcatgagagaacaggtggtactaatcactaccagtactgagtgctttgcagatgctacttcatatacataatctgatttaattctgatagcaagaa

SEQ ID NO: 62342 - DNA, 201 bp, Homo sapiens
taactctgattgaattatatgttaattccttgcggtggtcttagatttcagacgctattagcaaattatggaggaaaagcaagatcgtatgattcatgaaytatcacagcagcaacagtttctaatttccacccatcctctgtgtcatgtgatatgtttcagaaactcacttaaaattgagaaaataagccattcctaatt

SEQ ID NO: 62343 - DNA, 201 bp, Homo sapiens
gccatttgggggaaagaacaaagcactgaactagagggcaaagaccaacattttggttctagctctgccaagtgtaggacattggactaggcacttaactkcagtaagcctcagtctgcttgtgtacaaaacagagtaaaagatttcttgcatttcctactttacaaggtcaacatgaggatcaagaataccatgttcata

SEQ ID NO: 62344 - DNA, 201 bp, Homo sapiens
tctcctttgctgtcacatgtttgaagatggaattgtgctgcttctgagccatccttccaccaattaaaaatgccccagttccttatctctgccttctggamaatgtgctttttcagtatgtccatctgagtatgggcctgaaactgaacatagtatcccaaatatgacattctgtctagcccaggggggtgtggttacttc

SEQ ID NO: 62345 - DNA, 201 bp, Homo sapiens
ctcagtggaagaggcatgtggatcctggttaggtgtgaagccaggagggcttcttagccacagcctgaaatcgaagcccaggatcgagccacagtctgaawtttttggatcgcagctctgccagttaaaccaatggtaacaataataatgtactgtcatatatgtaagaactgccatatatggagcattttgagccaggca

SEQ ID NO: 62346 - DNA, 201 bp, Homo sapiens
gcacattgagtggctgctagcatcactccagagccagactgaatctgaatctggctctcctacttacaccggagtgacttccatgctagaaatcgcttctstgggtccagcttacacttaagtgaatggagatgtaaaatggagacgataccagtaccgattatgcagagttgtggtgaggactgaatgaactaatacatg

SEQ ID NO: 62347 - DNA, 201 bp, Homo sapiens
actgacaagccttggtaacggagcagatataggagataatgaggagagaggagttggagttggagttggtgaggagagatggagttggagttggatacagygacaacttcgaagtttctatccagaggctgggagtgtgatgggccattgacagaaatggcaaacggagagctggtttgcaatggatcaagatgagggttg

SEQ ID NO: 62348 - DNA, 201 bp, Homo sapiens
tctaatcctccagaggatatcaaaggcaatacagccagcatacccaatcattaggagtttggcttctgggaccgggcactcttgggtgtgagcaccagctstcttatttataagctgtaaccttggccatgttatttaacccttctgagcctgactttcctcacttgtacaagacaggtaatataccaaccacagagggtg

SEQ ID NO: 62349 - DNA, 201 bp, Homo sapiens
tttttcatggctacctactacagagtgtcctagtaaaatatatacttgatacattaatatacgctttaaaaagaacagcagttagacattaaccaatatcygttttggttatgttaaagtcacaaatgtttaaaatgcccatcgtttcacagtcaaccacatataagatatatcttgctttattaagtgtatttaacacct

SEQ ID NO: 62350 - DNA, 201 bp, Homo sapiens
cacgaaacgaaactgtaaggcagaccaggtgtgaggaggggaggtgataaaaggattatagggtggaggagcggaggctgaggaagaattgggacctagckgggcctggcgaggagcagcctggggaggtggggagaggtcagatgggtccgtagaaaaggaagattagaaagcctcagcgacgcttggggttgggactga

SEQ ID NO: 62351 - DNA, 201 bp, Homo sapiens
agaagataataagtcaacagtcacttttttcatggctacctactacagagtgtcctagtaaaatatatacttgatacattaatatacgctttaaaaagaayagcagttagacattaaccaatatccgttttggttatgttaaagtcacaaatgtttaaaatgcccatcgtttcacagtcaaccacatataagatatatctt

SEQ ID NO: 62352 - DNA, 201 bp, Homo sapiens
ctccatgtatacatgtctgcccactggtttctttgggttggaggataacctaaggaaacccaaagccattattgttattattattttaaatcagcagatayatgcattgcccttagagccagtagcccagaaagctctgcccttctgctgtcaggctggaactcagttttcttcatggtcttcctctctagtgtgacccct

SEQ ID NO: 62353 - DNA, 201 bp, Homo sapiens
aggaggaaggtagagaaaatgggttccagtgtgtgtgtatgtgggggtgggaggggtgtgttgatttaggggtgtacagaaaatggtggtgtgcttcatgmcttttttttttaaagaatgaaaccaggacatcaactgagcatataagaggggaaagtggtgcagtagggttaaggcataatgaaaagatttagaattatc

SEQ ID NO: 62354 - DNA, 201 bp, Homo sapiens
ccaaatctcaaacttgaattgtttgttgcaaataactttcaaaaagaacagctaagctagagggatagtttaaagtagagagaggtttaaaatatcttatmttgtattgactcgaaggaacaacttaagcttgtttaagcagaacaggaatgcactggcccatgtgcagagaaggataaccgtgatgcttcacaggataca

SEQ ID NO: 62355 - DNA, 201 bp, Homo sapiens
gagttttggtattgattttatgtgtcagtacctgagaaggagagaagtccttgagttgtttcgtaaatgtggctcaagtgagatgctgaacagtgccagcyatgtggactctgccacagtgaaggaggaaggtagagaaaatgggttccagtgtgtgtgtatgtgggggtgggaggggtgtgttgatttaggggtgtacag

SEQ ID NO: 62356 - DNA, 201 bp, Homo sapiens
atctcccaatctctcttcccaagtcattcttttttttttttttaattatactttaagttttagggtcattcttatcttcttctcatctcttacctgttttytcctgaccctaattcctcaaagaagcttaattcacttctagatcccctccttcccccatgaatataaagaaaataactatatctagttcttttagatgtt

SEQ ID NO: 62357 - DNA, 201 bp, Homo sapiens
catgctttcctgccatcgcagatagatcagatatatcctccaagctgtagttccttgggctcagctctttttctaggacatgactcaaaaatcagaggaastaggttggtaagtgctgtcagaaagataagcccttatcagttatggcaaaccaaaatgactggctatggtaacactttttgcagagaatcttcaagcctg

SEQ ID NO: 62358 - DNA, 201 bp, Homo sapiens
tagcaatgagcaagactctgtgggcgtaggaccctctgagccatgcgcgggatataatctccttgtgtgccgtttgttaagcccattggaaaagtgcagtmttagggtgggagtgacccgattttccaggtgctgtctgtcactgctttctttgactaggaaagggaattccctgaccccttgcgcttcccaggtgaggcg

SEQ ID NO: 62359 - DNA, 201 bp, Homo sapiens
attcaagctctgctacctataaataagctaatgtctttcctctgggctgttgtcccttagccttcaacatcttctagtctgaagcaaaaatcatgcttcaytttgttttgctatctttctaatacagtaagagcttcaggtcaaagaactgaagagaatgtgagagcttgaccctctgttatgtttttcgttatttgtaga

SEQ ID NO: 62360 - DNA, 201 bp, Homo sapiens
cttcagagtcacacacacacaaaaagataagcttttttctcaattgaaaactggaaagttgaaagaggaagtaaagagaaaaagaaagacatatactatawtccaggagtcccacatgttcagaaactcttcacctgtgaatctacattttactgagttcacatctgccttctgaagggtaaccactctttaccccccaaa

SEQ ID NO: 62361 - DNA, 201 bp, Homo sapiens
tttgccattggttcgaatttcctcctgtagctcggagtagtttgatcatctgaagccttcttctctcaactcgtcaaagtcattctctgtccagctttgtkccattgctggtgaggagctgcgttcctttggaggaggagaggcactctgagttttagagtttccagtttttctgctctgttttttccccatctttgtggt

SEQ ID NO: 62362 - DNA, 201 bp, Homo sapiens
agttctccctcctttcacctgaacctgtccaaatgttactcttccttcaaaatagggctccaatctcaaaatttctgctcccatggggtctttcctgatgycgtgctgccgggcacaatctcaggagactccagcaccactgtttacaccacccttgtgtgtgtgtgtgtgtgtgtgtgtgtgtgtaagtggacctccaat

SEQ ID NO: 62363 - DNA, 201 bp, Homo sapiens
tccatgccaggcatgccccatcacctaggaagaaactcaacccatcagcaggcatccaaaaaggcgtcagccaggtagggtcccaaagagccccacacctygggttatctgggaaaatcccaagttatttagaagacagtgtacctcttgcctctacccttggtggtaaacattgcttcagagtcacacacacacaaaaag

SEQ ID NO: 62364 - DNA, 201 bp, Homo sapiens
caaaagatccatctcctgtggctacctaagagcagtgactctctgggggtggaataatttatacatgtgtaaaaacatttatttttctacatatttacttsaagcatgtgttaaaatatctgcaaacaactccagaccccctccccatcttatttttatcctaaaggcagtgttacatggatatccaaatgtttagagagg

SEQ ID NO: 62365 - DNA, 201 bp, Homo sapiens
gtgtttgaggaatttatccatttcttctagattttctagtttatttgcgtagaggtgtttatagtattctctgatggtagtttgtatttctgtgggatcgstggtgatatctcctttatcattttttattgcatctatgcagttcttctctcttttcttctttattagtcttgctagcggtctatcaattttgttgatctt

SEQ ID NO: 62366 - DNA, 201 bp, Homo sapiens
atcaatgaggaaatatacaaaagagccctagcacagaacctgattcatcactgatgctcggtgagtgttcattatacacccccaacacctctactaaccaygttgactgtgactaaagtaaatgtagattggcaagtcacactctggaataaagcttcccaaccctgacgcctgacacaatcacctgggagctttaaaaag

SEQ ID NO: 62367 - DNA, 201 bp, Homo sapiens
tgagtattcctccgtggagttttagcaacttcccataggaaatccaggctaaggtctgattcatccagtcctgaataatgtgttaatcatgaattggatamaaatcatgaattggatactactcaagaggataagctgttttcaaacatcttagcagtaaatatttgcaaaccaacaagaaacacactaaatacaaatggc

SEQ ID NO: 62368 - DNA, 201 bp, Homo sapiens
tagttttagaaggaatggtaccagctcctctttgtaactctggtagaattcgactgtgaatccatctggtcctggactttttttggttggtaagctattgmttattgcctcaatttcagagcctgttattggtctattcagagattcaacttcttcctggtttagtcttgggaggatggatgtgtttgaggaatttatcca

SEQ ID NO: 62369 - DNA, 201 bp, Homo sapiens
gcttcctctccaaccatcattaatttcccagaggggcctgtggtacttgggaatagcttcggtgatgagaggcaacaaggtctagccaagcacagctctcyaggtcttgaaacatccttaaggcctaagcctagtatcatagacacgggcttgttctaaccccaaactcagacctctaacaatgacctcacttccacttgc

SEQ ID NO: 62370 - DNA, 201 bp, Homo sapiens
cctgtggtctgctttagaattcacccaaaagccaattgtttctgtggttattcaaattttgtttctcttctcactccctcctcttgtctatcctctgatcsccagcatttggacagaataagagagaggaagtaaaactcaaatcattttactttactttttcttggccatttggctaagagatgtgtggggtgaagaggt

SEQ ID NO: 62371 - DNA, 201 bp, Homo sapiens
tgttgaattttgtcaaaggtcttttctgcatctattgagataatcatgtggtttttgtctttggttctgtttatatgttgaattacatttattgatttgcrtatgttgaaccagccttgcatcccagggatgaagcccacttgatcatggtagataagctttttgatgtgctgctggattaggtttgccagtattttattg

SEQ ID NO: 62372 - DNA, 201 bp, Homo sapiens
cactgcgtgagcctgggcaagcctcacaaccttgctggccttgactttcttatttatgagctatagacaattacacccagcctgctgcctggagggctggkgagagtggtgaattgagtgttcaagttgaaagtaagaggtggtcttcagcggttgactccaagcattacttatgatcaaggtctaatttctaagagtcca

SEQ ID NO: 62373 - DNA, 201 bp, Homo sapiens
ccactggagaagccacaatcatagggaaggaatattccatttggggacagataaagtcaatgaaaagatagatgttctcagtacagcccaggccagcatgrgcaaaggtggatacttaatgtctagtcagcttgcatgccatgacaaaataccacagactggggacttaaacaacagaagctgattttttcatagttctgg

SEQ ID NO: 62374 - DNA, 201 bp, Homo sapiens
ggggttttctagatatacaatcatgtcatctgcaaacagggacaatttgacttcctcttttcctaattgaataccctttatttccttctcctgcctaattkccctggccagaacttccaacactatgttgaataggagtggtgagagagggcatccctgtcttgtgccccttttcaaagggaatgcttccagtttttgccc

SEQ ID NO: 62375 - DNA, 201 bp, Homo sapiens
acagtccccctaatgttgtatctttggagtcttctcacattttatttctataaacaattttcaatgaatgtctgcatgcctatatagatgttttatttttstttttaaagtagagaagctgatttttgctgttgtttttgttgctgtataaaagatcactgagtgattgccttagttatgcaacaatagagaaataagtgt

SEQ ID NO: 62376 - DNA, 201 bp, Homo sapiens
gcttaggattgacttggcgatgcgggctcttttttggttccatatgaactttaaagtagttttttccagttctgtgaagaaagtcattggtagcttgatgrggatggcattgaatctgtaaattactttgggcagtatggccattttcacgatattgattcttcctacccatgagcatggaatgttcttccatttgtttgt

SEQ ID NO: 62377 - DNA, 201 bp, Homo sapiens
agtaccatgctgttttggtgactgtagccttgtagtatagtttgaagtcaggtagcgtgatgcctccagctttgttcttttggcttaggattgacttggcratgcgggctcttttttggttccatatgaactttaaagtagttttttccagttctgtgaagaaagtcattggtagcttgatggggatggcattgaatctgt

SEQ ID NO: 62378 - DNA, 201 bp, Homo sapiens
atgacttataatctttggctatatacccagtaatgggtcaaatggctgggtcaaatggtatttctagttctagatccctgaggaatcgccacactgacttscacaatggttgaactagtttacagtcccaccaacagtgtaaaagtgttcctatttctccacatcctctccagcacctgttgtttcctgactttttaatga

SEQ ID NO: 62379 - DNA, 201 bp, Homo sapiens
tgcatgtgtctttaaagcagcatgacttataatctttggctatatacccagtaatgggtcaaatggctgggtcaaatggtatttctagttctagatccctkaggaatcgccacactgacttccacaatggttgaactagtttacagtcccaccaacagtgtaaaagtgttcctatttctccacatcctctccagcacctgt

SEQ ID NO: 62380 - DNA, 201 bp, Homo sapiens
ccgggtgaggtgggtggtgagaaaggaaacagcaagcagggctctggcagctgctgcagacggcttcacacagggacgcgggctgccatcttgctctaagygaaagtgaaagaaaagtcggcagcagagggaacagggaagaaacctaaaggctgcaggctgccaggtgtgcttggagagcccccttcttccgccgggcct

SEQ ID NO: 62381 - DNA, 201 bp, Homo sapiens
caccaccaagggacactgtagcctccacaatctactctcatcttggcaggaagaaaaggcttcaggctcctccgctgtccccagttagatccatgtgtaaycttattcctcattctttctccagcttcccctaaagtacgactgagcttggcaaacgaagctctgctgcccaccctcatctgcgacattgctggctattac

SEQ ID NO: 62382 - DNA, 201 bp, Homo sapiens
tgggcaacaagagcgaaactccatctcaaaaaaaaaaaagaaaagaaaagaaaagcaagtcacagaaagttttgcttttctaaagtggtaagatatggggsacagaagaagaaagggaacaaatccacctccatccacactggtcacctcagggcacccctaggccttggtcctttcttcctaaaaacccctgagtcaggc

SEQ ID NO: 62383 - DNA, 201 bp, Homo sapiens
ctcccagggtcaccaagaatgaggcgctctggcacccgacgctgaacttgccactgagcccccaggggactgtgcgaactgcaggtaagaaaatgaaaagyaaggccaggtgtggtggctcacgcctgtaattccagaattttgggataccgaggtcggtggatcacctgaggtcaggagtttgagatcagcctggtcaac

SEQ ID NO: 62384 - DNA, 201 bp, Homo sapiens
cttgcactgatgttcctggggcttcagagacggcaaggtaagagcctgggtgcccttggctctggccctggcccacctcacccactctaaccacccccccrcccagaccagggtggaagcccagatgccccaagctccagccacccacccatcacagcctcctgcttttgagtttgccctaaatgaaaatgaaaccagtcg

SEQ ID NO: 62385 - DNA, 201 bp, Homo sapiens
tccttcttgcactgatgttcctggggcttcagagacggcaaggtaagagcctgggtgcccttggctctggccctggcccacctcacccactctaaccaccyccccgcccagaccagggtggaagcccagatgccccaagctccagccacccacccatcacagcctcctgcttttgagtttgccctaaatgaaaatgaaacc

SEQ ID NO: 62386 - DNA, 201 bp, Homo sapiens
tgagccaagatcatgccactgcactccagcttgggcgacagagcaagacaccatcttaaaaaaaaaaaaaaaactggcttagaatgacagtaagaagccarccaatctttagttggctttactatctgttttctggaaaatgtaaccctgcccccttacggcctgcatccaggtgggcccctcacacacccccgccttggt

SEQ ID NO: 62387 - DNA, 201 bp, Homo sapiens
tcagagacggcaaggtaagagcctgggtgcccttggctctggccctggcccacctcacccactctaaccacccccccgcccagaccagggtggaagcccasatgccccaagctccagccacccacccatcacagcctcctgcttttgagtttgccctaaatgaaaatgaaaccagtcgtgttccctcgttttctcctagct

SEQ ID NO: 62388 - DNA, 201 bp, Homo sapiens
cttggttcatggccaacatgcaggtctctggagggggacctagcatctccttggtgatgaagactcccagggtcaccaagaatgaggcgctctggcacccracgctgaacttgccactgagcccccaggggactgtgcgaactgcaggtaagaaaatgaaaagcaaggccaggtgtggtggctcacgcctgtaattccaga

SEQ ID NO: 62389 - DNA, 201 bp, Homo sapiens
atctccccacacgactgcctagtatgccacagatcttcatacttttagatattttttaattgatatgataatagtctcaactataaagtccagggcatggkggtgcacacctgtagtccagctactcaggagactgaggcaggaggattgcttgagcccaggagtttgagtcctgtctgggcaacatagagagcgagaccc

SEQ ID NO: 62390 - DNA, 201 bp, Homo sapiens; identical to SEQ ID NO: 26836

SEQ ID NO: 62391 - DNA, 201 bp, Homo sapiens
cccacctattatctttgaggcctcaggtaaaagccttccacctgtgtccttggtcctcccgggctccctccaccaggacagcccaggtcccgattacagcyacacatactgcctcccgttggccctggtgttctcacgctaatttgccctctgtgtgtgccctgcttctccccagtggacctggtccagattccccaggcc

SEQ ID NO: 62392 - DNA, 201 bp, Homo sapiens
cacccgacgctgaacttgccactgagcccccaggggactgtgcgaactgcaggtaagaaaatgaaaagcaaggccaggtgtggtggctcacgcctgtaatyccagaattttgggataccgaggtcggtggatcacctgaggtcaggagtttgagatcagcctggtcaacacggtgaaaccccgtctctactaataccaaaa

SEQ ID NO: 62393 - DNA, 201 bp, Homo sapiens
gcctctgccttccttcactgtgcaccctgggctcatgcaccaaggcagagaacaggaagaagtgaggggacaagaagaaggcagaatgtccagatggaggwtaagaccaaagagccaggttggtggtgtgacggtaggaaaacaaagctggaggaaatggagaaggaacaagtgagggacaatgaggcatgggttggggct

SEQ ID NO: 62394 - DNA, 201 bp, Homo sapiens
ccttgttccaggctcctcaaccagggactcacacacacaatccttagctcctcctccctggggtggacactgcaggtgagggctcagctcatgattcctgygcacgatgatccccgcccacgttgctctcacctacagagcggagaacagccttgggagtcatctttgccagcagtctcttccttcttgcactgatgttcc

SEQ ID NO: 62395 - DNA, 201 bp, Homo sapiens
tcctgtgctgacacacagagctcccatctccatgaagaccgcacagcgcgtgtaagccagcccagctgacctaaagcgacatgagactactagaaagaaaygacacccttccccaagcccccacagctactccaacccaaacaacaaccaagccagtttaatggtaggaatttgtattttttgcctttgttcagaatacat

SEQ ID NO: 62396 - DNA, 201 bp, Homo sapiens
ggaacactcaagatagaaacaatagcatatatgaaagccaaatcataaaacagcctaaagagaatttggagaattgcaagtaattcagcacagctagagcytagggtatatgggaaaaagggaaagtggctctgaagcttcggaggtaattctatttattgagcatttacatgaatcaagcagtgtagaaagcacttaaat

SEQ ID NO: 62397 - DNA, 201 bp, Homo sapiens
ctcaaccagggactcacacacacaatccttagctcctcctccctggggtggacactgcaggtgagggctcagctcatgattcctgcgcacgatgatccccrcccacgttgctctcacctacagagcggagaacagccttgggagtcatctttgccagcagtctcttccttcttgcactgatgttcctggggcttcagagac

SEQ ID NO: 62398 - DNA, 201 bp, Homo sapiens
gacagagaccactgttaagacagcagcttggttcatggccaacatgcaggtctctggagggggacctagcatctccttggtgatgaagactcccagggtcrccaagaatgaggcgctctggcacccgacgctgaacttgccactgagcccccaggggactgtgcgaactgcaggtaagaaaatgaaaagcaaggccaggtg

SEQ ID NO: 62399 - DNA, 201 bp, Homo sapiens
ccagcttcccctaaagtacgactgagcttggcaaacgaagctctgctgcccaccctcatctgcgacattgctggctattaccctctggatgtggtggtgaygtggacccgagaggagctgggtggatccccagcccaagtctctggtgcctccttctccagcctcaggcaaagcgtggcaggcacctacagcatctcctcc

SEQ ID NO: 62400 - DNA, 201 bp, Homo sapiens
cctcgggtgactgctgggaggttcaggatacctgcaaatgcctcactccctcagctgcaaggagagacttctcctttttattcgtttctaaaatgtgcctratcaatacggtggaactcagcataccaaaactgtacgtgaggatgatggggaaaagggggtaagggggtgttcactgacagccttatctgggcacatccc

SEQ ID NO: 62401 - DNA, 201 bp, Homo sapiens
ccccacagctactccaacccaaacaacaaccaagccagtttaatggtaggaatttgtattttttgcctttgttcagaatacatgacattggtaaatatgcmacatgcctttggtggaagtacaactgttgttattactctatacaagtatgagatcagggttaggaaaaaaagacaaagaggtgatgacagacacacagtg

SEQ ID NO: 62402 - DNA, 201 bp, Homo sapiens
cacctcagggcacccctaggccttggtcctttcttcctaaaaacccctgagtcaggccaggtgcgaaggcccatgcctgtaatcccagcactttgggaggscaaggcaggtggatcacctgaggtcaggagttcaagaccagcctggccaacatggtgaaaccccctctctactaaaatacagaaattagccgggcatgat

SEQ ID NO: 62403 - DNA, 201 bp, Homo sapiens
ctcccaagtagctgggattacaggcatgcgccacgacacccagctaatttttgtatttttagtagagacggggtttctccatgttggtcaggctggtctcraactcccaacctcaggtgatccacccgcctgggcttcccaataccacgtgtgtttttttgttttgttttgttttttacattttttttgagacggagtttc

SEQ ID NO: 62404 - DNA, 201 bp, Homo sapiens
gttaagacagcagcttggttcatggccaacatgcaggtctctggagggggacctagcatctccttggtgatgaagactcccagggtcaccaagaatgaggygctctggcacccgacgctgaacttgccactgagcccccaggggactgtgcgaactgcaggtaagaaaatgaaaagcaaggccaggtgtggtggctcacgc

SEQ ID NO: 62405 - DNA, 201 bp, Homo sapiens
tcttaccagcacctacaggacttgggctgcttcaggctgaacgctgggagaccacttcctgtgctgacacacagagctcccatctccatgaagaccgcacrgcgcgtgtaagccagcccagctgacctaaagcgacatgagactactagaaagaaacgacacccttccccaagcccccacagctactccaacccaaacaac

SEQ ID NO: 62406 - DNA, 201 bp, Homo sapiens; identical to SEQ ID NO: 26831

SEQ ID NO: 62407 - DNA, 201 bp, Homo sapiens; identical to SEQ ID NO: 26833

SEQ ID NO: 62408 - DNA, 201 bp, Homo sapiens
ctggacgatggctccctggaggacttcaccgatttccaagggggcacactggcccaagatgacccacctattatctttgaggcctcaggtaaaagccttcyacctgtgtccttggtcctcccgggctccctccaccaggacagcccaggtcccgattacagccacacatactgcctcccgttggccctggtgttctcacgc

SEQ ID NO: 62409 - DNA, 201 bp, Homo sapiens
caacagttggaaatgcaagcataaactcctctgagcaaggcaaatccaggactttaactctcaccaagaagtatttgcctggactagcaggtgctctccaraaagctggtttggggatgacgggagaatagagggacacagaaacagctaggatcttggatggcaacttttaccctttgatgactccacagcttgagggcg

SEQ ID NO: 62410 - DNA, 201 bp, Homo sapiens
tttctccacactggtcccaactgagccctgtcaccaagcctagcggctccaacttgcaaagtgtttaagtatgaaacaaaggccctcagaggcacccccgkggctccatctcagttgcacctcagctgcaattagggttctgctccctcgggtgactgctgggaggttcaggatacctgcaaatgcctcactccctcagct

SEQ ID NO: 62411 - DNA, 201 bp, Homo sapiens
tgtatatgtgtacgtgtgtattttcctctgaactgagagtaagttgcagaagataacacttgaaccccaaacgcatgtttgaaccccgaaacgcatgtttraaccccaaatacatccatagcatgtattagtttacaatgaaggacaaggatgtaatccttcatagttacaaagccatcatgtcagaaacaaaccaaagtg

SEQ ID NO: 62412 - DNA, 201 bp, Homo sapiens
cagaacactctaacctctctgtggtccaacctaaatctatcctgacccattagaaaaaggtcttcatgtctgtccagtgtctaccatactcctggcatgcrtaggtatttctctctttttattccaaacctacaaaaaaaggtgaaataataatataatgaacacctatataccctacacctagatccaccagttgttaac

SEQ ID NO: 62413 - DNA, 201 bp, Homo sapiens
ctcatctcactgggctgccatgaggaaataagacacatgatgctattctgtacatgggtgctgtccactgtagtcttatcgagccaaaacccggttttctsccagtgaaatgctaggctgctctggtgcttcaggggtaaagctcagggatgcatcatttgttcatgatcttattagtaaacccagtacttgccctctcca

SEQ ID NO: 62414 - DNA, 201 bp, Homo sapiens
cactccagcctgggcagctgagtgagacaccgtctcaaaaacaacaacaacaacaaaaaccctgagtccacaagagaatgcttcgcagcccctacctgaasgtccccaggcacacagacaacctgtgttatttccaaaatggagatcgttctcatctcactgggctgccatgaggaaataagacacatgatgctattctgt

SEQ ID NO: 62415 - DNA, 201 bp, Homo sapiens; identical to SEQ ID NO: 32951

SEQ ID NO: 62416 - DNA, 201 bp, Homo sapiens; identical to SEQ ID NO: 33130

SEQ ID NO: 62417 - DNA, 201 bp, Homo sapiens; identical to SEQ ID NO: 33293

SEQ ID NO: 62418 - DNA, 201 bp, Homo sapiens; identical to SEQ ID NO: 32960

SEQ ID NO: 62419 - DNA, 201 bp, Homo sapiens; identical to SEQ ID NO: 32884

SEQ ID NO: 62420 - DNA, 201 bp, Homo sapiens; identical to SEQ ID NO: 33050

SEQ ID NO: 62421 - DNA, 201 bp, Homo sapiens; identical to SEQ ID NO: 33262

SEQ ID NO: 62422 - DNA, 201 bp, Homo sapiens; identical to SEQ ID NO: 33298

SEQ ID NO: 62423 - DNA, 201 bp, Homo sapiens; identical to SEQ ID NO: 33041

SEQ ID NO: 62424 - DNA, 201 bp, Homo sapiens; identical to SEQ ID NO: 33104

SEQ ID NO: 62425 - DNA, 201 bp, Homo sapiens; identical to SEQ ID NO: 33359

SEQ ID NO: 62426 - DNA, 201 bp, Homo sapiens; identical to SEQ ID NO: 33150

SEQ ID NO: 62427 - DNA, 201 bp, Homo sapiens
gagctttcacatccaacatcacctttgatattggtgaattacaaaacaaaattattgatttaaataggcaaactcaagaatttcagccttctttagaagaytggaccgaattccaggaaggcctggagagcctcaacccttggacctatctaaggcaccacattaacatcttatatgtagttcttggaataatgttgtttt

SEQ ID NO: 62428 - DNA, 201 bp, Homo sapiens
ttaacatcttatatgtagttcttggaataatgttgttttgtctctgtcttcggtttatagtctgtaaaatcggatggaccaccaattggagaatgagagcytcccagcccagccttacattctttcaattaatacataaacagaaagggggatatgcagggagccaaaggcctgtgggacgtgaccaactcagcattctgc

SEQ ID NO: 62429 - DNA, 201 bp, Homo sapiens
taacatcttatatgtagttcttggaataatgttgttttgtctctgtcttcggtttatagtctgtaaaatcggatggaccaccaattggagaatgagagcckcccagcccagccttacattctttcaattaatacataaacagaaagggggatatgcagggagccaaaggcctgtgggacgtgaccaactcagcattctgct

SEQ ID NO: 62430 - DNA, 201 bp, Homo sapiens
aatgttgggttgcatccctgggctatggattcttgttaatctgtctgagccttgggctgccacacctgctttgcatttttgtaacacttcttctaactcascttactcactgtgtccatagagccttaggcataatttttgctattgtttccttggtcaaactaataacttctgttgtgatatcttctgtaactctgcata

SEQ ID NO: 62431 - DNA, 201 bp, Homo sapiens
gccaaaacctcctacttatatctcatcggccttgccactgaagaatgatggtgccctggaacagacaccctggcaactacctttgcctcatccaagccaarggtaaccctgatggtggcaggtaggccagtatatttttaaattaataccaggcaacctactctgctttacctaatttttcaggaaccacccagtcctccc

SEQ ID NO: 62432 - DNA, 201 bp, Homo sapiens; identical to SEQ ID NO: 25921

SEQ ID NO: 62433 - DNA, 201 bp, Homo sapiens
cggggcctgaaagcttaaggagatgaataactcctcccttctcaggcccagtcccaaggcgcaagggccacttgtgtcagcagtgtgcaccagcagcgtgygccggcaagatagcagaagcatgaaaagggccggccagaagacacctactctggctggaagacacgtacccctgaagatcaagaaagaagctatctggga

SEQ ID NO: 62434 - DNA, 201 bp, Homo sapiens
accatcttctttaaccccccaagcctcctcattgtcttctcagctgccatcttcccagtcagctgtatccacttatttttctacaccgtcccctcctcagracaattctaatattacctatacctattctcctccccaacgccctctcctgaggcttgtaaacctatcctgccaccttacgcctctgtctatcctccactg

SEQ ID NO: 62435 - DNA, 201 bp, Homo sapiens
aggcagagtttcaaatgcttgcctccaccatcaggggccctgcaggcccacggggccgcagctccacacagaagcctcctaaaaatccacctccacctggygcctatttcaagtgtggcaatgaaggccactggtccagacaatgcccaaacccaggtaaagccagcagtccatgcccctctctgcggagaaccccactgg

SEQ ID NO: 62436 - DNA, 201 bp, Homo sapiens
gcacagcctattacccaacctttccatctactccagaaggctctcacctcagcctcatcctcactctcccagacctcaccaaacctttctccctctatatmgacagatgatgtaaagttgcattatgtattctaacccagtctaagggacctaccgcccaggttgttgcctacctctctaaacagcttaaagccaccattc

SEQ ID NO: 62437 - DNA, 201 bp, Homo sapiens
gccaaaccattataccaggctgctaaaggccctctctatgtgccattaaactctgcacagcctattacccaacctttccatctactccagaaggctctcayctcagcctcatcctcactctcccagacctcaccaaacctttctccctctatatcgacagatgatgtaaagttgcattatgtattctaacccagtctaagg

SEQ ID NO: 62438 - DNA, 201 bp, Homo sapiens
gtccggctcagctgctgagaccacatatctggaccctcagtgccctggcaacagctctgtgcaggcaggatgaagcacaggcttaggtcaagcaatcagcygtcaaaatccacactctcacctgtgagtggctgttcaaccttgaacatgttactttttatgttaatgaaactcagttttctagtcctataaatttggggc

SEQ ID NO: 62439 - DNA, 201 bp, Homo sapiens
caggcaggatgaagcacaggcttaggtcaagcaatcagccgtcaaaatccacactctcacctgtgagtggctgttcaaccttgaacatgttactttttatrttaatgaaactcagttttctagtcctataaatttggggctatcatcaaccattaagtgatattaaacccagtgccacacaggcaagtacctagcagtgtc

SEQ ID NO: 62440 - DNA, 201 bp, Homo sapiens
tctttcttttacagaagatgaacactgaagtcttggaaccctgggaatgaacctggaaaaattcaaaatatggtctagtcttaggcaagtttccttgtccrgctcagctgctgagaccacatatctggaccctcagtgccctggcaacagctctgtgcaggcaggatgaagcacaggcttaggtcaagcaatcagccgtca

SEQ ID NO: 62441 - DNA, 201 bp, Homo sapiens
aattgtgtcactgcactccagcctgggtgacagagcaagactccgtccaaaaaaaaaaaaaaaaaaaaagggaccatgttctagtgtaggggtaagtggaytgttttggccccaaccccaagaggatcaagggagaccactgcagctgcccgagaaattcttgccctctgacaagaaacaccctatccagtctggggaatt

SEQ ID NO: 62442 - DNA, 201 bp, Homo sapiens
ctggggaatttgccagtccaacccctccccttggctcaagattctgggaaatcctaaatagtgtttaccattggccttttatcagctccagtataaatgcrtctggccagacttgctttacaactatgcataatggatagttgggccaggcttggtggctcatgcctagtgctttgggaggccgaggtgggaggatcactt

SEQ ID NO: 62443 - DNA, 201 bp, Homo sapiens
aaattacccgggcctggtggcgcatgcctgtaatcccagctgctcaggaggctgaggcaggagaatcgcttgaacccaggaggtggaggttgcggtgagcygagatcacgccattgcactccagcctggacaacaaaagcaaaactccgtcttaaaaaataaataaataaataacattaaactacgtcactcagcctgtga

SEQ ID NO: 62444 - DNA, 201 bp, Homo sapiens
ggggtaagtggattgttttggccccaaccccaagaggatcaagggagaccactgcagctgcccgagaaattcttgccctctgacaagaaacaccctatccrgtctggggaatttgccagtccaacccctccccttggctcaagattctgggaaatcctaaatagtgtttaccattggccttttatcagctccagtataaat

SEQ ID NO: 62445 - DNA, 201 bp, Homo sapiens
catgagcttgcctactttccttggtatttcatttttggagccagaaacaaaatcctcccagatgctctgcttggcccctgtgagtctgacctgcaggcctrtgtctggcagagggcacgcaacagtggctcacctcccactcgcactgcgcaggggctgacacagggagaacgggagtcatagctctgtgtctgcgcttac

SEQ ID NO: 62446 - DNA, 201 bp, Homo sapiens
gtctcgaactcctggcctcaagtgaccctcctaccttggtctaccaaaatgcttcatttacaggcatgagctaccatgcctggcctacttcttgcggggargtgggaggtacagaagagttctgttccctgttatataaaggcccaccctccaggaactgtgatttgtagctcagttggtaggaggggtcttgcaacctgg

SEQ ID NO: 62447 - DNA, 201 bp, Homo sapiens
agctgagattgaggattctgacatgcatgagcttgcctactttccttggtatttcatttttggagccagaaacaaaatcctcccagatgctctgcttggcycctgtgagtctgacctgcaggcctgtgtctggcagagggcacgcaacagtggctcacctcccactcgcactgcgcaggggctgacacagggagaacggga

SEQ ID NO: 62448 - DNA, 201 bp, Homo sapiens
cgaactcctggcctcaagtgaccctcctaccttggtctaccaaaatgcttcatttacaggcatgagctaccatgcctggcctacttcttgcggggaggtgsgaggtacagaagagttctgttccctgttatataaaggcccaccctccaggaactgtgatttgtagctcagttggtaggaggggtcttgcaacctggcccg

SEQ ID NO: 62449 - DNA, 201 bp, Homo sapiens
tctgttccctgttatataaaggcccaccctccaggaactgtgatttgtagctcagttggtaggaggggtcttgcaacctggcccgaggcagtgactaaggyacaggctatatgtggggccctggggtttgtcatctctgctgctaacaaaggtggaaaattcctacttcctgagctgagattgaggattctgacatgcatg

SEQ ID NO: 62450 - DNA, 201 bp, Homo sapiens
agaaacaaaatcctcccagatgctctgcttggcccctgtgagtctgacctgcaggcctgtgtctggcagagggcacgcaacagtggctcacctcccactcrcactgcgcaggggctgacacagggagaacgggagtcatagctctgtgtctgcgcttactgcagtgcccttaacctctctgagtctcagtttccttatctg

SEQ ID NO: 62451 - DNA, 201 bp, Homo sapiens; identical to SEQ ID NO: 30196

SEQ ID NO: 62452 - DNA, 201 bp, Homo sapiens
gacagtaccgctgccaggctggaaatgacttgtgcatataccgctccttcttgaaactcccttctgtcttaccatccttgtgaccacactctgttccctgwaaacctttctgactcctcctccccgcttctgtcctggctcttcctccgcctgtcccttaaaaagcatgttcccagaattcccaactctctttatattcca

SEQ ID NO: 62453 - DNA, 201 bp, Homo sapiens
ataccgctccttcttgaaactcccttctgtcttaccatccttgtgaccacactctgttccctgtaaacctttctgactcctcctccccgcttctgtcctgkctcttcctccgcctgtcccttaaaaagcatgttcccagaattcccaactctctttatattccattatagtctaagtaactctcaggccatgatttacctt

SEQ ID NO: 62454 - DNA, 201 bp, Homo sapiens
tcttgaaactcccttctgtcttaccatccttgtgaccacactctgttccctgtaaacctttctgactcctcctccccgcttctgtcctggctcttcctcckcctgtcccttaaaaagcatgttcccagaattcccaactctctttatattccattatagtctaagtaactctcaggccatgatttaccttctctgcctagg

SEQ ID NO: 62455 - DNA, 201 bp, Homo sapiens
actcctcctccccgcttctgtcctggctcttcctccgcctgtcccttaaaaagcatgttcccagaattcccaactctctttatattccattatagtctaartaactctcaggccatgatttaccttctctgcctaggatttacagaggggtctgctgtgtacctgacactatactaaggtctgggattacagagataaaag

SEQ ID NO: 62456 - DNA, 201 bp, Homo sapiens
tgagtgccctggccaggcattcctgctccatcctctctgactttgcacgtgcaatttgtgcttatccttcttctcagtacttcctgtgcaccagatcctcrctagtctgctggccaggaatgcagaaatgtgcgtaatccattccttgatgtcaagtcgttcacaggtggtagaggagacagaccagaaatgatgagatag

SEQ ID NO: 62457 - DNA, 201 bp, Homo sapiens
atcccagtactttgggaggctgaggcaggaggactgcttgagcccaagagttcgagaccagcctgggcaacatagtgagatccccatctctacaaaaaatrtaaaatataaaaattagccaggtgtggtggggcatgcctgtagtcccagctacttggcaggctgaggtgggaggatcacttgagcccaggaggtcaaggc

SEQ ID NO: 62458 - DNA, 201 bp, Homo sapiens
aaaggtaagaactggatctaatgaagagggatatggaattacttaccagactgcattcagatgcaggtccagcactggggccctctacagcctggctacaycctatgcccagtgcagacccccacggctccctgcacatctgctgtccccacaaccaagctctcctcctcattgccactgtccacccgactctgcctgtct

SEQ ID NO: 62459 - DNA, 201 bp, Homo sapiens
ggggccttttacaccctgcattaggctggacattgttcataaggaccattcataaatttaagctggggaatgacttaacatgattcgcatctcggagagawtaatctgcagcaatgtgaagaatagatggaggaaggacactgaacaaggacctcaaacacagcatgtcaaaggccgggtcattcccatggataaatatat

SEQ ID NO: 62460 - DNA, 201 bp, Homo sapiens
tatgagtgcatagctctgtgttacgcttcctaagggagaagctgaatggatgataaacacacaaggctcatggaggatcgcaaagctacacagtcattgcygtttgtccagaatcttaagtgtgtttattgaacacctaccatttgctaggcactggggatgcacacgtgaaaagacagttgtgggccctgtgacatgacc

SEQ ID NO: 62461 - DNA, 201 bp, Homo sapiens
acacccagtcaggcactatcctctctaaactcactctctccaacctctccattcctctctggtccccttccctacctcagtccaaaccctgtctgtctctygcctggtctatgcagttgccgcccacccaccccagcaactcatcatcctgcctttggtccttccttaatctagtccgtgctgcgtaccgccattggagag

SEQ ID NO: 62462 - DNA, 201 bp, Homo sapiens
gtgctttcagcagatgtgtgtaaatgaggaaatgtgactctgttttaggtcttaagaacagaaaaagagaagcaggatgtttatcaccatgagcacatagragacctcctagacaagcaaagccgggaactgcaggacatgggtgagcccacaagtagaggcctcgttggttagggttggaagagctaggttatggggaaa

SEQ ID NO: 62463 - DNA, 201 bp, Homo sapiens
ctcatggaggatcgcaaagctacacagtcattgctgtttgtccagaatcttaagtgtgtttattgaacacctaccatttgctaggcactggggatgcacaygtgaaaagacagttgtgggccctgtgacatgaccaggaagcttacagtcaagtgagggatagaaacaagtaaagccatcagagcagcaatacaacactgc

SEQ ID NO: 62464 - DNA, 201 bp, Homo sapiens
gaaaccatgtctcaaaaaaaaaagagaaaaaaaggaagaataagaagatactaggcataaaaaccagcaagacagaagagttaggacctatattaaagtaytaaaagtgagcctaagaagacatcaagagggacagattggcagtactgagaaccacccagctttgggcacttaccacaatttgtaataatgtgtttgtct

SEQ ID NO: 62465 - DNA, 201 bp, Homo sapiens
cagtcaagtgagggatagaaacaagtaaagccatcagagcagcaatacaacactgccacaaagcacggtgacaagcccctggcattcgctggagatccctyccagagctccctagaattttctgcaggaaaagcaaagagggagaagaggatgagggaggggcccgtgagagtgggggcctgacctgctgcagaagggaca

SEQ ID NO: 62466 - DNA, 201 bp, Homo sapiens
acagataatttaaattttgttttacatactttttgtaatttccaaattctctacaatgagaattatgattaggagaaacttattttaaaacaaaatgaaamgataagaaaaagcaaaaagataagaaaatcaaagcatagatggagaataactagcagaatactgattcctggattgtcaggaagttaaataaaattagtc

SEQ ID NO: 62467 - DNA, 201 bp, Homo sapiens
gagcagagtaagagaggtgatgggtcctgggaatgggaaggggttgcagaattaaacagtgtggtgcaagtcagcctcgtcaagcaggagatgcttaagcygacttgaatgagatgagcgcatgactagcacaatgtagtaaagattttttgaggatagaggaggaagctcatatgtctcctcatttttagctgatgtgcc

SEQ ID NO: 62468 - DNA, 201 bp, Homo sapiens
gccttctacgagccgcatggacggaggcctgcgtgttatttcatagaggccgaaacggagacccaggaaagataaaagaagggctcaacccgggacccccrctagccagccgagggcgagaaatgaaagccaaggctgaatgattccctgtgccgtgagctctctcccactccatccacactctcctccctgcaaagagtg

SEQ ID NO: 62469 - DNA, 201 bp, Homo sapiens
aactcccacacccgcgctgtcccgccccgtcgcagttccgcgggccctggcgcggcctggagactccagtctcttcctctctggacctcagtttcgccacmggtccagcggaaagcggatctggtgggtcccatgcatatgaaacgttcccgctccctagaggggccctgcccggagatggcctgtccggaggcgatgctt

SEQ ID NO: 62470 - DNA, 201 bp, Homo sapiens
ccactttggggggagttgggaaggaagggtgggaaggagcatttgcctggctcctctgtcgagccgcagccacggaacttcctgcctgggtggtaatggtkatgcccattttacagagaagaaaagtgcagcttccaaaggtgcaatccgcggtggggaaaggggccggcaaactcccacacccgcgctgtcccgccccgt

SEQ ID NO: 62471 - DNA, 201 bp, Homo sapiens
gagagaggagatgaggctgtttagaattcatgggaagagcatgcagatccagttctgcttttgttggtgttctgaattcaaggcaggagtcacatgtttgyaacggatcaaggctttagagcagggtagctacgaatgggtggacctgtgtgccagtgacctggaaaagtatgacggagtgaaggaataccccctttagga

SEQ ID NO: 62472 - DNA, 201 bp, Homo sapiens
gctccaactttgctcagtctctcactctggatttgccagaacaggtggggatagagatcatcttcccactgcggatcccaagaggggccccggcttccgtkcactcttgtcccttaccccagacctgggactccagagccagacctcctgtaggcaccgctggggaccaggccaaaccaaacactccaggagaacagccca

SEQ ID NO: 62473 - DNA, 201 bp, Homo sapiens
taccagcgggcgctgggagctgccgggcagcattccattcaggactcattccttttctcttcagtggaagtgaaatgatcctttccaggtaacagccgagmataggggactgcgggacatctccgcctcttccttggctctgggccttcgatgtaaggcgttagaggacaatctttgttggctggatttctgttcttcccc

SEQ ID NO: 62474 - DNA, 201 bp, Homo sapiens
aggggccctgcccggagatggcctgtccggaggcgatgcttcgccatttgccggcgccctcttcattgttatctcctttgtgtccgctctggtcttagccstcggaacatcctgggactccaaggctccgacccccagcgcaaaggactctagggactggcttcctggctgtaccgcgcagcgggactcctcgtctgcaca

SEQ ID NO: 62475 - DNA, 201 bp, Homo sapiens
gccactagaacacagagtcacctgtgctccaggagttaaggggtcttctaagtggtgcttttgcacacaggttaccctgatttgcagaggaaatggagatsggaagggacttactgctttctcccgtgggggtgaaaaataaacccacttgatgctgtctccaacggcggctccaactttgctcagtctctcactctggat

SEQ ID NO: 62476 - DNA, 201 bp, Homo sapiens
gaggataccgaggtcaggggttcgagaccagtctggccaacaaggtgaagccctgtcgctacttaaaagaaaagaaaagattagaacagaaattaggaaaragacaggcagttcctagccccagaaaatccagagacctggctgacttcctttcctctgcactaacctgctgagggaacttgggcaagtcttcgcctcttt

SEQ ID NO: 62477 - DNA, 201 bp, Homo sapiens
tgagtgccctgctagcctcatgaaccgagtgccactagaacacagagtcacctgtgctccaggagttaaggggtcttctaagtggtgcttttgcacacagkttaccctgatttgcagaggaaatggagatgggaagggacttactgctttctcccgtgggggtgaaaaataaacccacttgatgctgtctccaacggcggc

SEQ ID NO: 62478 - DNA, 201 bp, Homo sapiens
tcccttccggagggccccagctgcctaggagcttttccactttggggggagttgggaaggaagggtgggaaggagcatttgcctggctcctctgtcgagcygcagccacggaacttcctgcctgggtggtaatggttatgcccattttacagagaagaaaagtgcagcttccaaaggtgcaatccgcggtggggaaagggg

SEQ ID NO: 62479 - DNA, 201 bp, Homo sapiens
ccagtgacctggaaaagtatgacggagtgaaggaataccccctttaggacacagttggaacaggaacaaagttttccttttctaggttaacaatcacttayctgatacctgctcccaaaacgaatcctattgatgaaggatcttctttctgagcagtaaacctgtgtttaattaaccttatgcaaatgagcttaattgctt

SEQ ID NO: 62480 - DNA, 201 bp, Homo sapiens
gtctgggccttcgggcgttggctgtaatgcttaaaatctgtcgcaaggtggcaacattgtggcgagaaatagactttttttaaatcctgggttttttttttcaaagcatattttccctattaatgtttcatttaacttaattagaatctggtaaactaattaaagtagctacgagccccgcaatcagcaataattagtata

SEQ ID NO: 62481 - DNA, 201 bp, Homo sapiens; identical to SEQ ID NO: 20302

SEQ ID NO: 62482 - DNA, 201 bp, Homo sapiens; identical to SEQ ID NO: 20323

SEQ ID NO: 62483 - DNA, 201 bp, Homo sapiens; identical to SEQ ID NO: 19937

SEQ ID NO: 62484 - DNA, 201 bp, Homo sapiens
cccattcccgggtgtgatccggctcccctggcaagagttgtgtcagggactggggctcaagccagcctcttcacgtccccgaatcacagcagaaagttggraaggaaactctggagtcctggcctttgccctagtcacccagggtcatggtgagcgtcagggggttgtgcttcacagatgccatgtgagcagcggacagga

SEQ ID NO: 62485 - DNA, 201 bp, Homo sapiens
gtcatggtgagcgtcagggggttgtgcttcacagatgccatgtgagcagcggacaggatgctgagctgaggaacacaagccctgccccactctgctgtgartttccttggacaagctgcttcagtattgtgggtctctatggcctatcacctcctctacccacaaacagggactggagagggtgacatgcaggacacttct

SEQ ID NO: 62486 - DNA, 201 bp, Homo sapiens
atgtggtcttactatgttgcccaggctggtctaaaactcctgggctcaagcgatccgcccatctcagcctccccaagggctgggattataggcaggaggcrgtattacaaggcaactgagagcaatgtcattggagtaaacaaagcaaaaacaggccaggcatggtggctgaggcctgttatcccagcactttgggaggct

SEQ ID NO: 62487 - DNA, 201 bp, Homo sapiens
tcttactatattaaatttttttgatagagatgtggtcttactatgttgcccaggctggtctaaaactcctgggctcaagcgatccgcccatctcagcctcsccaagggctgggattataggcaggaggcggtattacaaggcaactgagagcaatgtcattggagtaaacaaagcaaaaacaggccaggcatggtggctga

SEQ ID NO: 62488 - DNA, 201 bp, Homo sapiens
tgcaggacacttctactggaaggtctagaacaaataaatcatgccttctcactgcctttgtaaaagtggaatcttaggaggtcatattcttactatattamatttttttgatagagatgtggtcttactatgttgcccaggctggtctaaaactcctgggctcaagcgatccgcccatctcagcctccccaagggctggga

SEQ ID NO: 62489 - DNA, 201 bp, Homo sapiens
gaaggcagtcttgtcccattctgacaaattgttatagaagagtggtgggggtgaagaggtgacggggtaaggggcagccttagctccaggactatttctgycacctgtaggctgaagatacaaggccagtgcctttgggagctcagtttcccatctataaagcagatatcagattttgcacccataagtgcatgtgggaaa

SEQ ID NO: 62490 - DNA, 201 bp, Homo sapiens
cctcgcgtctccagcacaggtccgggtttctccacccaatgcgcctgcgcacaggcctagcccagtcggacgcagcccaggactgccaggggtggggattrcctgggtcccccaggaagggccgggttacgtccggaaaagtgaggcccggggttccagttaattgttaccggaagtggagggaagcgttgccaggggagg

SEQ ID NO: 62491 - DNA, 201 bp, Homo sapiens
ggaaatctgaggaaggagagggatagtctgccttcagagttttgtttttgagataggtctcactgtcacccaggctgagaggctgagatcatagctcactkcgtcctcgcgtctccagcacaggtccgggtttctccacccaatgcgcctgcgcacaggcctagcccagtcggacgcagcccaggactgccaggggtgggg

SEQ ID NO: 62492 - DNA, 201 bp, Homo sapiens
gagatcatagctcactgcgtcctcgcgtctccagcacaggtccgggtttctccacccaatgcgcctgcgcacaggcctagcccagtcggacgcagcccagsactgccaggggtggggattgcctgggtcccccaggaagggccgggttacgtccggaaaagtgaggcccggggttccagttaattgttaccggaagtggag

SEQ ID NO: 62493 - DNA, 201 bp, Homo sapiens
caggggtggggattgcctgggtcccccaggaagggccgggttacgtccggaaaagtgaggcccggggttccagttaattgttaccggaagtggagggaagmgttgccaggggagggcggagactgtggctgacaagatgggtggcaggcccttccctgggggtatcgaggtagggacgtttgtggctacgtctgtcctaga

SEQ ID NO: 62494 - DNA, 201 bp, Homo sapiens
ctctaaaaaataaagtgtctataaaaatcagtcttacttagaccagctgtcaagattctccagttcataaagtgtaatacccacttaaaattttatgtgcytaacggtcaggcgcagtggctcacgcctgtaatcccagcactttcggaggccgaggctggtgaatcccctgaagtcaggagttccagaccagcctgacca

SEQ ID NO: 62495 - DNA, 201 bp, Homo sapiens
ggcggagcccgggtggctggcgggcagtgctcccaggctggccagccgtggtctggccccgcctgaggggctgtggcctgggaaccgtcagctgtctcctyggggaagcggctgggatctccagaacaaacagggaaaccacaggctcccccaccacgcccccaaggaggggcacggcctctggccttgcccgccaacacc

SEQ ID NO: 62496 - DNA, 201 bp, Homo sapiens
agaaatgtttaaacttatgggaagatacaccactaacaagggctggagccaggactctagccatgcagtgtggctgcagagtacaggattttaatcacccrttgcatcctctggcgtcgggcagggctggacttcaggctgggttttccccgttcccagctgcacccacgtcgtgtctcctcctggagtctaagtttcctg

SEQ ID NO: 62497 - DNA, 201 bp, Homo sapiens
aggagaattgcctggagccgggagatggaggttgcagtgagctgagatcacgccattgcactccagcctgggcgacagagcgagagcgagactccgtctcaaaaaaaaaaaaaaaaaaaagaagcaggggagacaagtgactggcttgtgctttgattactcgagtggctggggagcagaggaggctggggagctccagga

SEQ ID NO: 62498 - DNA, 201 bp, Homo sapiens
tcaggctgggttttccccgttcccagctgcacccacgtcgtgtctcctcctggagtctaagtttcctgtgctgtgactgcaggcggagaggagggcccaaygtctaggggtgagtcaccacgtgccgattctctgctcctagggtcggggcctggctggtcactgccacccactggctgcagtccagcgccctcatctgcg

SEQ ID NO: 62499 - DNA, 201 bp, Homo sapiens
tctccagaacaaacagggaaaccacaggctcccccaccacgcccccaaggaggggcacggcctctggccttgcccgccaacaccccactctccaggcctgkctccccacttctgggtgaatagaaaggaggcctggtggcaagcaggtcccagaagtgcctgatcctcaggtggtgaaatgacaaggagttccccagacgg

SEQ ID NO: 62500 - DNA, 201 bp, Homo sapiens
ccactctccaggcctggctccccacttctgggtgaatagaaaggaggcctggtggcaagcaggtcccagaagtgcctgatcctcaggtggtgaaatgacarggagttccccagacggaagcgcccagcacagggcactgcacacgggaggcccctgagaaacagcagccctggactcatccaccgctggctcagtgggagc

SEQ ID NO: 62501 - DNA, 201 bp, Homo sapiens
agctccagggtttctggatccccaagtcagcccgggcttgaccacgctgcctgcaggtgtgtcatcggcctccagcccactcaggtcacctggttggggawaaatggcagtgaaggggcagagtgctgggtcagggtgagagaaggggcctggggcagggtctggaggccttgaggtgtgatcattgcccctcttggcctc

SEQ ID NO: 62502 - DNA, 201 bp, Homo sapiens
agcaatcctgggggattcctgtacttggcagggcaggctgggacagccgccctaattcagaccggctgggggatggggtgcatgtgactccactaaaagcygcaattagagcccaatttaaagaaacgctgtgttagttcctccccgggtagatgtgattataggctcggagctaaaccgtttctaacaggatgacacatg

SEQ ID NO: 62503 - DNA, 201 bp, Homo sapiens
cctccactgtcgaagattctcctggggcaaaggcctctttccacaggttcccagacaaagctcagcctggaatggcctcgctatggtccagggaggaaggyggcccaggaagggtcagcaccaagttgcagccgcacagtaaaatgggcagaggagcccagcttccatctccagcaaagggttctcacagccttctgaccc

SEQ ID NO: 62504 - DNA, 201 bp, Homo sapiens
tggaggaacaacggctccaggcaggcaatagatcaagtgcaaccacctggggcagaaatgaggaccagaaataaggtgatgtggctggaacccagagaaayggggatcagtgagtgggacagaggctgcattatgggatgtggcatgaaaagagctggcatcttcttctggtcgcagagaggaagccactggagggttaga

SEQ ID NO: 62505 - DNA, 201 bp, Homo sapiens
ggagaattgcctggagccgggagatggaggttgcagtgagctgagatcacgccattgcactccagcctgggcgacagagcgagagcgagactccgtctcaaaaaaaaaaaaaaaaaaaagaagcaggggagacaagtgactggcttgtgctttgattactcgagtggctggggagcagaggaggctggggagctccaggag

SEQ ID NO: 62506 - DNA, 201 bp, Homo sapiens
ggaccagaaataaggtgatgtggctggaacccagagaaacggggatcagtgagtgggacagaggctgcattatgggatgtggcatgaaaagagctggcatyttcttctggtcgcagagaggaagccactggagggttagaagcaggggagacagctgggcgtggtggctcacgcctgtaatcccagcactttgggaggccg

SEQ ID NO: 62507 - DNA, 201 bp, Homo sapiens
gaccagcctgaccaatatgatgaaaccccgtctctactaaaaatacaaaaattagccgggtgtggtggtgcgtgcctgtaatcccagctactcaggaggcwgaggcaggagaattgcctggagccgggagatggaggttgcagtgagctgagatcacgccattgcactccagcctgggcgacagagcgagagcgagactcc

SEQ ID NO: 62508 - DNA, 201 bp, Homo sapiens
tgatgaaaccccgtctctactaaaaatacaaaaattagccgggtgtggtggtgcgtgcctgtaatcccagctactcaggaggctgaggcaggagaattgcytggagccgggagatggaggttgcagtgagctgagatcacgccattgcactccagcctgggcgacagagcgagagcgagactccgtctcaaaaaaaaaaaa

SEQ ID NO: 62509 - DNA, 201 bp, Homo sapiens
ttgtacagatggggaaactgaggtctgaaggaaggcagggctggggtctaggtcttctgtctgccaaccccgactcttctgccagcctctaaggtggactsctgtctgagccaactcaatggctgggttgaaaccttccaactgggacattcctgaagggggtgagtgtctctctggaggtcctcctgtagatggacctgg

SEQ ID NO: 62510 - DNA, 201 bp, Homo sapiens
gcagcctttgtcttctgaaccccatgctgccttgggttccacggacgcaggtaagtcttgggggttcccgccccacctgcatgctcagggaaggctctccrctgccgcattcccccgctgccagtggctcccacctgctcccctcccagagggctgactccaaaggaagcctgtcctttgtcagcagagctgccttgcccg

SEQ ID NO: 62511 - DNA, 201 bp, Homo sapiens
cgggtgtgatggtgcacacctgtaatcccagctacttgggaggctgaggcaggagaatcacttgaacctgggaggcggaggttgcagtgagccaagattgyaccactgcactccagcctgggtgacagacagagaccctgtcacttacacacacacacacacacacacacacacacaaggccgggtgcagtggctcacgcc

SEQ ID NO: 62512 - DNA, 201 bp, Homo sapiens
ccatctgtcccagaagcccttggcctggataatccctggttccttagtagttcaggcagcctttgtcttctgaaccccatgctgccttgggttccacggaygcaggtaagtcttgggggttcccgccccacctgcatgctcagggaaggctctccactgccgcattcccccgctgccagtggctcccacctgctcccctcc

SEQ ID NO: 62513 - DNA, 201 bp, Homo sapiens
taaatacccactcctttcttcccacgagagagatattattccccccatttcatggaggaggaaactgacgatcagagcagccaggaaacaggatggcgttstctgctgagggacggtgtgttccctggagaggagatccagcttgccattgtgggtttcttacagcaaaaatcctgtgtgtacacatatgctgaacaaggc

SEQ ID NO: 62514 - DNA, 201 bp, Homo sapiens
tttatttatgctagagacatggccttgctgtgttgcccaggctggtcttgaactcctggcctcaatcaatccttccctcctcggcctcccaaagtgttggrattacaggcatgagcaccgcatctgaccttagagagctgggatttaaatctctaaatccttccaccttattttgcggacaggggcccagggctctgggtc

SEQ ID NO: 62515 - DNA, 201 bp, Homo sapiens
ctcctttcccatccctccctcagcctcatgcctgcttgattgcaattaaggatgagaaccattgaatagggctcgaatggtgaattaataaccttatctcrccccagccaaatctggggccattgcgcacctctggcccagggtggggagggcttctttatcaggctgcaggcagcgctcagattttccttctcagacaag

SEQ ID NO: 62516 - DNA, 201 bp, Homo sapiens
tgtctcttcctcttctcacaaggacaccagccacactggattagggtcccacccttaggacctcatttaaccttaatcacctcctatgaggctctctctgycaatgtagtcacattggggattagggcttcaacatatggatttggagggggacagggttcagcccataacaccacatggtagcaatcggcccaagactga

SEQ ID NO: 62517 - DNA, 201 bp, Homo sapiens
aagcccccagcaccctgctgcctgctgtactggggccgcctcagccccagtccctggtcctgggagcaggtccctcctttcccatccctccctcagcctcwtgcctgcttgattgcaattaaggatgagaaccattgaatagggctcgaatggtgaattaataaccttatctcaccccagccaaatctggggccattgcgc

SEQ ID NO: 62518 - DNA, 201 bp, Homo sapiens
cagggctcttcacaccctccgtgctcccaatcaatccctgttcctaatgtgccctaggattgctattcttccttggcctggcccagggctggatcgattcytctcttaaaggcacaggcctccctttacagccatcagcgggcattctgcagagaagtttatttacaaaaaaagtcttttgttttattcttgactcggatg

SEQ ID NO: 62519 - DNA, 201 bp, Homo sapiens
ttctcacccccacgggtcccacagcccccgcttccctgagccccactgcaaggggtagcctatgagggctggccagagtcagggctcttcacaccctccgwgctcccaatcaatccctgttcctaatgtgccctaggattgctattcttccttggcctggcccagggctggatcgattcctctcttaaaggcacaggcctc

SEQ ID NO: 62520 - DNA, 201 bp, Homo sapiens
acagggctgtgagcctcttgagggcagggcctgtcccccattccggtcagtgcaccagggcctggcactagtaggtgctctgtaaacagctgtcctgcagygatcggtgggacgtgggcatggctcggtgtgtgtgtgtctgggcaggggtctcacatgccagctgctcctgtgggaaaaggcctcggagtagtggtttgg

SEQ ID NO: 62521 - DNA, 201 bp, Homo sapiens
ctcccctgggttcctgcagcccctgggtttgcttctctcagcatagtaatcacccaggcagtaactccctatttcatctattttccaaacagggctgtgarcctcttgagggcagggcctgtcccccattccggtcagtgcaccagggcctggcactagtaggtgctctgtaaacagctgtcctgcagtgatcggtgggac

SEQ ID NO: 62522 - DNA, 201 bp, Homo sapiens
gattcttcaaaagtacataagataacaccaggacccctgctctccccctggctcttgtcccactgcagaatggctgctaagccctggacacacccaccctyttttctgcctctggctctttttcatgttgttcccccagctggaacacctttccctctcccttcgtagcctaacaaagcccttcctcctcttttgggctca

SEQ ID NO: 62523 - DNA, 201 bp, Homo sapiens
tcccagggttgttctgtgtgacccatagaatatagcagaattgatgttagtatctttggaggtgaggttatgagagatgctgtgggttctgttttaggttmtctctctctctctggccattcactgtgggggaagtcagttccatgccctgagtccattcaggcagcttgtgaagaggcccacatggccaatagccagtga

SEQ ID NO: 62524 - DNA, 201 bp, Homo sapiens
aaagcttccagaaggatagactgggatcctggagaatctggggttgcttggggcctccctggagctctggataacacccttctcttccatgtcacccgctstcccacccaggccccactccagagagacggcctagaactgattcttcaaaagtacataagataacaccaggacccctgctctccccctggctcttgtccc

SEQ ID NO: 62525 - DNA, 201 bp, Homo sapiens
tggaggcaggggatggactgaatggcttctgaatcctgaatgacccaggattctgtgatgtccaactaatcttcacaaagtgatgttttcctagaccaggkttctgcaaactttttctgtaagggaccaaacaagtaaattattttggctttggaggccatatgatttctgttacaactgcacaactcaactccactgctg

SEQ ID NO: 62526 - DNA, 201 bp, Homo sapiens
cctgtccctttaaagagcccgctgttaagtttcaaagacccttgcagagcatgaggagtgtctgggagcacgattcctcaaggaggaatattccatcaaaygccgcgtgataaatggggacccgcgtggttgtagaccctcactttggacgcgagtggcccagcgcaggcgacttcactcgctgggataaaaggagattca

SEQ ID NO: 62527 - DNA, 201 bp, Homo sapiens
gccagacccaatattgaagggggattggatcccatcttgggagactgatgccccaaccctgttggtctcgtaatgttcctattggattactgataccccaraaagcgaatgccccaggaatactgatctttaaggattattgggacctcaagctctggaaattgtgattgtaggagcattaattgcccaagaacactgtta

SEQ ID NO: 62528 - DNA, 201 bp, Homo sapiens
ggaagtcaggagactgagattcaggtcctagtgctgtacctggctcattcagcctttgaactttctaaatggaaaggccattaaagattatccagtctaayactagcatttgaggaacctgaggccagactggggatggggagacaatatacaatcaagggtatagatgtaggagctagacagtttgcattcaaatctcta

SEQ ID NO: 62529 - DNA, 201 bp, Homo sapiens
ctgtggaaactggccccatttggcaaatgagtggggaagacaggaagggatcccccagaaagtggagagaaacagccttgaaataaacgatgccctgccaracccaatattgaagggggattggatcccatcttgggagactgatgccccaaccctgttggtctcgtaatgttcctattggattactgataccccagaaag

SEQ ID NO: 62530 - DNA, 201 bp, Homo sapiens
ctgtcaaaaaaaaaaaaaaaaaaaaaaaaaaaacctgtggaaactggccccatttggcaaatgagtggggaagacaggaagggatcccccagaaagtggaragaaacagccttgaaataaacgatgccctgccagacccaatattgaagggggattggatcccatcttgggagactgatgccccaaccctgttggtctcgt

SEQ ID NO: 62531 - DNA, 201 bp, Homo sapiens
aaacaggtagtgtctgcttcaggcaaggattgatccagctgcaatgcattgattggtatgaataggaccagtgagttttctttttctccatttctaggctytgcttcctcagtgtcagcatcattcacagcaggcatgtccctcctgcctccaagagagtcaccagcagcttcctcctccacatctgtgagtaaatgagag

SEQ ID NO: 62532 - DNA, 201 bp, Homo sapiens
gaagctcagagctgcctggggggaccagaaggtgggaacagacctgggatctaacttctacagagcctcctgctggctggggaacaggaacatatcatgckcctctataagcctcagtttcctcatccgtccaatggctatgctaagcctctcaggcctgccctggccttgcagagagggtaggagaccaggatttcccat

SEQ ID NO: 62533 - DNA, 201 bp, Homo sapiens
accttccaaaaaaacctgtggaggccgggtgtggtggctcactcctgtaatcccagcactttggaaggcagaggcgggcggatcataaggtcaagagatcragaccatcctggccaacatggtgaaaccgcgtctctactaaaaatacaaaaattacctgggcatggtggtgcatgcctgtagtcacaactacttgggaca

SEQ ID NO: 62534 - DNA, 201 bp, Homo sapiens
ggctaaggttgcagtgagccaagatctcgccactgcactccagcctggcgacagagtgagactctgtcaaaaaaaaaaaaaaaaaaaaaaaaaaaacctgkggaaactggccccatttggcaaatgagtggggaagacaggaagggatcccccagaaagtggagagaaacagccttgaaataaacgatgccctgccagacc

SEQ ID NO: 62535 - DNA, 201 bp, Homo sapiens
agctttgctttctactctccaggctctcagcaacctgactttccctgagttcatttaggggcagcaggggtccctgtgagtgatttcttccaggagggaatttggaggaacattccagagcttggctctcacacttgagctgcatcacaatcagctagggggctttgtaaaacacagcctgctgggcccactcccagagtt

SEQ ID NO: 62536 - DNA, 201 bp, Homo sapiens
atccctctgtgcacaagtctgtgatcttccaaatgacatttctgtgccaaaccgggccctgttttctgcattaatacccatcccgattactgcagttttarttgcaaatgtcagaaaatccaattcaaaggacttaaataataaagagaattcactggcttacataactgaaaaacaggtagtgtctgcttcaggcaagga

SEQ ID NO: 62537 - DNA, 201 bp, Homo sapiens
gctttgctttctactctccaggctctcagcaacctgactttccctgagttcatttaggggcagcaggggtccctgtgagtgatttcttccaggagggaatttggaggaacattccagagcttggctctcacacttgagctgcatcacaatcagctagggggctttgtaaaacacagcctgctgggcccactcccagagttt

SEQ ID NO: 62538 - DNA, 201 bp, Homo sapiens
agcactctcaaggccaaagtgcatgggcaagaaatttaggacaaggggaggaagaaagaaaagaaaagagaatatcaaggaggcaaatgacaaataaatasccactcctttcttcccacgagagagatattattccccccatttcatggaggaggaaactgacgatcagagcagccaggaaacaggatggcgttctctgct

SEQ ID NO: 62539 - DNA, 201 bp, Homo sapiens
tgcttcaggcagagggagagagaaatagtcacagtccttaccctggtgagttaaaaggataatgcttaagatgccattcacccacccttctatccatttghcattcattcattcattcattcattcattcattcatgtatccattcatttattcggtaaatagcaagcacctactactgtataggagtaaacccgagacaa

SEQ ID NO: 62540 - DNA, 201 bp, Homo sapiens
agaatgcggcaggcagtcaggccctctgcgtggaccccacaggtggtcaggcagtcttttcttctgctctcatgctgtgctgacgcagggactttggggtytccttgcttcctttgggattggcagcatagactccctctgtctcagatccccacgctttcatggaggtctggggattccttagctggcttgtggtaataa

SEQ ID NO: 62541 - DNA, 201 bp, Homo sapiens
tctgtaatcccagcactttgggaggcaggtggatcacctgaggtcaggagtttgggaccagcctgatcaacgtggtgaaacccagtctctactaaaaatayaaaaaattagctgggcatggtggtgcacacatgtaatcccagctacttgggaggctgaggcaggagaatcgcttgaacctgaaaggtagaggttgcagtg

SEQ ID NO: 62542 - DNA, 201 bp, Homo sapiens
ggccacacagttgggaacggtaggacggggctttgaacctaggcagtccagttccacactttctgctcccaatcattctctcccgtggccagcaggggccktgaggggtgttggtgctgagagcggggctggagaggtttgggggctcagagctggtctggaggaggaaagaagttcagggtcagccccctttcctgctcc

SEQ ID NO: 62543 - DNA, 201 bp, Homo sapiens
aaatataaaaaattagctgggcatggtggtgcacacatgtaatcccagctacttgggaggctgaggcaggagaatcgcttgaacctgaaaggtagaggttscagtgaatgaagatcgcaccactgcactccagcctgggcaagaagagcaaaactctgtcacaaaaaaaaaaaaaaaaaaaaaaaaaaggaacttcacctg

SEQ ID NO: 62544 - DNA, 201 bp, Homo sapiens
acggggctttgaacctaggcagtccagttccacactttctgctcccaatcattctctcccgtggccagcaggggccttgaggggtgttggtgctgagagcrgggctggagaggtttgggggctcagagctggtctggaggaggaaagaagttcagggtcagccccctttcctgctccctgctgctgtgaactgcctgcgcc

SEQ ID NO: 62545 - DNA, 201 bp, Homo sapiens
ccaacctttagggtttgcctgggactgagggggtgcctgggatggaactctctattttaaaaccaggcaaaccaagatgaattggttgctttctttttttytttttttgttgagaccaagttttactctgtcgcccaggctggagtgcagctgtgcgatcttggctcactgcaacctctgcctcccaggttcaagcgtttc

SEQ ID NO: 62546 - DNA, 201 bp, Homo sapiens
ctcccaatcattctctcccgtggccagcaggggccttgaggggtgttggtgctgagagcggggctggagaggtttgggggctcagagctggtctggaggargaaagaagttcagggtcagccccctttcctgctccctgctgctgtgaactgcctgcgcctggaaagggctgagccactctgagaagttcatgggccaatg

SEQ ID NO: 62547 - DNA, 201 bp, Homo sapiens
tgagttcacgccattcttctgcctcagcctcccgagtatctgggactacaggtgcctgccaccacgcccggctaatttttttgtattttttagtagagacrgggtttcaccgtgttagccaggatgggctcgatctcctgaccttgtgatccatccgcctcggtctcccaaattgctgggattacaggcgtgagccaccgc

SEQ ID NO: 62548 - DNA, 201 bp, Homo sapiens
ccggccccgacaccagcacacgattgagaaggaaactcaagcaaaatgaatcggttggccggcaggagcagctgttgatttatttctgggaagggcccggygtcccctggaacggtgacctctattaatgttgacatgttcaaagcctcatattgggatgcagcacgcctctcctgtccctttaaagagcccgctgttaag

SEQ ID NO: 62549 - DNA, 201 bp, Homo sapiens
attggggggcaggaatggggaacatcgccccctgccaaggcgagacttttgcccacagtccccactgtggccatcacacaccttggccctcactcatttcyggcacttggcgttctaggatcacaggatcacactcaggtctgaccctcggctcctggggacagggaagggcccaagacacagtggttttctgtcagaggc

SEQ ID NO: 62550 - DNA, 201 bp, Homo sapiens
attgcagacagtgatgggctgggaaaagagtcagagggacctgaggccatgagggtgatgcacacagatcctactgagcaaaggccttgccagaggggacktgccttcaaaccaagagtgaaagaatgtgtacaaattgaggctcagagagctcaagccatttgcccaaggccacacagctaggacatggtagagctggga

SEQ ID NO: 62551 - DNA, 201 bp, Homo sapiens
gagagtacacagccctggggacccttcaggaggccgggctactgagggttaaatctacctcgagaaacaacatctagcaaccaccaagggagggaaccagmaaaagcattatcatgattaatgttatttcaaagacttaatttttccccctctttcaggaatgcttgtctgcagttgcaccgagtgctatctcttgattct

SEQ ID NO: 62552 - DNA, 201 bp, Homo sapiens
cataaacagcactattgataaaacaatcagtaactgagaaatgacagaaacataaaacaatctatatctagctgtttgttaggagttttaaatgtggcagkaccatcgcaggggcaagctggtctgtgcctgcatcattgcagacagtgatgggctgggaaaagagtcagagggacctgaggccatgagggtgatgcacac

SEQ ID NO: 62553 - DNA, 201 bp, Homo sapiens
tctctgaggtcactcccttccagtgcctgtattctgtgattcaggaggatgaatgactcacccagggccacatagggaggtgggagaagaaccagataaaytgtggaagtcacataaacagcactattgataaaacaatcagtaactgagaaatgacagaaacataaaacaatctatatctagctgtttgttaggagtttt

SEQ ID NO: 62554 - DNA, 201 bp, Homo sapiens
agtgagactctgtcaaaaaaaaaaaaaaaaaaaaaaaaaaaacctgtggaaactggccccatttggcaaatgagtggggaagacaggaagggatcccccaraaagtggagagaaacagccttgaaataaacgatgccctgccagacccaatattgaagggggattggatcccatcttgggagactgatgccccaaccctgt

SEQ ID NO: 62555 - DNA, 201 bp, Homo sapiens
gatcgagaccatcctggctaacacagtgaaaccccacctctactaaaaatacaaaaaattagccgggcgtggtagcacgcgcctgtagtcccagctactcygtctctactaaaaatacaaaaatacaaaagttagccgtgcgtgatggtgcgcgcctgtaatcccagctactcgagaggctgaggcaggagaatcgcttga

SEQ ID NO: 62556 - DNA, 201 bp, Homo sapiens
cactccagcctggcgacagagtgagactctgtcaaaaaaaaaaaaaaaaaaaaaaaaaaaacctgtggaaactggccccatttggcaaatgagtggggaaracaggaagggatcccccagaaagtggagagaaacagccttgaaataaacgatgccctgccagacccaatattgaagggggattggatcccatcttgggag

SEQ ID NO: 62557 - DNA, 201 bp, Homo sapiens
aaggccgggtgcagtggctcacgcctgtaatcccagcactttgggaggccgaggcgagtggatcatgaggtcaggagatcgagaccatcctggctaacacrgtgaaaccccacctctactaaaaatacaaaaaattagccgggcgtggtagcacgcgcctgtagtcccagctactccgtctctactaaaaatacaaaaata

SEQ ID NO: 62558 - DNA, 201 bp, Homo sapiens
accccaacactttgaggtttaaaacaacagctattgatcgttttcttaattctatgggctaatgggttgagttttctgctcaatctgtgttccgtagggtrgtggggtaggggcaggggggagtgttcctgggaattgaaaactgggagtgtcctaggccacctgagatgagttggtcaccttgttattgcctggatcatt

SEQ ID NO: 62559 - DNA, 201 bp, Homo sapiens
ggccagttggtggctgttggtgggccctggggtatccccagaagaatccctgtaaacctgcctggcaggcagcaccaaaggcacatcaccctagagaatcrtttcctggagcgtatctctctcattttggggtccccctcccaaaggcagaccccaagacagtgcttgttacaggtagtttatgtagggcttgattctggg

SEQ ID NO: 62560 - DNA, 201 bp, Homo sapiens
ctttcttcatgcctgaacttgacttatcacttggcctgtctgagcctcatttccttcccttgctgggtaatcaagccatcttacaggactgtcgtacagaytacaaattcttacaggaagggctgagtccagtgcttggcacatattagggacttgttccagttatctattgctgcatcccaacacaccccaacactttga

SEQ ID NO: 62561 - DNA, 201 bp, Homo sapiens
gcagcctccattattccccggggagtgcgggcagctggggactcagggtgtggctcctcttgactctctccctgaggcataaataaccctttgtctcaaamcccaccttttgtttttgagacagagtctcattctattgcccaggctggagtgcagagatgcaatctcagctcactgcagcctccgcctcctgggatcaag

SEQ ID NO: 62562 - DNA, 201 bp, Homo sapiens
tggctacctagtggagaggagacatggggaggagctgagttgccctaattgaagccagcccagatcagtcaaccaaccccatgacacaaaccagagccatycaactgacccacagactcataaacttaagaaatgccagttgtttcaagccactgagttttgggctggtttgttacacagcattgttatggcactagataa

SEQ ID NO: 62563 - DNA, 201 bp, Homo sapiens
aggccattgtggagaaccctggggtcccaaggaatgtactttgaaaacccctagtctggtccatacccctccttgagcaggtgggggaaggggacccagtraggtctcctgacttgttcaaggtcatctgaggagtcaggggcagaggcaaggcctgagttgcatggtgtcccaggcacgtctccccagagtcctctacat

SEQ ID NO: 62564 - DNA, 201 bp, Homo sapiens
cgtatctctctcattttggggtccccctcccaaaggcagaccccaagacagtgcttgttacaggtagtttatgtagggcttgattctgggaaccaggggargagaagagaggattcaagtgctacaagttagactttggtgtgggggacagtgctccctcttgctggaacattctgagaagccttaggaaatgcatctctg

SEQ ID NO: 62565 - DNA, 201 bp, Homo sapiens
aatgtcagaaaatccaattcaaaggacttaaataataaagagaattcactggcttacataactgaaaaacaggtagtgtctgcttcaggcaaggattgatycagctgcaatgcattgattggtatgaataggaccagtgagttttctttttctccatttctaggctctgcttcctcagtgtcagcatcattcacagcaggc

SEQ ID NO: 62566 - DNA, 201 bp, Homo sapiens
gcagcaccaaaggcacatcaccctagagaatcatttcctggagcgtatctctctcattttggggtccccctcccaaaggcagaccccaagacagtgcttgktacaggtagtttatgtagggcttgattctgggaaccaggggaagagaagagaggattcaagtgctacaagttagactttggtgtgggggacagtgctccc

SEQ ID NO: 62567 - DNA, 201 bp, Homo sapiens
tttgaacccagatctgcctgatatggaggcccatgctcttagtttgcctgctctatccctctgtgcacaagtctgtgatcttccaaatgacatttctgtgscaaaccgggccctgttttctgcattaatacccatcccgattactgcagttttagttgcaaatgtcagaaaatccaattcaaaggacttaaataataaaga

SEQ ID NO: 62568 - DNA, 201 bp, Homo sapiens
ccctcgctgctgacataacctcagtagatgccccttttctctcacggtccctcagaggattgtcatagcactctgtaagttccctaatgagtactttgcayggactaccctggcgtttagggcttctttctttggaatctctgccctgtcctagtacagcttggggcactcctttgcgcgaactcccctgccattgttttt

SEQ ID NO: 62569 - DNA, 201 bp, Homo sapiens
acctcaccccctcgctgctgacataacctcagtagatgccccttttctctcacggtccctcagaggattgtcatagcactctgtaagttccctaatgagtrctttgcacggactaccctggcgtttagggcttctttctttggaatctctgccctgtcctagtacagcttggggcactcctttgcgcgaactcccctgcca

SEQ ID NO: 62570 - DNA, 201 bp, Homo sapiens
tggcccagccctttagccaaactccttaagccctcatgtaaattccatacctcaccccctcgctgctgacataacctcagtagatgccccttttctctcamggtccctcagaggattgtcatagcactctgtaagttccctaatgagtactttgcacggactaccctggcgtttagggcttctttctttggaatctctgcc

SEQ ID NO: 62571 - DNA, 201 bp, Homo sapiens
agttagactttggtgtgggggacagtgctccctcttgctggaacattctgagaagccttaggaaatgcatctctgaactgtccaccaggggagatggaacrtttacccaccagtctgtgtccctgccagtagaggtggccccacaggtgttaactcccctgtgtccggactgtgcatctgtgaatccctctgctgcttcag

SEQ ID NO: 62572 - DNA, 201 bp, Homo sapiens
aagagctttacatggattttattttaattcttacaaacgatgagaagacagatgttattatccttaattacagctaggcaaactgagcctcagagaggtamagtcccttgcccaggttcacacagcagagcacagagcagatggaactgagctttgaacccagatctgcctgatatggaggcccatgctcttagtttgcct

SEQ ID NO: 62573 - DNA, 201 bp, Homo sapiens
ccataccaggccttagtttcttcattggtcaaaactggagcatggtgatggcctcctgctgggtgttatgcttcttagacgcagcagggcttatgattcaygcatctaggagagtgtggggcacttggcccatctgcccactgcagagctaagccatgtgtcctcactcctgtccttagagaacttgctcctgggttcaag

SEQ ID NO: 62574 - DNA, 201 bp, Homo sapiens
catagtaatcacccaggcagtaactccctatttcatctattttccaaacagggctgtgagcctcttgagggcagggcctgtcccccattccggtcagtgcmccagggcctggcactagtaggtgctctgtaaacagctgtcctgcagtgatcggtgggacgtgggcatggctcggtgtgtgtgtgtctgggcaggggtctc

SEQ ID NO: 62575 - DNA, 201 bp, Homo sapiens
aattctttgagctctcactatctactaggccccaacctaactcttcccacctctaacttcatttgctcctcatcacaccccatggggtggatactcagagwtgagtcacctgcctgaggtcatgcagcgtggaggtggcagagctggggttccgtggcctgcctgagctcctcttgcccttctctttctcagtcccgcttg

SEQ ID NO: 62576 - DNA, 201 bp, Homo sapiens
aagtaacagtatacaatgtccacatacagacttagctgaattctttgagctctcactatctactaggccccaacctaactcttcccacctctaacttcatytgctcctcatcacaccccatggggtggatactcagagttgagtcacctgcctgaggtcatgcagcgtggaggtggcagagctggggttccgtggcctgcc

SEQ ID NO: 62577 - DNA, 201 bp, Homo sapiens
acttggatgagcttggaagcacgtcctccagccccagtcaagtcttgaggtgagaccacagtcctggccaacaggtgactacaacatcacgggaaacccaragccattcagctaagccactctcagattgctgatccccagaagctgcatgagataataaatgtttgttgttttaagctgctaagttttggagtaattgac

SEQ ID NO: 62578 - DNA, 201 bp, Homo sapiens
cagggctgggcccaggatggctgcagcctcacctcacccaggggcaaacagaggctcagcccaacggagtggcgggggaggagtctggagtgaggacccaracccttattttggctctaccccttgtcggctggggaacttctccaagcctcagttttgtcatctgcaaaaggggggcaagaataacgcttccccttccag

SEQ ID NO: 62579 - DNA, 201 bp, Homo sapiens
tggtgtggtgacccgcttggtcagcccctgcctgtgcacatccctggggtgtggagcccaagaaggggaggagcagggctggctggtcataggtttgtccktagtgccattgccctccggatggttgaggtcttgcaggcttgacagggcactgagcaagctccaagccttaaccaataacagctagagacctaccaaagt

SEQ ID NO: 62580 - DNA, 201 bp, Homo sapiens
aagaagtactgagtgcccatctcaggaaattgatcccctgcaagtattgattctactgtgctgttgataccccaggagctttgctttctactctccaggcyctcagcaacctgactttccctgagttcatttaggggcagcaggggtccctgtgagtgatttcttccaggagggaatttggaggaacattccagagcttgg

SEQ ID NO: 62581 - DNA, 201 bp, Homo sapiens
tgatatcctctgctgaaagaaggcagaggattgattagatggaatggaatagactcgaaggggcctcagaatccatccaggctcattctgtccttttaacrctatggtcactaaagcatagagaaaaggagagagcttccagaattacacagcgtttgggatgcagccagggccagaagtttccagcatccagagcccggg

SEQ ID NO: 62582 - DNA, 201 bp, Homo sapiens
atgagaattctaggagatacaattcaagtggagatttgtggggggacacagccaaaccatatcaccaggctgaagtgcagtggcacaatcacaactcaccrcatccttgaactcctgggctcatgtcgccctctccactccaagcagtgggactacaggcttgagccaccatgtctggctaatttttttttttgagaagta

SEQ ID NO: 62583 - DNA, 201 bp, Homo sapiens
ataaaatcttgtactaaacctcaggctgataggaggctctggagaaaactgttttctgttgtttttgttctttagaatcttaagattctcaatgacaaagstgggctgcaagctccttgggcagaaaccctgaccagcacattcacggctgtatccctctctaatgcccagccaaggcctggcgcccagtaggtgctcata

SEQ ID NO: 62584 - DNA, 201 bp, Homo sapiens
atagggaggtgggagaagaaccagataaattgtggaagtcacataaacagcactattgataaaacaatcagtaactgagaaatgacagaaacataaaacawtctatatctagctgtttgttaggagttttaaatgtggcaggaccatcgcaggggcaagctggtctgtgcctgcatcattgcagacagtgatgggctggga

SEQ ID NO: 62585 - DNA, 201 bp, Homo sapiens
gctcccctcccagagggctgactccaaaggaagcctgtcctttgtcagcagagctgccttgcccggcaaagaggctttcatctctgtgcataggacttccygccgcatcagcagaaacttctggctgcttagtgcagggactagggggtggctcagttgttgagggcgcaaactttggagtaaagcgaccctggccttgaa

SEQ ID NO: 62586 - DNA, 201 bp, Homo sapiens; identical to SEQ ID NO: 14558

SEQ ID NO: 62587 - DNA, 201 bp, Homo sapiens; identical to SEQ ID NO: 14490

SEQ ID NO: 62588 - DNA, 201 bp, Homo sapiens; identical to SEQ ID NO: 14559

SEQ ID NO: 62589 - DNA, 201 bp, Homo sapiens; identical to SEQ ID NO: 14449

SEQ ID NO: 62590 - DNA, 201 bp, Homo sapiens; identical to SEQ ID NO: 14464

SEQ ID NO: 62591 - DNA, 201 bp, Homo sapiens; identical to SEQ ID NO: 14706

SEQ ID NO: 62592 - DNA, 201 bp, Homo sapiens
tgtctgttttggggtttgttttacctttacctctatgccgtccttcttccttcaccatctcttttgtcctttgaacaggaacattttggaaaagacaagtygtcagaatttcagctctttggctctcctcatgagacagatctgctgtttactgatgctgcccatgggtttttaatggtcccacctaagatagatgccaag

SEQ ID NO: 62593 - DNA, 201 bp, Homo sapiens
cttggtaaaccttcctagcaccaattcctaagattaagatcttgatggttatgtagtctactaaatgtgtcaattgtaaggattaagtaaatctcagtacrtataacattgcctggtatatagttagcagtaactaagtgttagctgttattattattcaaaatcccagggacagttggtatattttcttaaataatgaaa

SEQ ID NO: 62594 - DNA, 201 bp, Homo sapiens
gcctggcacataataaggcttggtaagtttttgctgctgtagtcactgtttttagatttctagaagggtagtgaaaaggtcaaaaacaaagagcatgtatrtgcatgtttttatcttggtgaccttatctataagtatacttttttactctattagaaaaattaattgattaaaataataagtgaattattagtgtattat

SEQ ID NO: 62595 - DNA, 201 bp, Homo sapiens
gtcagaatttcagctctttggctctcctcatgagacagatctgctgtttactgatgctgcccatgggtttttaatggtcccacctaagatagatgccaagytgtacctgggatatgagtatttttccgcgactcaggatccaaaaagaggtatgtaaggtcccgggagggacctggccagcttgggcagcagggtggggtg

SEQ ID NO: 62596 - DNA, 201 bp, Homo sapiens
agcaccaattcctaagattaagatcttgatggttatgtagtctactaaatgtgtcaattgtaaggattaagtaaatctcagtacgtataacattgcctggyatatagttagcagtaactaagtgttagctgttattattattcaaaatcccagggacagttggtatattttcttaaataatgaaacactcatttaaataat

SEQ ID NO: 62597 - DNA, 201 bp, Homo sapiens
ccaagggagctactaactgcattgggttaatgagggggttttctgtgattagaaagtggctttaatggccttcatattctagaaaacttgaagacatgatkgccctggctcctttttattaggtggggtcatcccacccagggtgagtctattcgacatggagtataaaaatagtccatcttaaactgaagtgggaatgtg

SEQ ID NO: 62598 - DNA, 201 bp, Homo sapiens
gtgggaggcacacgagtatggattcttacctgatggaattggactacctcatggacatggatggcgtcctttatggaggacaaagggactgatttgcaggrtgtatctgggaaagttcctgggccctggggagtaactgtgtgcatcctaaggaggtggggggtgggggttgtcagggagggcagcaggtggcatttcatg

SEQ ID NO: 62599 - DNA, 201 bp, Homo sapiens
tctcttttgtcctttgaacaggaacattttggaaaagacaagtcgtcagaatttcagctctttggctctcctcatgagacagatctgctgtttactgatgytgcccatgggtttttaatggtcccacctaagatagatgccaagctgtacctgggatatgagtatttttccgcgactcaggatccaaaaagaggtatgtaa

SEQ ID NO: 62600 - DNA, 201 bp, Homo sapiens
cagccactctgcagcgctaagctcccagacctacctggggcttcctttggatccctccacccggcctagatgtggaagactccccagggtgcggtggtgckcagtgggccaccatgagagggccaagtgtgatgagtggagtgctgtgactggtggtgccttggcgtgcaccatggaggagaccccagaggactgcatcac

SEQ ID NO: 62601 - DNA, 201 bp, Homo sapiens; identical to SEQ ID NO: 39671

SEQ ID NO: 62602 - DNA, 201 bp, Homo sapiens
atacagaattcataaacagtttacctgaaccaacaagaaaagacatcaaatagtgcttgacttcattacttattaggcagatgccaaatacttttctttctttttttttttttttttttttgagacagggtctcactctgtcacccaagttggagtgcagtggcaagatcatggctcattgcagcctccacctcccatgct

SEQ ID NO: 62603 - DNA, 201 bp, Homo sapiens
tacagaattcataaacagtttacctgaaccaacaagaaaagacatcaaatagtgcttgacttcattacttattaggcagatgccaaatacttttctttctttttttttttttttttttttgagacagggtctcactctgtcacccaagttggagtgcagtggcaagatcatggctcattgcagcctccacctcccatgctc

SEQ ID NO: 62604 - DNA, 201 bp, Homo sapiens
acctgggcaacgtggtgaaacctgtctgtacaaaaaaatacaaaaattagctgggggtggtggcacatgcctgtagtcccggcaactccggaggctgaggygggaggatggcttgagcctgggaggtggaggtgggagtgagtcttgatggcaccactgcattccaacctgggcaacagagagataccctgtcaaaaaaaa

SEQ ID NO: 62605 - DNA, 201 bp, Homo sapiens
tggattgcttgagcccaggaatttgagaccaacctgggcaacgtggtgaaacctgtctgtacaaaaaaatacaaaaattagctgggggtggtggcacatgsctgtagtcccggcaactccggaggctgaggcgggaggatggcttgagcctgggaggtggaggtgggagtgagtcttgatggcaccactgcattccaacct

SEQ ID NO: 62606 - DNA, 201 bp, Homo sapiens
gtagaagccggttgacaggagccagggccctggggtcatgacctctgttccctttgttggtagccgtgattaagatggaaggaggcacggagaatgatctycgcatcctggagcaggaggaggaggaggagcaggcaggaaagcctggggagcccagcaagaaagaagaaggacgggctggagcaggcctaggggacgggg

SEQ ID NO: 62607 - DNA, 201 bp, Homo sapiens
agtgggaccgtggccgtgagcgccgtagtcggggtgaatatcgggactatgaccggaatcggcgagagcgcttctcgccacctcgccacgaactcagcccrccacagaagcgcatgaggagagactggtgagatggagcggtttccctctcctcccctttgcctcagttccacctgggcctcccctttctcccctcacctg

SEQ ID NO: 62608 - DNA, 201 bp, Homo sapiens
tgtgtggggatggcagagagtgggacagctttgataggctttgaggcagaggattagcaggagcagtaattagcggtgagggtagtgaatgacagctggcragagatgctgttccgttgatacagcagagtggggagcgggaggaggaaaagacatttgggcccatagtggtgggatgaataggcttgattcttttttctt

SEQ ID NO: 62609 - DNA, 201 bp, Homo sapiens
cttgagcccaggaggcggaggctgtagtgagccgagagtgattgtgctgctgcactccagcctgagcgacagagtgagactgtctccaaaaaaaaaaaaaraagaagaagaagaagatgaggatgggggaggctggtgattggttgggaggttggtgactggtggagaggctggtgactggtcgagaggctggagtgacag

SEQ ID NO: 62610 - DNA, 201 bp, Homo sapiens
cgttcctcagtcctgtatcatccatacttgtactaccttgtcctatgaagctctgagaattttttgtacgatcagccttactgctaataaaagcacttccmcagggctcctgactctcgtgtgttacataactcctccatccttccagagtaactcctgaggtgttgctcagccctgccacttttattattgatgtcaaaa

SEQ ID NO: 62611 - DNA, 201 bp, Homo sapiens
gcagagatcaacgtggagcgggatgagaagttgattaaggtgccagtggcagcgcggggcacgtgggggctcgggcggtgagggcaggagctgaacgctcscattcacttcccttaggtcttggacaagctcctcctttacctgcgcatcgtgcattccttggattattacaacacctgtgagtaccccaacgaggacgag

SEQ ID NO: 62612 - DNA, 201 bp, Homo sapiens
cagcagaactggggggatgctagtgatcatttgtggctggggtggaacaaaagctaaaataaagacaaatctcaagggggcaaaaggtgccatttatgtcyggtgaactcctgtcccctcgctgctctttcacttgtggaaagtctcaggttacctcctctgaaggtcttctctgccttacttgcttctcttcctcccatc

SEQ ID NO: 62613 - DNA, 201 bp, Homo sapiens
gaagaaagaagactccgagaaggaagccaaaaaggtgaggtgtctgtggcctggggtcagagtgttggggctggggttctggcacgctgacttgtcccctstgctgtggctcacacagagtagcaagaagcggaaccggaagcacagtggtgacgacagctttgacgagggcagcgtgtcagagtctgagtcggagtcaga

SEQ ID NO: 62614 - DNA, 201 bp, Homo sapiens
tgcctcagttccacctgggcctcccctttctcccctcacctgtgcctaaatctttgtcatttccttttctcaacttcccatcacccatcgttactttgtcmcttgaaacccttgtctgggagaccatgctgtgtgtacccccgtctgtccatcctccatgctctggggaggtgactcccttctctgctttacttttgtgtc

SEQ ID NO: 62615 - DNA, 201 bp, Homo sapiens
gggtcttgttctgctgccctggctggagtgcattgatgcagtcgtagcagcctccacctcccgggctcaaccgagcctcccgcctcagcctcttgagaagytgggactccagggggaggccatcacgcccgcctaacttttaaaaattattattgttatttcgagacagagtcttgccctgtcgcccaggctggagtgcaa

SEQ ID NO: 62616 - DNA, 201 bp, Homo sapiens
tggaccgttttctgtggttcagcctatttgctgttggccaaataactagctgtggcttggtttttgaaattctctgcagatcagagctatagagctaagartttgagtatgaagaagcactgtttatacatgcacgaaaagcgtgcttttttgcttttttttgttttgttattgagatggggtcttgttctgctgccctgg

SEQ ID NO: 62617 - DNA, 201 bp, Homo sapiens
gatgctagtgatcatttgtggctggggtggaacaaaagctaaaataaagacaaatctcaagggggcaaaaggtgccatttatgtccggtgaactcctgtcycctcgctgctctttcacttgtggaaagtctcaggttacctcctctgaaggtcttctctgccttacttgcttctcttcctcccatcagagcctgccctcgc

SEQ ID NO: 62618 - DNA, 201 bp, Homo sapiens
ccatacccccatgccccgtatggtgctggtcgagggaactatgatgccttccgaggccagggaggttatcctgggaaacctcgcaacaggtgaggagggcrgacgcccaagctttgttgccgcctgcagactcccttttgggagccctcagctctcatcctgtacctctcacttcacaggatggttcgtggagacccaagg

SEQ ID NO: 62619 - DNA, 201 bp, Homo sapiens
ttactgccagagagtgggaccgtggccgtgagcgccgtagtcggggtgaatatcgggactatgaccggaatcggcgagagcgcttctcgccacctcgccamgaactcagcccgccacagaagcgcatgaggagagactggtgagatggagcggtttccctctcctcccctttgcctcagttccacctgggcctcccctttc

SEQ ID NO: 62620 - DNA, 201 bp, Homo sapiens
gagggcagacgcccaagctttgttgccgcctgcagactcccttttgggagccctcagctctcatcctgtacctctcacttcacaggatggttcgtggagayccaagggccattgtggaatatcgggacctggatgccccagacgatgttgatttcttttgagccgtcccccgttcctcagtcctgtatcatccatacttgt

SEQ ID NO: 62621 - DNA, 201 bp, Homo sapiens
tttttctcaccaaaatttttctggaaaacgatttttcataaaaacatgtaatgtgtttcatcttactgtgtaatttaaaaatgaaggttttggaacatttygttttaattttgaatatagtaagtatcgatagatgtaacccacataagcagaaactctttggtgtcctcagtcatttttaagagtattaaggggctgagg

SEQ ID NO: 62622 - DNA, 201 bp, Homo sapiens
aggtaaagatcctggaggtgatgcctgcggctttcctttcctcttctgccccactcgtggttctgttctgtcttcgctgtcccctctctcgaattgctctrtgtctttgtcctaatctctcagcaccttcattcttctctgtttctgttcttgctccctgcctaacaccaccttcttccctgttggtttttttagtttctc

SEQ ID NO: 62623 - DNA, 201 bp, Homo sapiens
agcgcccagctctgcctgagatcaagccagcccagccacctggccccgcccagagtaagatacgatccatgaaggtcgcatgtgccctcttccttgactayccagggactcctgtttctctttaacgtgtcaccccgagaagtttctgccccatcctcaggccatagccctagaagtcaattgtacccgtatccccctccc

SEQ ID NO: 62624 - DNA, 201 bp, Homo sapiens
actccgagaaggaagccaaaaaggtgaggtgtctgtggcctggggtcagagtgttggggctggggttctggcacgctgacttgtcccctctgctgtggctyacacagagtagcaagaagcggaaccggaagcacagtggtgacgacagctttgacgagggcagcgtgtcagagtctgagtcggagtcagagagcggccagg

SEQ ID NO: 62625 - DNA, 201 bp, Homo sapiens
tgatggggacaaggaagagaagaaagaagactccgagaaggaagccaaaaaggtgaggtgtctgtggcctggggtcagagtgttggggctggggttctggyacgctgacttgtcccctctgctgtggctcacacagagtagcaagaagcggaaccggaagcacagtggtgacgacagctttgacgagggcagcgtgtcaga

SEQ ID NO: 62626 - DNA, 201 bp, Homo sapiens
agattatttccctgacaatatatgattaggtttcttgtcactgttttgcctaaaatctcagagttcatagggcggtgctgattggattgattataagatgyggttattgaccttagggtgttacagtgagcttggcatgggggatcagaatggcagtggatgtattctgtaaatgagtatatatagtggaagttataaaga

SEQ ID NO: 62627 - DNA, 201 bp, Homo sapiens
cagcgtgtcagagtctgagtcggagtcagagagcggccaggctgaggaggagaaggaggaggccggtagggtttcttttctgctttaaagtgcgttctccyaatgcgggtggggaggtgagaggttggcgacattgacgggagggtgggtggcttttaggggaaagcttctgtatcctccccaccacaatcagtaataaaa

SEQ ID NO: 62628 - DNA, 201 bp, Homo sapiens
gcccagctctgcctgagatcaagccagcccagccacctggccccgcccagagtaagatacgatccatgaaggtcgcatgtgccctcttccttgactacccrgggactcctgtttctctttaacgtgtcaccccgagaagtttctgccccatcctcaggccatagccctagaagtcaattgtacccgtatccccctccccgc

SEQ ID NO: 62629 - DNA, 201 bp, Homo sapiens
agtcagagagcggccaggctgaggaggagaaggaggaggccggtagggtttcttttctgctttaaagtgcgttctcctaatgcgggtggggaggtgagagrttggcgacattgacgggagggtgggtggcttttaggggaaagcttctgtatcctccccaccacaatcagtaataaaaatgcaccaactccttcctacccc

SEQ ID NO: 62630 - DNA, 201 bp, Homo sapiens
atctcaagggggcaaaaggtgccatttatgtccggtgaactcctgtcccctcgctgctctttcacttgtggaaagtctcaggttacctcctctgaaggtcktctctgccttacttgcttctcttcctcccatcagagcctgccctcgcaaaacccgatcttgaagaatatcaccgactacctgatcgaggaagtaagcgcc

SEQ ID NO: 62631 - DNA, 201 bp, Homo sapiens
agccctcagctctcatcctgtacctctcacttcacaggatggttcgtggagacccaagggccattgtggaatatcgggacctggatgccccagacgatgtwgatttcttttgagccgtcccccgttcctcagtcctgtatcatccatacttgtactaccttgtcctatgaagctctgagaattttttgtacgatcagcctt

SEQ ID NO: 62632 - DNA, 201 bp, Homo sapiens
ggaaggtgagctccaggttcccctttgttcccggctgcccctggccttggtcctccagccccttgccaccatccttccttctggctcccttgccaaccttycttcctctgttcccaaaccacagtgctggagtggcagaagacttttgaggagaagctcacgccgttgctgagtgtgcgggagtcactctcagaggaagag

SEQ ID NO: 62633 - DNA, 201 bp, Homo sapiens
ctaagcgcccagctctgcctgagatcaagccagcccagccacctggccccgcccagagtaagatacgatccatgaaggtcgcatgtgccctcttccttgastacccagggactcctgtttctctttaacgtgtcaccccgagaagtttctgccccatcctcaggccatagccctagaagtcaattgtacccgtatccccct

SEQ ID NO: 62634 - DNA, 201 bp, Homo sapiens
atggtgctggtcgagggaactatgatgccttccgaggccagggaggttatcctgggaaacctcgcaacaggtgaggagggcagacgcccaagctttgttgmcgcctgcagactcccttttgggagccctcagctctcatcctgtacctctcacttcacaggatggttcgtggagacccaagggccattgtggaatatcggg

SEQ ID NO: 62635 - DNA, 201 bp, Homo sapiens
ccacctggccccgcccagagtaagatacgatccatgaaggtcgcatgtgccctcttccttgactacccagggactcctgtttctctttaacgtgtcacccsgagaagtttctgccccatcctcaggccatagccctagaagtcaattgtacccgtatccccctccccgcccccgcagtaattcatgtccctgtccgtgttg

SEQ ID NO: 62636 - DNA, 201 bp, Homo sapiens
gggaaacctcgcaacaggtgaggagggcagacgcccaagctttgttgccgcctgcagactcccttttgggagccctcagctctcatcctgtacctctcacytcacaggatggttcgtggagacccaagggccattgtggaatatcgggacctggatgccccagacgatgttgatttcttttgagccgtcccccgttcctca

SEQ ID NO: 62637 - DNA, 201 bp, Homo sapiens
ggcgccgctagttaaatcttgagctctgtttgaccaagcggccaaggtaaagatcctggaggtgatgcctgcggctttcctttcctcttctgccccactcrtggttctgttctgtcttcgctgtcccctctctcgaattgctctgtgtctttgtcctaatctctcagcaccttcattcttctctgtttctgttcttgctcc

SEQ ID NO: 62638 - DNA, 201 bp, Homo sapiens
acctgtgtgtgtgtgccattcaccctcttaactgtgagggtcaggaaaatcatcatgttagtttacattaagcatggacttctgacacacagatttgcacrcagatatttgggggaaatcacgagtgggtttgatgagcgtgtccaatactgtctcttctccagtctttcctgtatatgaatcaggatgcacgggtgggaa

SEQ ID NO: 62639 - DNA, 201 bp, Homo sapiens
ggaagggtggctcctgggccttgaagatcctagagctttgcctgtcctgtgtgtgagatggctggtcttggggcgacctgtctgctgcttcataggatgcrttgtgtgttcgtctgtcactgcgtggccactgtggcagaggccaggcaaggcacatttcagtgatttgtgatccaggcagccatggctgtgtggatggct

SEQ ID NO: 62640 - DNA, 201 bp, Homo sapiens
tacactgagtcagcccaggttgtcggtgactgggcagggtgcctcccagtgcactgtctaaaatcccttcccagctccaggcctcgccctggaacactccsggtgggccaccagggactgacacacgccagggtcatgggtggagggcagcttagctgcttggctctggaagaggacttggaatgtttggctttgtaattt

SEQ ID NO: 62641 - DNA, 201 bp, Homo sapiens
acaataccaggtcaccccgagcaccttctgtgtgctgggcactatgctgttgccacaagaagacactattattcttattcccatttgcaaatgagcagttkgacacagtggctttctgaggtcctgcagcttctgggagggcaggactcacatttgggcaagtgtggccgggcggccatgctgcttcccatttccctgctt

SEQ ID NO: 62642 - DNA, 201 bp, Homo sapiens
gagcagactcaggagccaggggacacggctccaattctagctctgtgaacacactggccgtgtgccaccctcagcaagttacttaatctctctctcttaggaaaaaaaaaaaaaaaaaaaagaaatccttgcacatgctgtaaaattcaaaagatgagagatgttccttctttgttccccagccgcccagggcccctccct

SEQ ID NO: 62643 - DNA, 201 bp, Homo sapiens
tttcttcaatattaatattaaataatattaaatatttaataattgggcctaaggtgggtatttcacatttttgtttattgaaaaagctgttttataaaacraaacaagaaaaagctgtttttaatcttttatgtttggaaaatttgtgaaaatccatgctggttgtcaatttgaattggaattttatgtgggcagtgtaag

SEQ ID NO: 62644 - DNA, 201 bp, Homo sapiens
gtgaggttttaaatttgagcaggagactttagcggtatgtattcatttgtacatttaacttcagcttggaaaagtttacactgaatttcatcttgtttttycttacagtgaaaaatgtgaggttttacaatattctgcaagggaagctcaagattcaaaaaaggtaagaaaatggttgaaaagttgaaagttattcctaca

SEQ ID NO: 62645 - DNA, 201 bp, Homo sapiens
attggctccatccctggcggtgagattcgggcgggctgtgtgttttggctagtccccactgctccctgcggggagtgagtgatgtgcatcagactgcatcygactgtttctcttttcaggcttcaagcactttcctgaagcggggattcattatccagacagtaccacaggagatgggaagcccctcgccaccgactataa

SEQ ID NO: 62646 - DNA, 201 bp, Homo sapiens
tggctggtgctggccacccgggaatctcatcctgcttgggtctgtcctccaccacccaccccctgctgcttctcatcactgcaacgcccagttcctggtaraggcctcatatccagcgtgcactcaggagatgtatctggagtgagtgactttgatttcttttagggctataaattctacaaaattcagagatgattttgt

SEQ ID NO: 62647 - DNA, 201 bp, Homo sapiens
ggggcaaaggcagagggccaaggcggtcagggagggtcctggtggtgcaggtgagagtgctggtgctatgggcgggggcgctgagagtaggcactgtctcttttcccgagagcccccacttaacaggggcattgttgcccctccttgcccagccaagttgcttcttgctttttaggttttcaaaattaagcagactattgc

SEQ ID NO: 62648 - DNA, 201 bp, Homo sapiens
tgggagacaagtggatctggctgaagtgaacgggccgccttctgctccagctgcatcacagtgatggccaagctgcatcagccgcactctcctggacgccrtatagctttaagatcgggggagggtaaataatgcaaaaattgcacagtggaagaaggggtctcacaaaaagcaatccatcctgtagtataggtaatggag

SEQ ID NO: 62649 - DNA, 201 bp, Homo sapiens
gtcagttagattcccactggtcttaacaaacatcactgttttatcacctgaaagcagtgccagtcaaacccatcatcacactcccctggccatgaggtttygagtttctttcaagtaattcggtttctacgatctgaaaattacagatgtcacagaatcttgggtcatccactctaccatttttattaaagagatggaaaa

SEQ ID NO: 62650 - DNA, 201 bp, Homo sapiens
gggggcaaaggcagagggccaaggcggtcagggagggtcctggtggtgcaggtgagagtgctggtgctatgggcgggggcgctgagagtaggcactgtctcttttcccgagagcccccacttaacaggggcattgttgcccctccttgcccagccaagttgcttcttgctttttaggttttcaaaattaagcagactattg

SEQ ID NO: 62651 - DNA, 201 bp, Homo sapiens
tctgtgtctcctgtctttgagcagttcctcctgtgttagcccttctctctgtcacgtgctgatacatggtgatgcttcactgtttttgtatttgttgcttrtgaatgcataaagagcattgcagccttttccaaaatatttgtattgtgggattttaagaggtacaatgagctaactctcataggaatgtgtattttctgg

SEQ ID NO: 62652 - DNA, 201 bp, Homo sapiens
gtttttaactcctgttttaggaacagatacagtctctgttcattgttaaagtagatcttatctgacagctcaagccgtatggattgatgggagccacttgwtgtaggggtcatttgtcacacattgaagaatgagtaccagatgtactctatgcagtatgcattattttaagtgctgaattgtagaccaagatcaaactgc

SEQ ID NO: 62653 - DNA, 201 bp, Homo sapiens
acagccgctcagctctgtgctgtgtgaaagcaccaccagccagtgtgtaaatgcatgggccaggttgtgccagtgaggcctcatttacagaagcagtcagyggcgagatttgatctgtgggctacagtttgccgacccatgcatgaggcagtaaaaggccaagagcctggtataaattcataacgagaaaccaaggctctg

SEQ ID NO: 62654 - DNA, 201 bp, Homo sapiens
tgacggcattttcatctgtagactggggtggctggagccagtggaaagctggaatctgggagctcagaggaagtactgttgattaatgaaagaggaggccraagcaagccaggtgaccattctgtggaggaggcgcctgcttctggctgcttgtgtgtcctggtgttgccggtactccacctgtgagcttgccgcccgcaa

SEQ ID NO: 62655 - DNA, 201 bp, Homo sapiens
caagtttttggcaattatgaataaagctgctgtaatcgtgtacatgcagatttctttttggaaatacatttttatatcatttgggtaatacctggaagagygattactcatgtagtaagactagttttctaagaagctgccaagccatcttccagagtgactgtgccatttgactcccaccagaagtgaaggctctccttg

SEQ ID NO: 62656 - DNA, 201 bp, Homo sapiens
tataaggttctatggattttttctttgtgctataaggttctataggttttgacacgtgtgtaatagcatgtctccaccattataggttcgtacagagtagmttcactgccttaaaaaattcccctctgctttacctattaaacccttctttttctccaacccctgacaaccacagatctcattaacatttccatagttgcc

SEQ ID NO: 62657 - DNA, 201 bp, Homo sapiens
gggttgtggtttgtgtacctgtggcatccttgcactcacaggagacacctgccacagatcatgtgctcaccagcattgctgaaggaactcatgaagtacasgcatctgccgggtagacattgaactatgagctggggaaacattcattcacgttaaacagaatgcaccaatgcctttttcccccacagctgccgggccgca

SEQ ID NO: 62658 - DNA, 201 bp, Homo sapiens
agtagtgagctctcatatctcacatccagtttccattttattaacttcttctgtgagtatggtacacttgttataattaatgaattaataatacttactgkgtttttgttttttgttttttttttttggaaaccgattgtcactctatcgcccaggctggagtgcaatggcatgatcttgactcactgtaacctccacctc

SEQ ID NO: 62659 - DNA, 201 bp, Homo sapiens
actaaagcccacactttgaattattcagattaccttagtttttccctaatgtcctttttctgttccaataccccgtctagaatatcacatgacattgggtmctcatgtctccttaggtacctcttggttgtaacattttctcagactttgtttttaataaggagtgctggtgaggtattttgtagactctccctcagttga

SEQ ID NO: 62660 - DNA, 201 bp, Homo sapiens
ccttaggtacctcttggttgtaacattttctcagactttgtttttaataaggagtgctggtgaggtattttgtagactctccctcagttgagggttgcccratgtttctctagcgattagattggactgtgtgttttggggaggaatccacagaggtgaagcatcaggggcacttgctgtcagtgcagcctggcaccatgg

SEQ ID NO: 62661 - DNA, 201 bp, Homo sapiens
cttaggtacctcttggttgtaacattttctcagactttgtttttaataaggagtgctggtgaggtattttgtagactctccctcagttgagggttgcccgrtgtttctctagcgattagattggactgtgtgttttggggaggaatccacagaggtgaagcatcaggggcacttgctgtcagtgcagcctggcaccatggc

SEQ ID NO: 62662 - DNA, 201 bp, Homo sapiens
cccgatgtttctctagcgattagattggactgtgtgttttggggaggaatccacagaggtgaagcatcaggggcacttgctgtcagtgcagcctggcaccrtggccctgaccgtgggctcctggctgaggtcgtgcttgctgggtctccactggaagctgctcttcctctttccagaaagccccatgcacaccacagcctt

SEQ ID NO: 62663 - DNA, 201 bp, Homo sapiens
ctgactgtttagaggattttgtttaaggaaattcggttgcttgatattaaaaaatgatcagttgaaattaaatagtaataaataataatgaccatttctgkaaattcatagaattccttttgtccatcagagacatcagcagcagttctcattgcatttccttctggaaacagcattgtggggatacctggaggtgaatga

SEQ ID NO: 62664 - DNA, 201 bp, Homo sapiens
caaccatgcagggctccgtgtcggcatggtgtggactcgggtgctctgatcatcccctgtgtttgcgtctgaccctgtgtggttgcattcccttgatggartgggaagtatgtaatttgtagtgctgaggacattcgtctgtttgattttctggtgttttcaatgacatgcatgttcagcagagaaagatgaataaacact

SEQ ID NO: 62665 - DNA, 201 bp, Homo sapiens
taatctaaaagtagcttactgaaatgattggctctctagaaagtcttttgaaaggaatctagcaaatcttccattagaaagtaaaacaaacaacaaaaccygctttccttgtcttttttttttttttttttttttttttgagtcagagttttgctcttgttgcccagactggagtgcagtggcgcaatctcagctcactgc

SEQ ID NO: 62666 - DNA, 201 bp, Homo sapiens
cattgaattgtttcctctgctacatctctttgaatctggatcagttcctcaggcttttcttggcattcaagaccttgacatttttgaagactacagaacasttaccttgctgaatatccctcaatgtggttttgagggatatttggcatatggttcccatttgtcccatcactgcttttgttacctttattgcttgttaag

SEQ ID NO: 62667 - DNA, 201 bp, Homo sapiens
caatatcaattgtgtttattttcatttgagtaccatttctcaattgagggactcaagtgataattatgaccaattttctaacataattattgtaaacatgycgcttaccagtgacattcattttatccataacctgaccaaattattggtttagaacatttctgcaccatctcagttacgtgttgccagtgtctaattatg

SEQ ID NO: 62668 - DNA, 201 bp, Homo sapiens
tgtgccctgggccatcttgccttccctcctgccgtctgttcaggcttgaatcctggtggaacctttgactcctctgtcaaccataatcctagcttgaaccytcctttttccctgctgacccccttatcctccccaaagtcacaccctgcaggtcagtgtgccactttcagtgacttctctcccttgtctctaacactgctg

SEQ ID NO: 62669 - DNA, 201 bp, Homo sapiens
gtggggcatctcacctctcgggctgcaggagctagagctgctgctctctgcatcctctgtgtggtcctgtgccctgggccatcttgccttccctcctgccrtctgttcaggcttgaatcctggtggaacctttgactcctctgtcaaccataatcctagcttgaaccctcctttttccctgctgacccccttatcctcccc

SEQ ID NO: 62670 - DNA, 201 bp, Homo sapiens
gttccacagcacttctgtggggcgggactccctcattttacaaggaggagaccatgactcgagagctcgagcctgccaaggttgtgtgactgtgtggggcrtctcacctctcgggctgcaggagctagagctgctgctctctgcatcctctgtgtggtcctgtgccctgggccatcttgccttccctcctgccgtctgttc

SEQ ID NO: 62671 - DNA, 201 bp, Homo sapiens
gatcatcaggcattagattctcataaggagtgtgcaaactagatcccttgtatgcacagttcacaatagggtttgtgctcctgtgagaatctcatgctgcsctggtctgacagcaggtggagctcaggcagtaatgcgagcaggggaatcggctataaatacagatgaagcttcactggcttgcttgctcacctcctgctg

SEQ ID NO: 62672 - DNA, 201 bp, Homo sapiens
cagtttccattttattaacttcttctgtgagtatggtacacttgttataattaatgaattaataatacttactgggtttttgttttttgttttttttttttggaaaccgattgtcactctatcgcccaggctggagtgcaatggcatgatcttgactcactgtaacctccacctcccgggtttaagcgattcttgtgcctc

SEQ ID NO: 62673 - DNA, 201 bp, Homo sapiens
ataaagagcttaatggaacaaaacaagagtccagaaacatgtatgcacctgtgtgtaagtatcttcagtttggcaaagttagttccttaaaggataattayaaaaatgaagtagaggaaaattgtttcctaaatggtactgaggcaactgagcatccatttgttaaaaaacaagttttttattttgtattttatatattaa

SEQ ID NO: 62674 - DNA, 201 bp, Homo sapiens
accatgtcattgtgcggtgatgaccattcatagtcttgagttggtcactgcaggtgtttttcatataaagtagagggagaaagaaacaacctgccacagarttcctggagtccccgcttctgtggtgagttcggagacccaagttcactttggtagcttccttggttcccacagcctcctcccctctgccagcagctcagc

SEQ ID NO: 62675 - DNA, 201 bp, Homo sapiens
gtcatccactctaccatttttattaaagagatggaaaattgaaagttggattagttaatgggaaagatttacatgtaaagataacagttttccttaaattmgtgtgttttgtgaaagtctagtaaatcttggtgtagttttcagggaactttatgaataacagccagacaaacattaaaacatctgaagaagaataacgaa

SEQ ID NO: 62676 - DNA, 201 bp, Homo sapiens
actagtcattctacttagtttgttaattcctgcccccctgttaaaatagtatttgcaaaatcagttttctagttagtggaatggatactgaagggtgagcraggtaggcacactgtggggtcctcatgtcagactgaggagacgggaagggtcaggtcagcccttagctggctgtgtgacttgggacaagtcactttatct

SEQ ID NO: 62677 - DNA, 201 bp, Homo sapiens
actgaaatgtcttgtgtgaagccttctgtaactccttgcacacacccctgagagagtgcaggccttccccaggagtaggaggagatggagggtttttattwctaacaaaaggccccaccctggtgagagtggcttccttttatctggccacccgacagacagcttgtgctagcagcaatttccatcagatgctgagcggaa

SEQ ID NO: 62678 - DNA, 201 bp, Homo sapiens
ctaatagttactaatgcctacaggaaccagagtggtcacaatgtgctgctgtgtgattttgtgtttttcagagaggaattcatagcagtgtgcagtgcaarctgcgctatggaatgtggcatttcctacttggggataaagcaagcaaaagactgacagaacgcagcagagtgataactgtagatggcaatatatgtactg

SEQ ID NO: 62679 - DNA, 201 bp, Homo sapiens
ctgaaatgtcttgtgtgaagccttctgtaactccttgcacacacccctgagagagtgcaggccttccccaggagtaggaggagatggagggtttttatttmtaacaaaaggccccaccctggtgagagtggcttccttttatctggccacccgacagacagcttgtgctagcagcaatttccatcagatgctgagcggaaa

SEQ ID NO: 62680 - DNA, 201 bp, Homo sapiens
ggaggtgggaagaccttctcatcggtcttcaggtacacgtgtcaggtcactggtttgctgcaggggagcaaacagcatttgaggacattccacagaacgtrtgactattagagcagaaggtagttggcagccggttatttcctggagcaagtggaggccatggatgccttttcatggcagtggttcttagaagcccattac

SEQ ID NO: 62681 - DNA, 201 bp, Homo sapiens
tgacggtggtattcaagtcatcggtatccttactgattttctctctgctgggtccatcggttactcagagttggggtcatcggtatctttactgattttcyctctgctggatctgttggttactcagagttggggtcatcggtctccttacggattttctctctgctggatctgtcggttactgagagttgggtttaaatt

SEQ ID NO: 62682 - DNA, 201 bp, Homo sapiens
taatgtgctacattagagtagaaaaaataagaacgtgaagaagaaatagcaaaaggagaaaattaccacagatttacagaacaatatgttttaagagagaygttgagaaagattcacgtggccgtcctcagcgtctcaaactcctttgaagggagatttgagcttaggctgttgatgacataagatgcaaaagcaaaataa

SEQ ID NO: 62683 - DNA, 201 bp, Homo sapiens
tgtgagatgggtctagatttgaatttttctttatgccagtgctatttgcatcttgttggtaggatcttattccttgttggtaattcccccattgcttctctctgtagacattttaaacctagttattttatgctctgtctctggagcgctgctctggacgctgtctgatcttgttcgttgtttcttctttttctcacccat

SEQ ID NO: 62684 - DNA, 201 bp, Homo sapiens
tgttctccataactcccatcgtaccctggtagggctgagtttgctgcccagcctcattagcatggggcactttttagaagctgagtttccagaagccaacmaagggccagcctcgcaaggaggccctgccacagacagcagcataggcctgctctgtgtgtggcgaaggaaaggctttctgagagcgcaagagctgtgctt

SEQ ID NO: 62685 - DNA, 201 bp, Homo sapiens
gtgtcattcaggttgtgcacattgtttttcttctgacttccagaaataaaagtgtttccatgggaatttccccatcgtacgtctatgtgcgtgcgggcacrtcgaaactgcacacgtgcacacacgctgctctgggccctgtttggtgtggtgtggtttaattgaggcttacattatgctgaagagtttttctaaaggcct

SEQ ID NO: 62686 - DNA, 201 bp, Homo sapiens
tttcttctttttctcacccatggtggcttcttttcttgactgtgttggagactttgggtacagagcttctgccctgtggggctccatccatgggcatttgrtgagagtgggtccctcctgagtcaggttgccagatgaagtacaggatgccaaggtaagcttgaactgagagcagctagtattttagtataagtatgtccc

SEQ ID NO: 62687 - DNA, 201 bp, Homo sapiens
ccacgactggcagtgcagtaggtttgtcaatgccacatcaccgcagacacgggagtcatgcgctgagccacggcgctgtgacagctgctgtgataggaagygttcagctccactagaatcttgtaggaccacattgtatatgtgacctgttgtggatggaaacgccatgctgtgcataactggaaaccggcaggaacctgt

SEQ ID NO: 62688 - DNA, 201 bp, Homo sapiens
gaaaccctgttttggtgctggttctttctgtagccattctgtggaggacctgtctgaattagaaagtctacattttatatactcaataggtatttacccartgaacagtcccccagaatgcagaattgattaaatccccaaccccgaaggcacagaagggaaacctggctgatcaaagaattcttgccttttaatttaatc

SEQ ID NO: 62689 - DNA, 201 bp, Homo sapiens
acagggatatgttctaagaaaggtgtcgttaggcgatttcatcatcgtgaaaacatcatagtgtgtgtttacacaagcgtagatgctataacctgcacacytaggtggtgtggtggagcctgttgctcctaggccataaacctgtacagcatggtacagtactgaatactgttggcagttgtaacacgacggtaagtattt

SEQ ID NO: 62690 - DNA, 201 bp, Homo sapiens
ctggtggtggcctttcctcaccggacggtggagccctgggcctctgctgtgttgcctctcctgcagagttgtgtgtgtgactggaggagaggggtggagcsagttcagccagcactggggtctaactataaagcacaatagagacaggtagtggcagctgggtggggtgggctgtggggtggggttctaagataggaattt

SEQ ID NO: 62691 - DNA, 201 bp, Homo sapiens
atttttgttctttaatactaagctttttttcttttactttttaagtagtatttttctgatcttagaaataatttacattaattatcctcaattcacgcttyatggaaatctacagtgaagttgaacgaacccacctcctaaagacaaccgtgttgaagatgctattcatatttttttctgtgcatgccccagtgcagttga

SEQ ID NO: 62692 - DNA, 201 bp, Homo sapiens
aggaatcccaggcatacttcctcatggatcttttcctgacccttatgtttaatttaatttactgatggatggatgagcccagaaagggttacacaggagcrcacttctcagggagtggtgtgacgctggggaggctcgcccaccctgtgtctgagctaatttctgaaatctgtttggagcttatatattgaaacaaagccg

SEQ ID NO: 62693 - DNA, 201 bp, Homo sapiens
ggacagggatgcgtaggtgatggagaccaagaggagaaaataaaagtatatttctgagaagaaaatgattgttgtaataccagagactcaccatttcatamccaggtcagaaggatcccttgagagggactcagccactcacctgtcactgtgcccctgggcaaggggcctaacctctctgagcctctgtctccttgttgt

SEQ ID NO: 62694 - DNA, 201 bp, Homo sapiens
atcccaggcatacttcctcatggatcttttcctgacccttatgtttaatttaatttactgatggatggatgagcccagaaagggttacacaggagcacacytctcagggagtggtgtgacgctggggaggctcgcccaccctgtgtctgagctaatttctgaaatctgtttggagcttatatattgaaacaaagccgttat

SEQ ID NO: 62695 - DNA, 201 bp, Homo sapiens
aacacttcccaccaggccccacctctgacactgtgagttacatctcagcatgagatttggaggggacatccacactctcatttgatgaacatgctggtgayatgggtacacagacgagtaaagaaagaccttttcacagcagagtggatcttagattttcatatgaatagaagggtttatgatttttggttttgttgatcc

SEQ ID NO: 62696 - DNA, 201 bp, Homo sapiens
gatcacttcaaaaattatccttatatttgtgttaacagtaagaagatacgtacttgtagattattgacacatgcatggaagtgtttagatagaatgcatawggaaagctagcagcagtttcctctggagagggaacttgtagtcttacaattaatgcagtcttacaaaatacagcaactttatgcccttcacaaactttct

SEQ ID NO: 62697 - DNA, 201 bp, Homo sapiens
tccttgtctttctgagccattactaggagatggaagtaaagcacaaagcactgcttttggcctctgaataaatattctgcatcctggagacaatggccaarggttacagtgcctactccaggtggacaacacatttcaacctgagggccgtgagtttgctgattgacagggcgaccgaccagaaattagaggggtcctctg

SEQ ID NO: 62698 - DNA, 201 bp, Homo sapiens
ttaaaagattttccgggactacatgtaatgttgccaaattaagcatagatggcgctgttgctctctatactacacatggtccaggccactgattgctttcycattttctagcattttcttaggtttttcaaactgtaaagagaaccatgtcacctccctacattgatatttgttaacatttaaaatatgaacttcattttt

SEQ ID NO: 62699 - DNA, 201 bp, Homo sapiens
gcttcttctctggaccttggcatccagggccctccctgccctgttgcctttacagcctgatgttgcctttgtagaattcttttctacattgtcccctgtttggttgttcaggaggggacagatgtgttagccgttttaacagttacatggtgagctcacctagcagtttttcaatcactgtgttttatgtggttttgtctg

SEQ ID NO: 62700 - DNA, 201 bp, Homo sapiens
tgcattttataaacactaaacttcaatttatatttttattggctatttatttgctctttgtgaattttcccttcatatttattaactttttcgaagaaccwggtttttgttttgatgatttatccagttgttttctgttttattgatgtataccctagttttattattttttctctgctttctttaggcttcacttgttct

SEQ ID NO: 62701 - DNA, 201 bp, Homo sapiens
aggcggattcagaagaaaggagatgtaatgcagttttcaatcaaaggccaagcatctctattttgaatgcagatcagcactaaaagccctgttttaatagyatttatactaattcctaccagtcctcacgaggagggtgacacacaccctgttcccacttgagagagggcatctgcaggggtggaggggagaccccatggc

SEQ ID NO: 62702 - DNA, 201 bp, Homo sapiens
tgcccggtgtgagttgtaagaaaatggtggtcagtgattgtcttcgcattttatatacgcacaggtcaaagagaatgaactctaaatgtttcccagtttgrtttttctgcttctgtttagccacatgaaatgaagatcacctctgcctatctacaggacattgagaatgcctataagaaaacctttctccctgagatgagg

SEQ ID NO: 62703 - DNA, 201 bp, Homo sapiens
tagcggtatgtattcatttgtacatttaacttcagcttggaaaagtttacactgaatttcatcttgttttttcttacagtgaaaaatgtgaggttttacartattctgcaagggaagctcaagattcaaaaaaggtaagaaaatggttgaaaagttgaaagttattcctacatttgattcatgtgtaaggttcttgcaaat

SEQ ID NO: 62704 - DNA, 201 bp, Homo sapiens
tttggccattcccgtgttcaacatatacttatttactcagctccaacactgctagctcccagtgtcagtgttagctgagacacagaggtacacaagacagrgtagggaaggcctttctgagaaagaatcgtcacctctgagatttcagagacaagaagaggagcactgagtgaccagcctgacatgtagcgagttttgtaa

SEQ ID NO: 62705 - DNA, 201 bp, Homo sapiens
gtctctgttcattgttaaagtagatcttatctgacagctcaagccgtatggattgatgggagccacttgatgtaggggtcatttgtcacacattgaagaakgagtaccagatgtactctatgcagtatgcattattttaagtgctgaattgtagaccaagatcaaactgcagctttgtgatggacttggatcttaaaagtt

SEQ ID NO: 62706 - DNA, 201 bp, Homo sapiens
tactcatcaccaaggagatggcccaagccattcatgagggatcagcccgcatgatccaaacacttcccaccaggccccacctctgacactgtgagttacakctcagcatgagatttggaggggacatccacactctcatttgatgaacatgctggtgacatgggtacacagacgagtaaagaaagaccttttcacagcaga

SEQ ID NO: 62707 - DNA, 201 bp, Homo sapiens
gtgcttgtggaaagagggaaaagatgcaagagaggaatgggaccgttgatggagcagggatcccagaggcaggggggcctcttggctcctcagagatcccrgttcaccaagcagggatcccagaggcagggaggcctctcagctcatcagagatcccagttcaccaagcaggcgtggccaggccagatcactgtttgtttc

SEQ ID NO: 62708 - DNA, 201 bp, Homo sapiens
ggattatttcagtttcttcatgttcataatacagtaaagagcatgtagtaccccttcttgttcaatttcaggttacttaaggtataaaagtggtcagagtrtatgaacgcattttacagctattgagtttttgcaaaatgattctccggaatatgtgtaccagtattcatacttggacctggttctctgaatttccctata

SEQ ID NO: 62709 - DNA, 201 bp, Homo sapiens
tggaaaatggaatacagggaaagagcctcctgaaagtgttaaacttatcagagccctgtgaatgtaatgagtccaaaatgccttgaatttagagatccagygagggaaactccgttcgcattgtacagtagaggggattgcagaggatgagcattggaggggtttgttcctttttctgttaggcgctctttcttcttttgc

SEQ ID NO: 62710 - DNA, 201 bp, Homo sapiens
ttggatgtaaattaggaagttggtgcctacagatggcagctctgttcttggccctgtgatgttggtgttcttaggccgttggtgcttaccttctttctctrcctgatgggatgtgagtgatacagtagtctcctaggatgaccagagggacagctggctcactgcacatgtcactaaaagttcactgatcaaaatgtaaac

SEQ ID NO: 62711 - DNA, 201 bp, Homo sapiens
cctgagcctgccctgtgctgcttcctgcctctacccaggatgctctgtgcagactgcaccaacactttgcctctcgagggcctggaggcacaaggatggcmggggcactcaacttccctctcctcaacgtttggatgtaaattaggaagttggtgcctacagatggcagctctgttcttggccctgtgatgttggtgttct

SEQ ID NO: 62712 - DNA, 201 bp, Homo sapiens
ttggccagccatggtggctcacgtctataatcccagcactttgggaggctgaggcaggaggatcgcttgagcccaggagtttgagaccagcctgggcaacrtggtgagaccccatctctactaaaaatacaaacatcagccaggtgtggtggcatatgcctgtagtcccagcaactcgggaggctgaggtgctgaggtggg

SEQ ID NO: 62713 - DNA, 201 bp, Homo sapiens
ctgtatgttcttgcctttatgaaattcaccttacagaaaggcactaggatcagtttacctaaacatgcgggagacggaaggccagacgtgactgctttagrttcctcatgacattcagaccttacttggaactcagtttggtatctagttgtgttaaaatacaaattttcagtttataagttacttaattaagtttgaaag

SEQ ID NO: 62714 - DNA, 201 bp, Homo sapiens
tttgttaaaaaacaagttttttattttgtattttatatattaagcataaattactaaaaacaaaacgaggtgtaacaattctagaagaaaatacaagtttyaggatctggtcttgaagtgtgagtggtgcccgtgtaacagagaagctttgcatagttggctgctggggtgacaagcgtgcttcagttgcctctcagcatt

SEQ ID NO: 62715 - DNA, 201 bp, Homo sapiens
agtccaggaaaggccattgattttcagttttttcttattggaaggatggaaattacagcttccagccttcaccctttggagctgaagctggaagttccctstttgttttttaaaactctgttaacattttggactagatgcctatatttgtgtgtgtgtttgtaaatttacctaaatgatatactctattattcaaaactt

SEQ ID NO: 62716 - DNA, 201 bp, Homo sapiens
gcatgtgcgtctgtactcacttggcctgaggttcataacactctttgagcctttggctggtgttcattgtctgtagcacttttttttttttttttttttttgagacagaatctcactcttgtcacccaggctggagtgcagtggtgtgatctcagctcattgcaacctctgcctcccaggttcaagcgattctgctgcctc

SEQ ID NO: 62717 - DNA, 201 bp, Homo sapiens
acctgtgtggagagaagctctggttacgaattcccagtggagaatggtttcaccactgggtgccagctggggtctccttgctggcaggaggccttctcccygcactgaggtgtggcccttcaggagtcacctcacagggacaccaggccgtgtcttgtggctctctgcagctcttgggcgtcccgagggcaccgcggcttc

SEQ ID NO: 62718 - DNA, 201 bp, Homo sapiens
taggtgttagcagcaccaacccaatacttagaggtattttttcttccaaacagctcctgaatcccctggtctgatacttaatttattgagtgccattattratttaacaggcattttgcttccactatgtgcaacaccgttccagatttaagagatatagtgtcagataaaattcttgatgtctttgaaaatgtgttttag

SEQ ID NO: 62719 - DNA, 201 bp, Homo sapiens
tgcatgtgcgtctgtactcacttggcctgaggttcataacactctttgagcctttggctggtgttcattgtctgtagcacttttttttttttttttttttttgagacagaatctcactcttgtcacccaggctggagtgcagtggtgtgatctcagctcattgcaacctctgcctcccaggttcaagcgattctgctgcct

SEQ ID NO: 62720 - DNA, 201 bp, Homo sapiens
ccttctccccgcactgaggtgtggcccttcaggagtcacctcacagggacaccaggccgtgtcttgtggctctctgcagctcttgggcgtcccgagggcascgcggcttcagctcaccactctggcttttccactcactcttccttcttagccctttgtgatttcttgcggagctcagctgtacatgtagaagcatttcca

SEQ ID NO: 62721 - DNA, 201 bp, Homo sapiens
ttacatcgatgtgcccgttccagaggtccagaggcggattcagaagaaaggagatgtaatgcagttttcaatcaaaggccaagcatctctattttgaatgyagatcagcactaaaagccctgttttaatagcatttatactaattcctaccagtcctcacgaggagggtgacacacaccctgttcccacttgagagagggc

SEQ ID NO: 62722 - DNA, 201 bp, Homo sapiens
cagcactaaaagccctgttttaatagcatttatactaattcctaccagtcctcacgaggagggtgacacacaccctgttcccacttgagagagggcatctkcaggggtggaggggagaccccatggctcggcctggtgccacagcctgcgggcctgccgcccaccagtgctctgcggtcccactgtggtccccgagtcccc

SEQ ID NO: 62723 - DNA, 201 bp, Homo sapiens
ccctgggctgtcttggcatcactggctgaatgacctgggctttcatctcagtctctcttcagatttcaaactcctgaaggagctgggtttttctttttttktgtgtgtcccagaattctcctggcacccaaacaaaaccgtctgtatccacactgtatcctgggccagaaagctggaggctggctgtgccaccctcccccc

SEQ ID NO: 62724 - DNA, 201 bp, Homo sapiens
tcctatctttctcccggaagtcaccattggagctcatcagactgaccgtgtcttacatcagttcagagaggtaagactgtggaaatggagaaagctggccrgtggatgagtctgcagcacctggggacaatgcagtcacttctccagaaaggagtttttgttgttgctgtgttttgtttgttttagtgaaggagcctcttt

SEQ ID NO: 62725 - DNA, 201 bp, Homo sapiens
tgcctttaacgaaacttacatggacagagtggtgggggatagacagataattaaacaaattaataggcaataaagatgtagatgttggcatttttatcacyaagaggtttcttggtatttttacctaatagttactaatgcctacaggaaccagagtggtcacaatgtgctgctgtgtgattttgtgtttttcagagagga

SEQ ID NO: 62726 - DNA, 201 bp, Homo sapiens
ctttggtggcagagtgtcacatatttttaaatgaccagctctttggtggcggagtgtcacgtatttttaaatgaccagatctttggtggtagagtgtcacrtatttttaaatgaccaggtcttgtgtgaactcagagtaagagcctactcatcaccaaggagatggcccaagccattcatgagggatcagcccgcatgatc

SEQ ID NO: 62727 - DNA, 201 bp, Homo sapiens
atgaccagctctttggtggcagagtgtcacatatttttaaatgaccagatctttggtggcagagtgtcacatatttttaaatgaccagatctttggtggcrgagtgtcacatatttttaaatgaccagctctttggtggcggagtgtcacgtatttttaaatgaccagatctttggtggtagagtgtcacatatttttaaa

SEQ ID NO: 62728 - DNA, 201 bp, Homo sapiens
tctcaaatggagtttctagctacaacatcagcaaaataatggctggtttcagcctgtgcacagggcaagagtttcttttactttgccgccctcatagactsgttaagcctcaagcatttatttcttaccacttggtcttgctgtgtttttaactcctgttttaggaacagatacagtctctgttcattgttaaagtagatc

SEQ ID NO: 62729 - DNA, 201 bp, Homo sapiens
atttttaaatgaccagatctttggtggcggagtgtcacatatttttaaatgaccagatctttggtggcggagtgtctgtcacatatttttaaatgaccagmtctttggtggcggaggagtgtcacatgtttttaaatgaccagctctttggtggcggaggagtgtcacatgtttttaaatgaccagctctttggtggcgga

SEQ ID NO: 62730 - DNA, 201 bp, Homo sapiens
aggtcaaagagaatgaactctaaatgtttcccagtttgatttttctgcttctgtttagccacatgaaatgaagatcacctctgcctatctacaggacattragaatgcctataagaaaacctttctccctgagatgaggtgagccaaacacacgactgatttacagggctaaaacttcttcgccactcgtttcttaggccc

SEQ ID NO: 62731 - DNA, 201 bp, Homo sapiens
tattcctcagccttagctgctttcaatttcatgttgtcactaaatctgactcagtagatacttctgtgcagctgattatactactgaaacgggataaatgyagcttgatgattttcagctgagttatttgaaaaataaagtatttaaagctgttctttattcttcagagaagaccagactcttgtatctattattactgtg

SEQ ID NO: 62732 - DNA, 201 bp, Homo sapiens
gacagtgatggctgtggtctgtcacgcccttggcttgggggcagtgtagtcaggagaagggaaacgaggaaatggtcctgctgttgtcactgtcaagccakccatgagaacattctggcttttaacatgtcctcctgaaccagtcaagctctaatgcaccctcacatgcccagcacaatgcccagtgcagagaatgtgagg

SEQ ID NO: 62733 - DNA, 201 bp, Homo sapiens
gagcaagagaatggggcagcagagtgtcacatatttttaaatgaccagatctttggtggcagagtgtcacatatttttaaatgaccagatctttggtggcrgagtgtcacatatttttaaatgaccagatctttggtggcggagtgtctgtcacatatttttaaatgaccagctctttggtggcggaggagtgtcacatgt

SEQ ID NO: 62734 - DNA, 201 bp, Homo sapiens
gagacccagagctcaaggtaggactactaaatggatgatgtggagtgatggttaagatgacattttcctggctggtgctgtggctttggttgggaacagcragagatacagaaccgacggtctgggatccaggagggtggctggcaatagggaggaagtgtggacgcttgatccaggaggcacttaggattaatctggcag

SEQ ID NO: 62735 - DNA, 201 bp, Homo sapiens
gactgtaaggagttttaaattttaaaacttgctactcataattagatattcaagtttctgaaattcgcatagtgcatttcagatgatgagagaggtgacarccgtagaaagtgggagaagtggttgcggggagatgggtgagcgatggaggtggcgagcaagttggagagatgcagggagagtcaggtgacaagaagagag

SEQ ID NO: 62736 - DNA, 201 bp, Homo sapiens
ctttaggagaattattcctcagccttagctgctttcaatttcatgttgtcactaaatctgactcagtagatacttctgtgcagctgattatactactgaamcgggataaatgcagcttgatgattttcagctgagttatttgaaaaataaagtatttaaagctgttctttattcttcagagaagaccagactcttgtatct

SEQ ID NO: 62737 - DNA, 201 bp, Homo sapiens
ttcttattttgaacagctttaatgaggtataatttatgctccataaaattcacccattttaagggtacgactgaatgattttgggtaaatttaccaagttrttgccactcttgccataatccagttttagaatgttttcatcattttgtaggttgaaaccgcaggcctattcatttctttcttccttcctctctctcctgt

SEQ ID NO: 62738 - DNA, 201 bp, Homo sapiens
tgggtggcacgggccctgcgggtgccccctggattatgcattctgtgtagtgatcactttaggagaattattcctcagccttagctgctttcaatttcatkttgtcactaaatctgactcagtagatacttctgtgcagctgattatactactgaaacgggataaatgcagcttgatgattttcagctgagttatttgaaa

SEQ ID NO: 62739 - DNA, 201 bp, Homo sapiens
atccttcatgaatggcttggtgccctcctggaggtaattagtatgttctcacagagtgcacgtcgacctctcattttaaagtatatggcagctcccacccsctacccgcctcatgctcttgctcttgctcctactcccactatgtggcgtacctgcccctgctttgctttccactatgattggaagcttcctgaggccttc

SEQ ID NO: 62740 - DNA, 201 bp, Homo sapiens
ggtcaggtcaccagcaagtgtttctggagtgcctgtggtgtggcaggctctcttaggtgctagggatatgaatatgaagaaacttaagacaaggctcccaygggcccggggttgggggctgttgaaccaatggggatggttcattgtaataaagtgtacttagcactcctgagcattactcctgggtgctttgggggcaca

SEQ ID NO: 62741 - DNA, 201 bp, Homo sapiens
ccctttagctttgttttggaatggcccaccattctcactggaaaacagtggtctgctgtgaaaggccagctctcggcagcccctgtggtttcagcgctgcygctctgtgtcattcaggttgtgcacattgtttttcttctgacttccagaaataaaagtgtttccatgggaatttccccatcgtacgtctatgtgcgtgcg

SEQ ID NO: 62742 - DNA, 201 bp, Homo sapiens
tcctgtggctcttgtcaccctcctgacattaatgagaacactcagtagttcgtttccatttgtggctcccagccctaggacagaagcttctggcaggcagrgctgggttgtggtttgtgtacctgtggcatccttgcactcacaggagacacctgccacagatcatgtgctcaccagcattgctgaaggaactcatgaagt

SEQ ID NO: 62743 - DNA, 201 bp, Homo sapiens
cacaggtagcagcaaatggcacatctgtgtgcggagagagggagatgggtggactcttagggccttcgtgtctgttttatattgcagtgcttgctgctttygttgattggcagtgcccctgatgagcttctcacgcacaagctcagccgccactagggttggcttcatggggtctgagccgtgagaacaagaatgtggttt

SEQ ID NO: 62744 - DNA, 201 bp, Homo sapiens
tcagagggaatttcacgcggggctttttcagagagaactcggtgtttcagttggtgaactgtggttcctgggtcccagccccacccctgtgtctgcgtggstgtccctgctcagggcctcccctaagtgccacccattgctctctgtccccctcctgtggctcttgtcaccctcctgacattaatgagaacactcagtagt

SEQ ID NO: 62745 - DNA, 201 bp, Homo sapiens
gtggaccgccacctgagcccctgatctctcccagatggtgggagaagtgggggctgtaacatcctttctgcagctccgtcactgccaagctcagccccccrctggcctctctggcagcatccgctcctcctgggctctgtcgtcctgtcgctcctggatgttcagtggctcccgctagggtcagtcctgcagtgcttcccc

SEQ ID NO: 62746 - DNA, 201 bp, Homo sapiens
tgtgccctgtgaggttggcctctgtggaccgccacctgagcccctgatctctcccagatggtgggagaagtgggggctgtaacatcctttctgcagctccrtcactgccaagctcagccccccgctggcctctctggcagcatccgctcctcctgggctctgtcgtcctgtcgctcctggatgttcagtggctcccgctag

SEQ ID NO: 62747 - DNA, 201 bp, Homo sapiens
gctcttgttgccccccagatctccctgtgccctgtgaggttggcctctgtggaccgccacctgagcccctgatctctcccagatggtgggagaagtggggsctgtaacatcctttctgcagctccgtcactgccaagctcagccccccgctggcctctctggcagcatccgctcctcctgggctctgtcgtcctgtcgctc

SEQ ID NO: 62748 - DNA, 201 bp, Homo sapiens
tgaaagttattcctacatttgattcatgtgtaaggttcttgcaaatcagatcgtcagttagattcccactggtcttaacaaacatcactgttttatcaccygaaagcagtgccagtcaaacccatcatcacactcccctggccatgaggtttcgagtttctttcaagtaattcggtttctacgatctgaaaattacagatg

SEQ ID NO: 62749 - DNA, 201 bp, Homo sapiens
cagccctgtgctggccgcctaccctcatgaacaggcgtctttgtgctggcaggggctcttgttgccccccagatctccctgtgccctgtgaggttggcctytgtggaccgccacctgagcccctgatctctcccagatggtgggagaagtgggggctgtaacatcctttctgcagctccgtcactgccaagctcagccccc

SEQ ID NO: 62750 - DNA, 201 bp, Homo sapiens
aggcaggtgttctccataactcccatcgtaccctggtagggctgagtttgctgcccagcctcattagcatggggcactttttagaagctgagtttccagaagccaaccaagggccagcctcgcaaggaggccctgccacagacagcagcataggcctgctctgtgtgtggcgaaggaaaggctttctgagagcgcaagagc

SEQ ID NO: 62751 - DNA, 201 bp, Homo sapiens
atctctctcaaagtagttaggacacagcgtttcaccagtagaaggagtttcctccattagaatgagtgactgtgtgtgtgtgtgtgtgtgtgtgtgtgtgkatatttttttccttgactgatttctgtgcgaacagctggcatttgaagcactatatagggcatgtctaaattgtgcacccaagagaagagcctgggagaa

SEQ ID NO: 62752 - DNA, 201 bp, Homo sapiens
gcagtggaccgatgtggcttcatgtttgggcgttggattcctgagtgtgaggttcccatggcaaggtggcaggagatacctgtcggcatctgctgagtgtytgctgaagtctgaggactggcctgggctggagtctgcaggcgttgggggtccagcactgaccgtgagcatgctttccttgggaaagcccaaggggtgatg

SEQ ID NO: 62753 - DNA, 201 bp, Homo sapiens
tgacccagatcttaggcgtacatgtctttctcctcattaccttaattgtgaatgtgttaatgagtatcaacttagtttcaccaacatttggccattcccgygttcaacatatacttatttactcagctccaacactgctagctcccagtgtcagtgttagctgagacacagaggtacacaagacagagtagggaaggcctt

SEQ ID NO: 62754 - DNA, 201 bp, Homo sapiens
ccttccgtgcagcgggcactgcctttggcgatggtatgtgcagctgctgacatggctcatgtaccttgctcctgtggacagtgatggctgtggtctgtcaygcccttggcttgggggcagtgtagtcaggagaagggaaacgaggaaatggtcctgctgttgtcactgtcaagccagccatgagaacattctggcttttaa

SEQ ID NO: 62755 - DNA, 201 bp, Homo sapiens
gtgcagtgcaagctgcgctatggaatgtggcatttcctacttggggataaagcaagcaaaagactgacagaacgcagcagagtgataactgtagatggcartatatgtactggaaaaggcaaacttgcaaaagaaatagcagagaaactaggtatgattttatgttacacagaatgatacctttttctcagatatatggtt

SEQ ID NO: 62756 - DNA, 201 bp, Homo sapiens
gtagagtgtcacatatttttaaatgaccaggtcttgtgtgaactcagagtaagagcctactcatcaccaaggagatggcccaagccattcatgagggatcmgcccgcatgatccaaacacttcccaccaggccccacctctgacactgtgagttacatctcagcatgagatttggaggggacatccacactctcatttgat

SEQ ID NO: 62757 - DNA, 201 bp, Homo sapiens
gtatttcgggagggggcatttttccatgtcagggcttctttaagaccacaaagctgaagtctgtgctcgctgctcagcggaggccgtgctctgcgcattgygtgcatttgctgcctcctccctcctcctgaatggccacctcttccctgctgatccgcatgctgtctgcacctgaagcctctctccgtgttggtcaggtag

SEQ ID NO: 62758 - DNA, 201 bp, Homo sapiens
cccagtatcaaggcatggccatggggtccctgttgaatgctgcatgcgtgcagcgagaggcccctctgctctggccagtgggagctcgccgactctcagcyctaagtgaactctgggagtcatctgcttgcaactccctggaaactgttctttcccagaagtcgactttgtccagcttcatggagttttaccccctgcaca

SEQ ID NO: 62759 - DNA, 201 bp, Homo sapiens
ggcaccagaagctcttctgtgctccatcactgaccaggcacattctgtaacgtgcgtggccgtggcatgaacaggcagcagatcctgagggtcaggagcakcaggagcgttgcagaggagcacactttcctccctgcagtaggagctcggcagagcacattttcatggccaccacacttatccaatagaattgtgttttag

SEQ ID NO: 62760 - DNA, 201 bp, Homo sapiens
gctggagtgcagtggcacgatctcggctcactgcaagctccgcctcccgggttcacgccattctcctgcctcagcctcccaagtagctgggactacaggcrcacgccaccatgcccggctaatttttttgtatttttagtagagacggggtttcactgcttgtttaatactatgttattttttcctggaggagaatatggt

SEQ ID NO: 62761 - DNA, 201 bp, Homo sapiens
ggctggagtgcagtggcacgatctcggctcactgcaagctccgcctcccgggttcacgccattctcctgcctcagcctcccaagtagctgggactacaggygcacgccaccatgcccggctaatttttttgtatttttagtagagacggggtttcactgcttgtttaatactatgttattttttcctggaggagaatatgg

SEQ ID NO: 62762 - DNA, 201 bp, Homo sapiens
ccctgtggccgttggtagctctgttggcggcttgatggaggatcctgagatgaaacaaagaccgtctttgccctgtggcgagttctttgttttttttttttgagacagagtctcgctctgtcacccaggctggagtgcagtggcacgatctcggctcactgcaagctccgcctcccgggttcacgccattctcctgcctca

SEQ ID NO: 62763 - DNA, 201 bp, Homo sapiens
taaaactgcgtcaggtcacaaaggccagggagagaagtaaccctgagtaacagggtggtgagtagctaggggtgacaaagggcctctctcgggatgaggcytaagtgaggccaggattgggtcctgtgggccgtggggtgagcagagggcaggggcttggcaggtgcagaggctcttcaggcaggagtgtggtgggaaggt

SEQ ID NO: 62764 - DNA, 201 bp, Homo sapiens
ccagaggtccagaggcggattcagaagaaaggagatgtaatgcagttttcaatcaaaggccaagcatctctattttgaatgcagatcagcactaaaagccctgttttaatagcatttatactaattcctaccagtcctcacgaggagggtgacacacaccctgttcccacttgagagagggcatctgcaggggtggagggg

SEQ ID NO: 62765 - DNA, 201 bp, Homo sapiens
tttcctaagttctttttagaatggttatgtactgtaattccatcttatttcctttgtggccttacgagctacccctctttatttcatttctgatgattgcygtagggtttcaccacgggcaactctaacttgtcacagtcaatccacaccttgtcagcatttaaccgcctcacacagaatgcaggtatctggcccgaggcc

SEQ ID NO: 62766 - DNA, 201 bp, Homo sapiens
ttatcatttcttcagatttttttctatcctcccccttttggggactcttatgtatccatgcattaggtgacttgctattttccacaggtccctgtgactctgtccatttgtttttggcctttttctttctgtgcctaattttggatagtttctgctgctctgccttcaagctcacttatcttctgtgggtgtatgatatgc

SEQ ID NO: 62767 - DNA, 201 bp, Homo sapiens
taacgtgcgtggccgtggcatgaacaggcagcagatcctgagggtcaggagcagcaggagcgttgcagaggagcacactttcctccctgcagtaggagctyggcagagcacattttcatggccaccacacttatccaatagaattgtgttttaggaatcctgttttttagctctagaaattctgtttggtgctttttatgt

SEQ ID NO: 62768 - DNA, 201 bp, Homo sapiens
gttatcatttcttcagatttttttctatcctcccccttttggggactcttatgtatccatgcattaggtgacttgctattttccacaggtccctgtgactctgtccatttgtttttggcctttttctttctgtgcctaattttggatagtttctgctgctctgccttcaagctcacttatcttctgtgggtgtatgatatg

SEQ ID NO: 62769 - DNA, 201 bp, Homo sapiens
cgctggaaaaaggaacttcctaagtatcttccaccctttctccctcctgaaataggtgtcttttgtgctgtcatgtctccctgtgaaagcagattggagcyctggacctcaaacacacgcagcttaaagtgcagcccccacagcctcccgttagaacctcccccgctcttagcttgccctagcaatacctaggctgtagct

SEQ ID NO: 62770 - DNA, 201 bp, Homo sapiens
ccaggcgcaggacctggcacctgtaggcacttagccggcacaggacctcgtacctgtgggcacttaggaagtaattgtgggctaagtgaacttaaaccacrtcgtggactcagctttactgtcttgttgttaccttcctgtactttcttaggccagtgatcagcaaaggtttcctttaaagagccagagagtaaaggttcc

SEQ ID NO: 62771 - DNA, 201 bp, Homo sapiens
ccggaatatgtgtaccagtattcatacttggacctggttctctgaatttccctataaagaatataattaaacaaaatgcaaacaaaaactttcgattctgwtacccatacaagtatttgttttactttgcattttataaacactaaacttcaatttatatttttattggctatttatttgctctttgtgaattttcccttc

SEQ ID NO: 62772 - DNA, 201 bp, Homo sapiens
atctctttgaatctggatcagttcctcaggcttttcttggcattcaagaccttgacatttttgaagactacagaacagttaccttgctgaatatccctcaatgtggttttgagggatatttggcatatggttcccatttgtcccatcactgcttttgttacctttattgcttgttaaggtggtgtcttcactataaagtta

SEQ ID NO: 62773 - DNA, 201 bp, Homo sapiens
aatttcaggttacttaaggtataaaagtggtcagagtatatgaacgcattttacagctattgagtttttgcaaaatgattctccggaatatgtgtaccagwattcatacttggacctggttctctgaatttccctataaagaatataattaaacaaaatgcaaacaaaaactttcgattctgatacccatacaagtatttg

SEQ ID NO: 62774 - DNA, 201 bp, Homo sapiens
aatattcatagcttataatgtattaaaatgttacctcttggccagccatggtggctcacgtctataatcccagcactttgggaggctgaggcaggaggatygcttgagcccaggagtttgagaccagcctgggcaacgtggtgagaccccatctctactaaaaatacaaacatcagccaggtgtggtggcatatgcctgta

SEQ ID NO: 62775 - DNA, 201 bp, Homo sapiens
cctggctcctggtggggcttcagctaatgtctgttcagttatgtgtgttgaacgaaactgtcacatcgtcctgatctctcatgaccactcttgtgcaaatrtgtcaaatagtttgtgacctttcatattgctgtgtgagaacaaataatgtttctgtgccagccctgttcatcagggatgtttaagacctctgtctcctat

SEQ ID NO: 62776 - DNA, 201 bp, Homo sapiens
tgtaaagatgccttctgcctgtgctcggttaggccctgggcttcgttgtccttccgtgcagcgggcactgcctttggcgatggtatgtgcagctgctgacrtggctcatgtaccttgctcctgtggacagtgatggctgtggtctgtcacgcccttggcttgggggcagtgtagtcaggagaagggaaacgaggaaatggt

SEQ ID NO: 62777 - DNA, 201 bp, Homo sapiens
cttgcacttactgtgtttatgaatgtctgttagatagatgaataaatgccattacttaatcggtctccgctggaaaaaggaacttcctaagtatcttccaycctttctccctcctgaaataggtgtcttttgtgctgtcatgtctccctgtgaaagcagattggagccctggacctcaaacacacgcagcttaaagtgcag

SEQ ID NO: 62778 - DNA, 201 bp, Homo sapiens
gtttttgaaaatggtttcccacttacaaatatgtctatgttcttttcagtattttggtgtggaaatggaattgtaaatgattgttattttcttttctctgraatgcagtgatcagttgacagtgctttgctatctgtctgattttcaatttctgtttgcctatgtttaaacaggacaaggtgttgtgttggagcgctccat

SEQ ID NO: 62779 - DNA, 201 bp, Homo sapiens
catttcctgagatatatctactatcaagttaatcacattcactcaccaaataagttcttttctgctttcttcttacaaagtagcatttgagaatgtttttrtgtggcacttctttcattactgtagttctctgataagtaactgcctagagcagtagtagggctgttaagtgttagaggctgtctttgcaaaaactgaaat

SEQ ID NO: 62780 - DNA, 201 bp, Homo sapiens
tacgtcttgcctcaggagcaaaagtgaacccttaaatgtggctaagatgtgctaaagatctgtcttttaggatgattaaggtcacagtttaaatgctgctrttttactctgtgtaagtagcttaatttctctgggcctcagacctttggtttgtaaatacagtggaggcgacaagccctgttttcagggttgtgggcacca

SEQ ID NO: 62781 - DNA, 201 bp, Homo sapiens
cttgactggcctttaaggggcacggtcgtccagctgtggagcactcgtggagtcagatctccacacagtggttcaggtccctgtgaatcctctcacctgcrtgaagggcctggctgcctcttctaggtgtctgggaagcctgctctttcccatcaactgcacccttaaatggggactccagaaacaggagcagtgtcaggg

SEQ ID NO: 62782 - DNA, 201 bp, Homo sapiens
agcactcgtggagtcagatctccacacagtggttcaggtccctgtgaatcctctcacctgcgtgaagggcctggctgcctcttctaggtgtctgggaagcmtgctctttcccatcaactgcacccttaaatggggactccagaaacaggagcagtgtcaggggcgagttagagggcctagcacgccatactcagggacagt

SEQ ID NO: 62783 - DNA, 201 bp, Homo sapiens
ggttggagccttgggggctccctctgtggtagctgcctatctctgttcagaataagatttatcacagtgaatgaggacagatacgcagacagatcaatacraaaaaagacatgttggactctggagaaatccatgcacaggctcttcctcctgtgagggacactgacacattgattgagcaactttctcaagcagtgaaaa

SEQ ID NO: 62784 - DNA, 201 bp, Homo sapiens
agcagactcaggagccaggggacacggctccaattctagctctgtgaacacactggccgtgtgccaccctcagcaagttacttaatctctctctcttaggaaaaaaaaaaaaaaaaaaaagaaatccttgcacatgctgtaaaattcaaaagatgagagatgttccttctttgttccccagccgcccagggcccctccctc

SEQ ID NO: 62785 - DNA, 201 bp, Homo sapiens
gccgtgctctgcgcattgcgtgcatttgctgcctcctccctcctcctgaatggccacctcttccctgctgatccgcatgctgtctgcacctgaagcctctytccgtgttggtcaggtaggatttctccacccttttcgccctccatcaccttccatcttctactttgggcttctcccacattccaactcatttctaggttt

SEQ ID NO: 62786 - DNA, 201 bp, Homo sapiens
atttaaaaattatctgggtatggtggtgcatgcctatagtttcagctacttgggaggttaaggtgggagggtcacttgaacctgggaggttgaggctgcartgagctgtgttcacgccacggtactccagcttgggcgacagagactctgtctctcaaaagaagttcacttctgtttgatgtttttagtacagcattaata

SEQ ID NO: 62787 - DNA, 201 bp, Homo sapiens
taagtctcgagcccttggcctgagcctgccctgtgctgcttcctgcctctacccaggatgctctgtgcagactgcaccaacactttgcctctcgagggccyggaggcacaaggatggccggggcactcaacttccctctcctcaacgtttggatgtaaattaggaagttggtgcctacagatggcagctctgttcttggcc

SEQ ID NO: 62788 - DNA, 201 bp, Homo sapiens
tatttataaatcaagattggagtaatttgagggtctttgacttgtgaaaatgcaggaaacatgagtagctatttggggatctgccttttgtgttaagtctygagcccttggcctgagcctgccctgtgctgcttcctgcctctacccaggatgctctgtgcagactgcaccaacactttgcctctcgagggcctggaggca

SEQ ID NO: 62789 - DNA, 201 bp, Homo sapiens
ctggagctctttttctgcctaggccccacccctttagtgctctactccgtaaaatctagtcactgtgtcctgcccagagtcagatgcaaccaccagactcrgtttctccagtttctaaatgtatctggctgggaggcaagtacagaccctgttactgcctcatgaaaggaaactgttgactactacttggcctggtgcctc

SEQ ID NO: 62790 - DNA, 201 bp, Homo sapiens
ctctatggggcaacccgccatgtagcccccacaccctgcacatattctataagcagaccggacacttaccttccctggggctgaccagctctttctctctstcacccaggccttcctgaccccgtcaggccctttgaggccagccccaggtgcccgtcactgctccccggtctagaaatagcacctacagcccgtctgaca

SEQ ID NO: 62791 - DNA, 201 bp, Homo sapiens
cccctgggctgtcttggcatcactggctgaatgacctgggctttcatctcagtctctcttcagatttcaaactcctgaaggagctgggtttttcttttttygtgtgtgtcccagaattctcctggcacccaaacaaaaccgtctgtatccacactgtatcctgggccagaaagctggaggctggctgtgccaccctccccc

SEQ ID NO: 62792 - DNA, 201 bp, Homo sapiens
atatttttttccttgactgatttctgtgcgaacagctggcatttgaagcactatatagggcatgtctaaattgtgcacccaagagaagagcctgggagaarcctcattgtgcggccttggccctcatggcacagatcccaggttggctgtagcatttagaagtggacacttttctaacatcagaactcatccagtccttac

SEQ ID NO: 62793 - DNA, 201 bp, Homo sapiens
agaaaccaaggctctgaatcagccccgaagtgtaagcagcagcataatgatctggagcagcatcttggcgttattaaattcaacccattccgatggctgcrtcagcatctattgctctgtttattgtttttccttaagcaagcagttccatttctagaaatttatctcaagcacataaatctagagggggcacatcggtgt

SEQ ID NO: 62794 - DNA, 201 bp, Homo sapiens
gaggtggggtctggtgggtggtgtttaggtcatgggagtagatccttcatgaatggcttggtgccctcctggaggtaattagtatgttctcacagagtgcrcgtcgacctctcattttaaagtatatggcagctcccaccccctacccgcctcatgctcttgctcttgctcctactcccactatgtggcgtacctgcccct

SEQ ID NO: 62795 - DNA, 201 bp, Homo sapiens
gccgcccagggcccctccctcaggcagcctggttcaggtttctttgtagccttccggttggtgggggagagggtagcacctgtgtgtgtgtgccattcacyctcttaactgtgagggtcaggaaaatcatcatgttagtttacattaagcatggacttctgacacacagatttgcacacagatatttgggggaaatcacga

SEQ ID NO: 62796 - DNA, 201 bp, Homo sapiens; identical to SEQ ID NO: 28674

SEQ ID NO: 62797 - DNA, 201 bp, Homo sapiens; identical to SEQ ID NO: 28724

SEQ ID NO: 62798 - DNA, 201 bp, Homo sapiens; identical to SEQ ID NO: 28710

SEQ ID NO: 62799 - DNA, 201 bp, Homo sapiens; identical to SEQ ID NO: 28795

SEQ ID NO: 62800 - DNA, 201 bp, Homo sapiens; identical to SEQ ID NO: 28673

SEQ ID NO: 62801 - DNA, 201 bp, Homo sapiens; identical to SEQ ID NO: 28683

SEQ ID NO: 62802 - DNA, 201 bp, Homo sapiens
tattggccatggcatttcaagtctctccagccttttcttcctctgcttcccaagtacaccctacacctgcacacatagccctcctttaccctgttccaggstttgggaagtcctgatgtctcatagttgaggtccaaaagggggagtttgggaaagcaatgaatgagggcaagtgcctcttctgaatccctgcaggaaaat

SEQ ID NO: 62803 - DNA, 201 bp, Homo sapiens; identical to SEQ ID NO: 39819

SEQ ID NO: 62804 - DNA, 201 bp, Homo sapiens; identical to SEQ ID NO: 39772

SEQ ID NO: 62805 - DNA, 201 bp, Homo sapiens; identical to SEQ ID NO: 39775

SEQ ID NO: 62806 - DNA, 201 bp, Homo sapiens; identical to SEQ ID NO: 39776

SEQ ID NO: 62807 - DNA, 201 bp, Homo sapiens; identical to SEQ ID NO: 39796

SEQ ID NO: 62808 - DNA, 201 bp, Homo sapiens
ctgatgccagcctcctccctaggtaacccgtggctgccatgagtcctgtctggatgaagaggtagagggccagggtttctgctctggtcctggctgggatyctgtaacaggctggggaacacccaacttcccagctttgctgaagactctactcaacccctgaccctttcctatcaggagagatggcttgtcccctgccct

SEQ ID NO: 62809 - DNA, 201 bp, Homo sapiens
gagggagcacacattgggagggtgggaacacaaggacaacgtagctcccactgaaacccacctgctgcccctacagcctcctagggctctttgccctcatmctctctggcaaatgcagttacagcccggagcccgaccagcggaggacgtgagttgacttagcacagactgcccccttccccataccctgttctgcctccc

SEQ ID NO: 62810 - DNA, 201 bp, Homo sapiens
tgaggaagagctgagtctcacctttgccctgagacagcagaatgtggaaagactctcggagctggtgcaggctgtgtcggatcccagctctcctcaatacrgtgccttttgggactgaggacaggatgtgggatgcggtggagggacacagggctgggttgggcatgggatggcgatcatgtcagagcctgccaagacact

SEQ ID NO: 62811 - DNA, 201 bp, Homo sapiens; identical to SEQ ID NO: 39778

SEQ ID NO: 62812 - DNA, 201 bp, Homo sapiens
ggtcaacactgagctcatgaaggctgccgctcggggtctcaccctgctcttcgcctcaggtgacctcctaccctaaacttagacaacgcttacacctctgyagcctgggagctttgactccacagtgatccctgagcctggtctctgactcataatctgaactcagaccttccagtagggaccactgacctgacctctaca

SEQ ID NO: 62813 - DNA, 201 bp, Homo sapiens
ctgccctgaagctggcagttcagtcccttattctgccctgttggaagccctgctgaaccctcaactattgactgctgcagacagcttatctccctaacccygaaatgctgtgagcttgacttgactcccaaccctaccatgctccatcatactcaggtctccctactcctgccttagattcctcaataagatgctgtaact

SEQ ID NO: 62814 - DNA, 201 bp, Homo sapiens; identical to SEQ ID NO: 39783

SEQ ID NO: 62815 - DNA, 201 bp, Homo sapiens
gaccacatagtattgaaatggccagtttacttgtctgccttcctttccaagaccgttggtgcctagaggactagaatcgtgtcctatttaactttgtgttmccaggtcctagctcaggagttggcaaataagaattaaatgtctgctacaccgaaaacctcacgcctctcattcgttgtgatttttgcatatgttgttgac

SEQ ID NO: 62816 - DNA, 201 bp, Homo sapiens; identical to SEQ ID NO: 39826

SEQ ID NO: 62817 - DNA, 201 bp, Homo sapiens
tacaggctgcccccaggctgggtgtccctgggccgtgcggaccctgaggaagagctgagtctcacctttgccctgagacagcagaatgtggaaagactctyggagctggtgcaggctgtgtcggatcccagctctcctcaatacggtgccttttgggactgaggacaggatgtgggatgcggtggagggacacagggctgg

SEQ ID NO: 62818 - DNA, 201 bp, Homo sapiens
aggctgtgtcggatcccagctctcctcaatacggtgccttttgggactgaggacaggatgtgggatgcggtggagggacacagggctgggttgggcatggratggcgatcatgtcagagcctgccaagacacttgtgttcctcaggctagaaacctaaaaggggatgtggttcagtatacaggctttatgatcaaatacga

SEQ ID NO: 62819 - DNA, 201 bp, Homo sapiens
aggtcccaggccccaaatctcttgtgtgggatacagctcccattgttccttttcgtcagttcccaggcattttagtggaagatttggtgggtgttctgtasagaaaagtgtgcacagtcacctcgggccatgccttgaaggctcaaaatctcttagtcaatcccatatacatgcttccccacagagtctagttcctccagc

SEQ ID NO: 62820 - DNA, 201 bp, Homo sapiens; identical to SEQ ID NO: 39829

SEQ ID NO: 62821 - DNA, 201 bp, Homo sapiens
gcctacatccagcgggtcaacactgagctcatgaaggctgccgctcggggtctcaccctgctcttcgcctcaggtgacctcctaccctaaacttagacaaygcttacacctctgcagcctgggagctttgactccacagtgatccctgagcctggtctctgactcataatctgaactcagaccttccagtagggaccactg

SEQ ID NO: 62822 - DNA, 201 bp, Homo sapiens
tgtgggatacagctcccattgttccttttcgtcagttcccaggcattttagtggaagatttggtgggtgttctgtagagaaaagtgtgcacagtcacctcrggccatgccttgaaggctcaaaatctcttagtcaatcccatatacatgcttccccacagagtctagttcctccagcaagacctgggctatactcacccct

SEQ ID NO: 62823 - DNA, 201 bp, Homo sapiens; identical to SEQ ID NO: 39833

SEQ ID NO: 62824 - DNA, 201 bp, Homo sapiens; identical to SEQ ID NO: 39790

SEQ ID NO: 62825 - DNA, 201 bp, Homo sapiens
gataacagtgcttggcacctggaagtaggtggcagatgttaacgcccttcctcccttgcactgcgccccctgtgcctacctctagcattgtaacgaccacrtagtattgaaatggccagtttacttgtctgccttcctttccaagaccgttggtgcctagaggactagaatcgtgtcctatttaactttgtgttcccaggt

SEQ ID NO: 62826 - DNA, 201 bp, Homo sapiens
tgcctttcataatcaccagggaataaagtggaataatgttgataacagtgcttggcacctggaagtaggtggcagatgttaacgcccttcctcccttgcaytgcgccccctgtgcctacctctagcattgtaacgaccacatagtattgaaatggccagtttacttgtctgccttcctttccaagaccgttggtgcctaga

SEQ ID NO: 62827 - DNA, 201 bp, Homo sapiens; identical to SEQ ID NO: 39837

SEQ ID NO: 62828 - DNA, 201 bp, Homo sapiens
tttgttcttaagtaaaaaatcatttttcctcctccctccccaaaccccaaggaactctcactcttgctcaagctgttccgtccccttaccacccctgatamaactgccaggttaatttccagaattcttgcaagactcagttcagaagtcaccttctttcgtgaatgttttgattccctgaggctactttattttggtatg

SEQ ID NO: 62829 - DNA, 201 bp, Homo sapiens; identical to SEQ ID NO: 39770

SEQ ID NO: 62830 - DNA, 201 bp, Homo sapiens
ggacgttttcaaacaactatggggagtgctaagggggacttgggggcagttagggtggtgtggaatagcctttgaaatgtgagtacagggtgaggagatayactctttaagtactggtactagtaggcccagatctgatgccagcctcctccctaggtaacccgtggctgccatgagtcctgtctggatgaagaggtagag

SEQ ID NO: 62831 - DNA, 201 bp, Homo sapiens
atttggtgggtgttctgtagagaaaagtgtgcacagtcacctcgggccatgccttgaaggctcaaaatctcttagtcaatcccatatacatgcttccccasagagtctagttcctccagcaagacctgggctatactcacccctccccacatatcttggaggtccccttgggtcccctactatccaaatgctgtcttctcc

SEQ ID NO: 62832 - DNA, 201 bp, Homo sapiens; identical to SEQ ID NO: 39771

SEQ ID NO: 62833 - DNA, 201 bp, Homo sapiens
cagccctgccacatgtgcatactgtgagctatggagatgatgaggactccctcagcagcgcctacatccagcgggtcaacactgagctcatgaaggctgcygctcggggtctcaccctgctcttcgcctcaggtgacctcctaccctaaacttagacaacgcttacacctctgcagcctgggagctttgactccacagtga

SEQ ID NO: 62834 - DNA, 201 bp, Homo sapiens
aagctggcagttcagtcccttattctgccctgttggaagccctgctgaaccctcaactattgactgctgcagacagcttatctccctaaccctgaaatgckgtgagcttgacttgactcccaaccctaccatgctccatcatactcaggtctccctactcctgccttagattcctcaataagatgctgtaactagcatttt

SEQ ID NO: 62835 - DNA, 201 bp, Homo sapiens; identical to SEQ ID NO: 39840

SEQ ID NO: 62836 - DNA, 201 bp, Homo sapiens; identical to SEQ ID NO: 39774

SEQ ID NO: 62837 - DNA, 201 bp, Homo sapiens
gctttgctgaagactctactcaacccctgaccctttcctatcaggagagatggcttgtcccctgccctgaagctggcagttcagtcccttattctgccctrttggaagccctgctgaaccctcaactattgactgctgcagacagcttatctccctaaccctgaaatgctgtgagcttgacttgactcccaaccctaccat

SEQ ID NO: 62838 - DNA, 201 bp, Homo sapiens; identical to SEQ ID NO: 39781

SEQ ID NO: 62839 - DNA, 201 bp, Homo sapiens; identical to SEQ ID NO: 39812

SEQ ID NO: 62840 - DNA, 201 bp, Homo sapiens; identical to SEQ ID NO: 39782

SEQ ID NO: 62841 - DNA, 201 bp, Homo sapiens; identical to SEQ ID NO: 39851

SEQ ID NO: 62842 - DNA, 201 bp, Homo sapiens
actgcgccccctgtgcctacctctagcattgtaacgaccacatagtattgaaatggccagtttacttgtctgccttcctttccaagaccgttggtgcctaraggactagaatcgtgtcctatttaactttgtgttcccaggtcctagctcaggagttggcaaataagaattaaatgtctgctacaccgaaaacctcacgcc

SEQ ID NO: 62843 - DNA, 201 bp, Homo sapiens; identical to SEQ ID NO: 39852

SEQ ID NO: 62844 - DNA, 201 bp, Homo sapiens
gctgctcagtaatgagtcagccctgccacatgtgcatactgtgagctatggagatgatgaggactccctcagcagcgcctacatccagcgggtcaacactragctcatgaaggctgccgctcggggtctcaccctgctcttcgcctcaggtgacctcctaccctaaacttagacaacgcttacacctctgcagcctgggag

SEQ ID NO: 62845 - DNA, 201 bp, Homo sapiens; identical to SEQ ID NO: 39853

SEQ ID NO: 62846 - DNA, 201 bp, Homo sapiens; identical to SEQ ID NO: 39854

SEQ ID NO: 62847 - DNA, 201 bp, Homo sapiens; identical to SEQ ID NO: 39784

SEQ ID NO: 62848 - DNA, 201 bp, Homo sapiens; identical to SEQ ID NO: 39857

SEQ ID NO: 62849 - DNA, 201 bp, Homo sapiens; identical to SEQ ID NO: 39785

SEQ ID NO: 62850 - DNA, 201 bp, Homo sapiens; identical to SEQ ID NO: 39858

SEQ ID NO: 62851 - DNA, 201 bp, Homo sapiens; identical to SEQ ID NO: 39860

SEQ ID NO: 62852 - DNA, 201 bp, Homo sapiens; identical to SEQ ID NO: 39862

SEQ ID NO: 62853 - DNA, 201 bp, Homo sapiens
ccactgacctgacctctacactctgacctcctacagtaacaaatttcccctctgacatccgaacccacatactaagccctaaccaattaatatgaatgctrcacttggtctctctcaggtgacagtggggccgggtgttggtctgtctctggaagacaccagttccgccctaccttccctgcctccaggtaagtactctag

SEQ ID NO: 62854 - DNA, 201 bp, Homo sapiens; identical to SEQ ID NO: 39864

SEQ ID NO: 62855 - DNA, 201 bp, Homo sapiens
aggggatgtggttcagtatacaggctttatgatcaaatacgaactcaaattctgactctgctacttactagctaccaggcatctagtacaacttacgttcyttcccctaccctcaaatccattctaatttcctcttttgttcacatactaaggctgccagttctaactcccaaagagcctttggattaatctccttcttgc

SEQ ID NO: 62856 - DNA, 201 bp, Homo sapiens
caaggattactggatagaattcaggctttcccctccagcccccaatcatagctcacaaaccttccttgctatttgttcttaagtaaaaaatcatttttccwcctccctccccaaaccccaaggaactctcactcttgctcaagctgttccgtccccttaccacccctgatacaactgccaggttaatttccagaattcttg

SEQ ID NO: 62857 - DNA, 201 bp, Homo sapiens; identical to SEQ ID NO: 39817

SEQ ID NO: 62858 - DNA, 201 bp, Homo sapiens
ttgctgtactcctgtctcttcttcctgcaggtcccaggccccaaatctcttgtgtgggatacagctcccattgttccttttcgtcagttcccaggcatttkagtggaagatttggtgggtgttctgtagagaaaagtgtgcacagtcacctcgggccatgccttgaaggctcaaaatctcttagtcaatcccatatacatg

SEQ ID NO: 62859 - DNA, 201 bp, Homo sapiens; identical to SEQ ID NO: 39789

SEQ ID NO: 62860 - DNA, 201 bp, Homo sapiens; identical to SEQ ID NO: 39818

SEQ ID NO: 62861 - DNA, 201 bp, Homo sapiens; identical to SEQ ID NO: 39791

SEQ ID NO: 62862 - DNA, 201 bp, Homo sapiens
tgagctcatgaaggctgccgctcggggtctcaccctgctcttcgcctcaggtgacctcctaccctaaacttagacaacgcttacacctctgcagcctgggwgctttgactccacagtgatccctgagcctggtctctgactcataatctgaactcagaccttccagtagggaccactgacctgacctctacactctgacct

SEQ ID NO: 62863 - DNA, 201 bp, Homo sapiens
cagtgtgacactagtgtgcatggcaggaaacagtgactcaccatcgtgttaagcttaaaatcaacaagtatgcaaatttgagctaaactgaataactggtrccgaaagatttgaaaacatttaccggacataagcttaaaattaaaatggaaaatttatatgtattaacctcattcattttcatgatcatggcaatacatg

SEQ ID NO: 62864 - DNA, 201 bp, Homo sapiens
tatgctccaggcacagtctgacccaaagccatggccaccaccctcagtccctgcagcctcctcctcatcctcccctgcttcatcctacctggctgctgagragagtcctttggagtgacaggtatgggggcagaattgggagtggagcaaagggcaggtgggtgaggagggaggacagggatggagaattcccagagtccc

SEQ ID NO: 62865 - DNA, 201 bp, Homo sapiens
caggacaggggtgaagtggggttgcacagggacacaatcacagacactcccaccagccaccagcctgctctgttctcacccgctctcaaccacacaaaccytccagcacccccagggctgcgtgcccttgaatttttccctgcactttcctgtagacactcacctgcacccagcggctcagcagacacttcccaccctccc

SEQ ID NO: 62866 - DNA, 201 bp, Homo sapiens
ctccccatccatgaaggggccctcgcgacctcttacaccacgtgacaccttctgcctcttgcctgaggacacaccccagcaaacacaccccaagctccccwcagaacctgtgcaggggggatgggaagcaccatttcctccaggatgaccctgggaactctggtgagtagaggcacccacttctgcccttggggcccagac

SEQ ID NO: 62867 - DNA, 201 bp, Homo sapiens
gaggaggcatctcctcagatttggggcctggacaagggttgtcactcttgtgcttccatttcagcaccacccaccatgtcctcaggcacagcccaacccarggccacggccaccaccctcatcctttgctgcctcctcatcatgtgtctcctcatatgctccaggcacagtctgacccaaagccatggccaccaccctcag

SEQ ID NO: 62868 - DNA, 201 bp, Homo sapiens
ggcagtgggacatgtctggggacatgtggtttctcagcaggcagggacctcctcctcctctttgccctcatggaagtggggagcactcgccttaatcttgyggacaccacagttctggaggaggcactccttgctgggccagcccagccctccagaggcttcctcttattgtcacagtgtggaggaggggtatctaggggt

SEQ ID NO: 62869 - DNA, 201 bp, Homo sapiens
cctgcacacctttacatgtttacaaaattgcccttcatagcaaactctagtggccataaatacgtttggagaagcccacaaagaatcattgcacttgttgyggggttaaagggtccttcctcactggaaactggtgtcttcttctagtcatgggttcacggtctgagaagtggctttattctgcaaattaggcaaagcagc

SEQ ID NO: 62870 - DNA, 201 bp, Homo sapiens
cttctagtcatgggttcacggtctgagaagtggctttattctgcaaattaggcaaagcagccttgttcttgaaggactggctactttcagcctcctggtcmtccatcatttgttttatctctgtttcttgtaattatttaaatccagcactattcaggttgggtttccatctcttctggatcttggacccctttgttctat

SEQ ID NO: 62871 - DNA, 201 bp, Homo sapiens
ccctacttctgcccatcccaggagaaccacctgtgtcttctcactgccagacctctcttcctaatgacctagagggtgaggagcccacccgtaatgggcakctctgaggctggatggtcacggcccttccatggctaaaggccccatctctgccaaggcccagtactctacaggagacactttttaatgttgagatttcct

SEQ ID NO: 62872 - DNA, 201 bp, Homo sapiens
ccaaacctcatgtataacaatgtaaaagtgtaaattagccaccagatttaattataaaaatgaacttagcaggaaaaaaactctttgtgtttatagttctwtagcatatatacttctgttaatgacttttccttagaaaattagacatgctgatatatttgcagctgctcatatcagcatatacatttagaatagtaatag

SEQ ID NO: 62873 - DNA, 201 bp, Homo sapiens
tctatttcctaattcccagaatttgtgaatatgttaggttgcatggcaaagggtaacattgctaagcagctgaccttaaactagggaggttatcctggatyatgtaggtgggccaaatattaacacagtggttcttaaaagtagaggagaagagtagaagaaaagagtcagagaaaaaggtctgaacatagaaacaacatc

SEQ ID NO: 62874 - DNA, 201 bp, Homo sapiens
tttatatacatagaaacacatgtatgcataagtatatgtgtacacacacacacacacacacacacacacacacacacatatatacatacatacaaacagcytgctaagtatgaggcacgcattaccattactattagctgcctttcagaattacctgttttctattgatatcataactacctttcctcaattgctttatct

SEQ ID NO: 62875 - DNA, 201 bp, Homo sapiens
aaggttacatcatgatttatgtatctgtttgcccctattaaattataaattactttaaattagggaccaattattaattcatagcaaaatgcacaaggtckaacacatattaaatgttaagtaaatctgtgtttgttgaaaattacacaactaataaggagcacaatggggctcaacttggaactttacctgaattcaaaa

SEQ ID NO: 62876 - DNA, 201 bp, Homo sapiens
gaaagcatgttcatataaatatactattaaaaaagaagtattaataactctgagatgttatttgctagttcattaaaatcaggcattatatttaggctgayctttgtcagtgagcagtctttgaatgtcagcattaatgggaacaacttgataaccctgtggagttatattgtttacttgatgacaagagtagcatataag

SEQ ID NO: 62877 - DNA, 201 bp, Homo sapiens
tgcttaatgcatttatatacatagaaacacatgtatgcataagtatatgtgtacacacacacacacacacacacacacacacacacacatatatacatacrtacaaacagcctgctaagtatgaggcacgcattaccattactattagctgcctttcagaattacctgttttctattgatatcataactacctttcctcaa

SEQ ID NO: 62878 - DNA, 201 bp, Homo sapiens
aatatataaagtgcttaatgcatttatatacatagaaacacatgtatgcataagtatatgtgtacacacacacacacacacacacacacacacacacacayatatacatacatacaaacagcctgctaagtatgaggcacgcattaccattactattagctgcctttcagaattacctgttttctattgatatcataacta

SEQ ID NO: 62879 - DNA, 201 bp, Homo sapiens
tcttaaactctgcgagcctgggttttctcttctacaagaactcttgtagaatttaaattaaaaaatatataaagtgcttaatgcatttatatacatagaarcacatgtatgcataagtatatgtgtacacacacacacacacacacacacacacacacacacatatatacatacatacaaacagcctgctaagtatgaggc

SEQ ID NO: 62880 - DNA, 201 bp, Homo sapiens
gatcccaaaaaactgttgccatgaactctgctctgttttttgtttgtttgttgttttttgtttgtttgttgttttttaagagacaaggtctttgtgtcacygaggctggagggcagtggcgcaatcatagctcactgcagcctggaactcaagtgatcctcttgtttcagccccctgagtagctgagactgtaggcctgtg

SEQ ID NO: 62881 - DNA, 201 bp, Homo sapiens
catgcaaattgcccttgtttgatgagaggaatgagcaggagcattgtcatggtggagaaggactctttggtgaagctttccatgggagtttttctgctaargttttggctaactttcccaaaacactctaataatcagatgttgttgttccttggccctccagagagtcaataaacaaaatgcctgaagatcccaaaaaac

SEQ ID NO: 62882 - DNA, 201 bp, Homo sapiens
gtttccatgaacatttacatacacagtttgtatggctatgctttcatttctcttcggtgtatatacctagagtttataattgtcgtatgttgttgctgctrcttctgtttgtttagtgattttcctgatctgattctgtaaaatctgtattcttttttatatatggctactgaaatctctctttggtttgcttaatgatca

SEQ ID NO: 62883 - DNA, 201 bp, Homo sapiens
aatgttacttgtcatttagtattattattaaggactattgtgttacaacattatacagttgctcaagcaaacagcgcctttgacatttggacatgtacacrcaaagttatataacttaaccctatgtcctttcatattgtgttaaaagtttttgcttgtctttttaagttcatatactgtaatctgaatgtagagtagaat

SEQ ID NO: 62884 - DNA, 201 bp, Homo sapiens
gggatactaaccttcaaagaacaggcagaggacataaaggaagccatctgagagttagtaggagaaacaggagagagaaataccaccaaaaagaggtatgrtgtctgatgaaatagaggttatagtaatctgagaactgaaaagtatccatggcttgttaattaatgggtattttgtgactgtttggtatccgtagagtgg

SEQ ID NO: 62885 - DNA, 201 bp, Homo sapiens
cataagggtctaccttgggcctaggtttgaaacctggggatactaaccttcaaagaacaggcagaggacataaaggaagccatctgagagttagtaggagraacaggagagagaaataccaccaaaaagaggtatggtgtctgatgaaatagaggttatagtaatctgagaactgaaaagtatccatggcttgttaattaa

SEQ ID NO: 62886 - DNA, 201 bp, Homo sapiens
cagtcccaggaaatcactaatctgttttctgcctgtataaatttgctttttctaggctcttcttcataaacgtgatcgttcaatatgtcatcttttgtgtmgagcttctttaacaatgcttttgagattcatgcatgacatagcatgtgccattaatttgttcctttttatagttgaataatattccattgtgtggatatg

SEQ ID NO: 62887 - DNA, 201 bp, Homo sapiens
ttaatcttgaaatatgaatttaaaggagggacagaggtcactggcatatgggtgataattaaaactatgggagatgaatgacataacataagggtctaccktgggcctaggtttgaaacctggggatactaaccttcaaagaacaggcagaggacataaaggaagccatctgagagttagtaggagaaacaggagagagaa

SEQ ID NO: 62888 - DNA, 201 bp, Homo sapiens
atgaaatggaagtaatagttaaataaaagtgaatgtacacacattcacagtaaattgattttacttttgaaattatgcaaattctaaacaagtgttaaatwttggttccaaataatgaaattatgtttcttctcaaatactagattagtgattgaattaaaatcagttgaattattctcacaattaggtaaatacgtgcta

SEQ ID NO: 62889 - DNA, 201 bp, Homo sapiens
agtgaaccacctgcctcagcctcccaaagtgctgggattacaggcatgagctgtcatgcttggcccttgaatttagttttgaatgtgttgaacttgagttrtttctgggatattaatcttgaaatatgaatttaaaggagggacagaggtcactggcatatgggtgataattaaaactatgggagatgaatgacataacat

SEQ ID NO: 62890 - DNA, 201 bp, Homo sapiens
gaaacacagacacacagacacacacacacacacacacacacacacacacacacactcttaatttttcatgatgggaattgtttaacatttacaaaagtaamgcggtgaaaccccatgcatgtcttattcaccttcaacagtagtcaattcattgttttatctacgccagattattttgaagcaaatctcaacattatcttt

SEQ ID NO: 62891 - DNA, 201 bp, Homo sapiens
gtatagctacttacttgagtaggccttcattaaatcgttgttcaacagatgaatgtttctaattgctcctgtcaaagtaggtattgatctggatatttacrtatatacatgataaattatggcaagattatttattattggtgtttttataattttatttctcatctactctttatgaatatggtatatctgacagtcttc

SEQ ID NO: 62892 - DNA, 201 bp, Homo sapiens
aaatttaggaaaaacaaaatgaaccactaatgggtgataattttgtagagctctttaactttttaatccaaaaaattgtgtggactataaattaaaatttrtttccatcaactcatatatggttactcagcaaaattggaaatttgaactagattccaaaccttttgagttttaaaatattctaaatagtgtattatttag

SEQ ID NO: 62893 - DNA, 201 bp, Homo sapiens
ggcaacagagtgagaccctgcctcaacacaaaacaaaaaactcttcttgtcccttcttaaaacaaattacctatttgtaaactgctgatttctttgagtcrttgttcccataaacttttcataaggcctcaatgatttcaccatacttccattaatgcttcgatataaatttgatgtttgtttttgctttaacattagcag

SEQ ID NO: 62894 - DNA, 201 bp, Homo sapiens
tctttttaaacagccttttatatgattaaagataatttataaaatcttgctatatgtctcttactctgaatgttagtatgttattaatatactttgttttwtcagaatcatttttcttcagattatatatactattaaaacaagaacagtgtgttcttattcaacatctcagtttctaaattataaatgaattataaggta

SEQ ID NO: 62895 - DNA, 201 bp, Homo sapiens
gtcaagatacttttgtaagcaatgatagcagccatttagtccattcctaaagaatttacagtcctcagagtttaaccatgtcagtgcagtcttttttacaygagtaactaaaagaaaataggtttgttttaaaggtgtgtgtgtgtttttttttaatattaggaaacaaagtcagaaggagccacatcagaactgtaagtt

SEQ ID NO: 62896 - DNA, 201 bp, Homo sapiens
tagcaaggtatagctttgaatcacagctccaaaattgattgcttatatgcaatttggttaagtgtcttaaactctgcgagcctgggttttctcttctacargaactcttgtagaatttaaattaaaaaatatataaagtgcttaatgcatttatatacatagaaacacatgtatgcataagtatatgtgtacacacacaca

SEQ ID NO: 62897 - DNA, 201 bp, Homo sapiens
attttattggctgggcacggtggctcatgcctgtaatcctagcactttgggaggccgaggcaggtgaatcacatgagaggccaggcattcaaaaccagccrgccaagatggcaaaaccctgtctctactaaaaatacaaaaaatgagctgggcatggtggtgcatgtctgtaatcccagctacttcagaggctgaggcagg

SEQ ID NO: 62898 - DNA, 201 bp, Homo sapiens
aaaaagactaggaagtgagagattaaagagaaagagatagaaaggtacaggctattgttgcctatttgtggtctataccttgtctttaatctaaaaacctrgaaactactttctctatttctcttccttctctaaatcatgaaacttatttattactatagctcagctagatttttggttcaatagattattttttccatg

SEQ ID NO: 62899 - DNA, 201 bp, Homo sapiens
agtttagggcacaatggaaggaagcatgaataaatgattatgttgatatgatagcacattttttttcctttttcttttctttagttggagaacatcaattracaggccataaagtggcagttaaaatcttaaatagacagaagattcgcagtttagatgttgttggaaaaataaaacgagaaattcaaaatctaaaactct

SEQ ID NO: 62900 - DNA, 201 bp, Homo sapiens
aaattcatggaaaaatggaattaaaagataaaaataaaaaatataaacatttttaatttttaattttaatttcaattttttaattaaatagagatgatttwaaaaaaaaattaaatacagacgaggtctcactatgttgcctaggctcgtctcaaactcctgagctcatgtgatcctcctgccttggcctcccaaagtgct

SEQ ID NO: 62901 - DNA, 201 bp, Homo sapiens
gcaacgtggtaggcactgttctaggcaatgaggatacagcaaggaaaaaacagatctttttgtttagctttctagtaggagaaggcagacagtaatcagawtatatatgtaaaaggtatgtttaattttattgagaaaaacgaatcagggaagggaagatagagagtcttgtgaggttggcagttttcaataaggtggtca

SEQ ID NO: 62902 - DNA, 201 bp, Homo sapiens
tgttaggcaagtgtgtcttacatatagtcatttgtcgttcaaaataatttagaaagtgccttcttaagatgaaagtgtcttcttaagatgaaagatttatragaacttgaatttaggaagaatctctttttttctgcagtttaacttttgattaaaaaggaaacatcagattatatttgggactatatatctttgagaaaa

SEQ ID NO: 62903 - DNA, 201 bp, Homo sapiens
tatcttttttgttgttactgattccatcagaagttttctcccatgtagtaaagattgatacatttgttaggcaagtgtgtcttacatatagtcatttgtcrttcaaaataatttagaaagtgccttcttaagatgaaagtgtcttcttaagatgaaagatttatgagaacttgaatttaggaagaatctctttttttctgc

SEQ ID NO: 62904 - DNA, 201 bp, Homo sapiens
ggctgccaattccaacttgtcttttaagtgcaattacatttgacccttgaacggtatgggtttgaaccacattggtctacttatgcttgggttttatgccrcctttgctatcctgagacagcaagaccaacccctcctcttcctcttcctcctcagtctactcaatatgaagatgacaaggataaagaccttgatggtgat

SEQ ID NO: 62905 - DNA, 201 bp, Homo sapiens
atctccctttccctaggctgccaattccaacttgtcttttaagtgcaattacatttgacccttgaacggtatgggtttgaaccacattggtctacttatgmttgggttttatgccgcctttgctatcctgagacagcaagaccaacccctcctcttcctcttcctcctcagtctactcaatatgaagatgacaaggataaa

SEQ ID NO: 62906 - DNA, 201 bp, Homo sapiens
aaaaaaagaaaagaaaagaaaacaacttatttaggtatattttatatatgaaattcatccattctaagtgtacaattcagtgatttttactaattttgccraatgttgcaaccatcattatagataggttttaggacatttgaggacaccacagtaagattctttatacccattcacagttaatctcatttctaccctcag

SEQ ID NO: 62907 - DNA, 201 bp, Homo sapiens
aaggttgctgaccaccccatgaggcccaactggctgatacatgtgtgatctcttggctcgtcacagcttaggtatatagtgtcctccaaatgttcttaacktttttattgtactccatatacaagagtatactggcatcttttacgtaaattctcaataaattttcacaaactgaacacatccacgtaaccaccactttga

SEQ ID NO: 62908 - DNA, 201 bp, Homo sapiens
ccagttctaccaggtaataatgcctaaacaatctcgaaggagtagtttgtgttagatgaaaatggtttggtattctaggataacaatagtaacatcaagcrcaaaggcccagaagtgtgagaaaataaggcttaggagagcagttctcagactttttgattttaaaatcttgtaactcttaaaaattattgaggacctcaa

SEQ ID NO: 62909 - DNA, 201 bp, Homo sapiens
tgtcatatttatcagtgttttcttgccttcatttctatatttactttcaatcattttatttttgtttgactgtctcatcctgattatttaattatttgctrttttctgaaggaattatagaagattgtcagagttggtcagaaagtaattggcagaggtgaatttgcagtttaaaacttttggcttccagccttgagatta

SEQ ID NO: 62910 - DNA, 201 bp, Homo sapiens
attaatatactttgttttttcagaatcatttttcttcagattatatatactattaaaacaagaacagtgtgttcttattcaacatctcagtttctaaattrtaaatgaattataaggtaagttaaactgactgtcataaaacaatagatctaacatttttaaatataccatacttttttttttctaaatgcttgttttact

SEQ ID NO: 62911 - DNA, 201 bp, Homo sapiens
tactgctttgtaataataataccaccccatttattcttctgagattcctgtggtttcctaaatgatagagaaaatattttgtagaggaagtattaataatktttgaagccaagcagataatttaatttgacctagcaggaagatctaatctcaaatcctttaagaaataatgagtaagtggctggcacaagacccttaaag

SEQ ID NO: 62912 - DNA, 201 bp, Homo sapiens
accatggctttctagaataccatatttattgttatttaagttgtttgagatgcaatacttttgaatccatacacaatactgtaacaggtacctgctaatayaatgttacaaccacaggtgttttttttcacttgtctttttgagttataatcttcactatgttgtaactatttagtatactaatttttaaagtaatcttta

SEQ ID NO: 62913 - DNA, 201 bp, Homo sapiens
gtgatctcttggctcgtcacagcttaggtatatagtgtcctccaaatgttcttaacgtttttattgtactccatatacaagagtatactggcatcttttaygtaaattctcaataaattttcacaaactgaacacatccacgtaaccaccactttgataaagacatggaaaatgaccagtatcccagaagtccccttgtgt

SEQ ID NO: 62914 - DNA, 201 bp, Homo sapiens
ggaaatttggagaagagcaatgagattgttttgtttcaccatgggcagaggtgaaaggagcgttgtgttgttttggcaggagtctggggatggtaggggtyggaacatatgtgcattacataacgctgctgatcaccagagttacggcttttgacatgaatgagttaaggttgctgaccaccccatgaggcccaactggct

SEQ ID NO: 62915 - DNA, 201 bp, Homo sapiens
agctggattttgaatggaaggtaggaaattataatgtaataagatcatttgtagaagccatttttctatattataagctgctctgagctcctgagttgagyattaagcccaactttttctagtaatatgctatgcacattaaaaacaaaacaaataacctctataaggatgaaaagtggttgatactgggaaccaacatat

SEQ ID NO: 62916 - DNA, 201 bp, Homo sapiens
aggaagatacaggatcaatggaaaagttttggagggtatatgatttggataggcttaagagaaatagccattagaaaaggaaaaaggttgaatatgaggasagtgtagaaaagatgggttcaaggccaaagttgacgagactggctttgaataggaggagggatgtggacagaagtaagcctttaagatagaggaaattgg

SEQ ID NO: 62917 - DNA, 201 bp, Homo sapiens
tggagtactctgactgagggtattactctgtggcagttatgctggctctgaagtcagacagcccaggtcagatgttatgccatcacttactgtgtgacctygggtgacttatttagctcctctgtgcctcaggtttctcatctatacactggagggtaataatacttcatagagttgagagagcagggaagctagcactta

SEQ ID NO: 62918 - DNA, 201 bp, Homo sapiens
tgccgcagcctcccaaagtgctgagattacaggcttgagccactgcgcccaggcccgaagacttatttttgatgtcatatttatcagtgttttcttgcctycatttctatatttactttcaatcattttatttttgtttgactgtctcatcctgattatttaattatttgctattttctgaaggaattatagaagattgtc

SEQ ID NO: 62919 - DNA, 201 bp, Homo sapiens
gcagtacttgattataaggttatcatccaggacctatgtattagatggtccagagtatgtatatagaggtttttaaagattgtcataagaattaaaattcyacccatgagcttggtgactcacctctcctatcctttgtttctttaactttaaaatgggacacctcatttgaggattaaatgtgttggcactggtataatg

SEQ ID NO: 62920 - DNA, 201 bp, Homo sapiens
gatcttaaaacaaaaaacaaacaaacaaaaaaacactcatgtatttttgctacagaagaagcttattgacatcgtctgtaacagtgttagtgatttaaacrgagagagcaaccttaccctttcagtggttttcttttgtgtagccttggactgtcaggaatagtttccttattgcaaaagtgggactctagaattagcaag

SEQ ID NO: 62921 - DNA, 201 bp, Homo sapiens
gctaaatctctttgctcttccccactgagtgtccacttcctatgagaagagaaagctgaaatagccagactaaaagtgtcatatgctagaatgaaagtggrgaagggaaagatctttccatatttgccttataccttgacctcatcacttttacaatgccaaccctgaaagactttgaggaaattttacccgtttgggtat

SEQ ID NO: 62922 - DNA, 201 bp, Homo sapiens
ggctggtctcaaactcctgacctcaggtaatccacctgccttggctgggattacaggcatgagccactgtgcccagccccagatattcttaatgcagtttyttttgtgcttgataggttgaagagatggaagccaggcggctctttcagcagattctgtctgctgtggattactgtcataggcatatggttgttcatcgag

SEQ ID NO: 62923 - DNA, 201 bp, Homo sapiens
gtctcttgcttccttgtgagaaccatcctttagagaactttaaaggattttcagggaaaggaaatttggagaagagcaatgagattgttttgtttcaccaygggcagaggtgaaaggagcgttgtgttgttttggcaggagtctggggatggtaggggttggaacatatgtgcattacataacgctgctgatcaccagagt

SEQ ID NO: 62924 - DNA, 201 bp, Homo sapiens
agttctgtgtcttgtatataaagacaaatgtgtcaaaactgaaaagcatccagaaagtggcaaccgaaatcgtcaagaggcaggagtggcttaaaagcttkatacccttcaatgtggaatgatcctcagggatatcattaggaaagtcttagagttggaaggggaattagctttgatctactccaacctgttatttaatgc

SEQ ID NO: 62925 - DNA, 201 bp, Homo sapiens
gaattatcttttagatgattaatagcagattagattccattgaagagaggattagtgaattagatgatgggtcagaagaaaatacccagactgaaagataracaaaaggatgaaaagaaagtataagacacatatgagaacacagtgaaaagtctaatacatgtattattggaagctatatagaaaaagttaattgcaaac

SEQ ID NO: 62926 - DNA, 201 bp, Homo sapiens
atacgggcttcccaacttcatgtacccctgtgtgatgaggaggcatggaagtagcagctgaatattttaaggacttctgatgaagatgtttttggttatgscatcctgacgttctgtgtttctgtcctaagttctcataaaaagctaagtaaaactgatgtaacattaccaccttttgtatcctgaggtatgaatgtcatc

SEQ ID NO: 62927 - DNA, 201 bp, Homo sapiens
ctgatttattatagccattctagtgggtgcgaaatagtatctcattgaggcattaattttgtgtttccctaaggactaatgatgttgaacattgtctcacrtaattactagtcatttatgtattttcattgatggaatgtctgtttatatctcttgcttattttctaattgggttacttgtcatcttataagttgagttgt

SEQ ID NO: 62928 - DNA, 201 bp, Homo sapiens
ttccaacataattctagcttgcttaattatatttagcctaattatgaaattaaaactcttgtcaaatagatgtctcagattttttttttttttttttttttgagacagactcttgctctgttgcccaggctggagcgcagtggcatgatctcagctcactgcaacctctgcctcctggtacaagcaattctcgtgtcccac

SEQ ID NO: 62929 - DNA, 201 bp, Homo sapiens
agtagagacggtgtttctccatgttggtcaggccggtctcgaactcccgacctcaggtgatccgcccgcctcggcctcccaaagtgctgggattacaggcrtgagccacggcgcccagcatcatttttatcttttcaattcattttctataccacaaacaaaatgatctttacagaatgataactaggttatgctaccctg

SEQ ID NO: 62930 - DNA, 201 bp, Homo sapiens
atgtgccaccacgcccggctaattttgtatttttagtagagacggtgtttctccatgttggtcaggccggtctcgaactcccgacctcaggtgatccgccygcctcggcctcccaaagtgctgggattacaggcatgagccacggcgcccagcatcatttttatcttttcaattcattttctataccacaaacaaaatgat

SEQ ID NO: 62931 - DNA, 201 bp, Homo sapiens
gcctcagcctccctagtagctgggattataggcatgtgccaccacgcccggctaattttgtatttttagtagagacggtgtttctccatgttggtcaggcyggtctcgaactcccgacctcaggtgatccgcccgcctcggcctcccaaagtgctgggattacaggcatgagccacggcgcccagcatcatttttatcttt

SEQ ID NO: 62932 - DNA, 201 bp, Homo sapiens
ccgggcgcggtggctcacacctgtaatcccagcactttgggaggccgaggcgggtggatcacgaggtcagcgaccatcctggctaacacggtgaaaccccrtctctactaaaaaaatacaacaaaaaattagctgggcatggtggcaggtgcttgtagtcccagctactcgggaggctgaggccggagaatggcgtgaacc

SEQ ID NO: 62933 - DNA, 201 bp, Homo sapiens
tttttttttttttaaggcagggtctcactctgtcgcccaggctggagtgcagtggtgtgatcacagctcactgtaggtagcctcaacctcccaagctgagktgttcctcccaccccaggctcctgagtagctgggactataggcacaagccaccacacccagctaattttttttaatttttttatttttagtagaaatgga

SEQ ID NO: 62934 - DNA, 201 bp, Homo sapiens
tgctgatgcgcctatgaatatgacctttgtatatcccacacctgtgtatagtagcaagatgattcactgcatcctgcctatgacttatcaaggcatgtttyttagaggttttttcttcttacctaagatttcatccgtgtttgtttacaaacatgttcttttgacatctttccagaactctttccccttttcatcattagc

SEQ ID NO: 62935 - DNA, 201 bp, Homo sapiens
acatatggttaaagacataaagcataaaaagttttgctaagtttttgaattcaatagctgctagtcagcttactgtgaaggcttttttgtcacttgagaaagtttggaaagtgccattgctgatgcgcctatgaatatgacctttgtatatcccacacctgtgtatagtagcaagatgattcactgcatcctgcctatgac

SEQ ID NO: 62936 - DNA, 201 bp, Homo sapiens
gcattttccttatttaatttaatattatcttcatgatcagtgtctaaagtaggcttactttatagacaaggaaactgcattatctaaaaagtaatagcagyttatccaaggccacacagctagtaagtcacagagctggtagttgaggtcaaacctgattccaaatgccatgctgttaatgctccagcattccagtttttc

SEQ ID NO: 62937 - DNA, 201 bp, Homo sapiens
ccagagcaggaattagcaacttataaactaattccagtcctctttcattattccaaatggttttcacttaactgaaacagttagtctctgacttcaactcygtattattcatgactttgttctagttactgggtaacatctaagctaaatctctttgctcttccccactgagtgtccacttcctatgagaagagaaagctg

SEQ ID NO: 62938 - DNA, 201 bp, Homo sapiens
gatacaggataaatactgtctacacagtactaattaagtactttaatgttttaaatatctctctctctatatatatgatatattatatatatatatatatatattttttgttttgagatagagtctcgctctgtcacctaggctagagtgcagtggcacaatctcagctcactgtaccacctcctgggctcagatgatcct

SEQ ID NO: 62939 - DNA, 201 bp, Homo sapiens
atgtgatacaggataaatactgtctacacagtactaattaagtactttaatgttttaaatatctctctctctatatatatgatatattatatatatatatrtatatattttttgttttgagatagagtctcgctctgtcacctaggctagagtgcagtggcacaatctcagctcactgtaccacctcctgggctcagatga

SEQ ID NO: 62940 - DNA, 201 bp, Homo sapiens
atgtgttggcactggtataatgcctagtgtttgataagcattggcccagagcaggaattagcaacttataaactaattccagtcctctttcattattccaratggttttcacttaactgaaacagttagtctctgacttcaactccgtattattcatgactttgttctagttactgggtaacatctaagctaaatctcttt

SEQ ID NO: 62941 - DNA, 201 bp, Homo sapiens
tcccgggttcacgccattctcctgcctcagcctcccgagtagctgggactacaggtgcccgccaccatgcccagctaattttttgtatttttagtagagayggggtttcaccgtgtttggtttagccaggatggtctcaatctcctgaccttgtgatctgtccgcctcggcctcccaaagtgctgggattacaggcgtgag

SEQ ID NO: 62942 - DNA, 201 bp, Homo sapiens
tccaggacctatgtattagatggtccagagtatgtatatagaggtttttaaagattgtcataagaattaaaattccacccatgagcttggtgactcacctytcctatcctttgtttctttaactttaaaatgggacacctcatttgaggattaaatgtgttggcactggtataatgcctagtgtttgataagcattggccc

SEQ ID NO: 62943 - DNA, 201 bp, Homo sapiens
aggttatcatccaggacctatgtattagatggtccagagtatgtatatagaggtttttaaagattgtcataagaattaaaattccacccatgagcttggtractcacctctcctatcctttgtttctttaactttaaaatgggacacctcatttgaggattaaatgtgttggcactggtataatgcctagtgtttgataag

SEQ ID NO: 62944 - DNA, 201 bp, Homo sapiens
tgagtgagaacatgcggtgtttggttttctgtccttgtgatagtttgctgagaatgatggtttccagcttcatccatatccctacaaaggacatgaactcmtccttttttatggctgcatagtattccatggtgtatatgtgccacattttcttaatccagtctatcactgatggacatttgggttggttacaagtcttcg

SEQ ID NO: 62945 - DNA, 201 bp, Homo sapiens
taaaaatacaaaaattagccgggcatggtggtgcatgcctgtagtcccagctactcgggaggttgaggcaggagaatttcttgaacccaggaggtggggtrcgcagtgagccgagagcatggccgctgcactccagcctgagtggcagagcaagactctgtctcaaacaaaagaaaaaaagtaactaattttaacgtctcc

SEQ ID NO: 62946 - DNA, 201 bp, Homo sapiens
gaggggtggtggggaaatagacaataaatcccttattatatgttatatgttagacagtgaagaggtgaggggatatgccatgtagatatctgaagggggtraatgttacacatagagggaagagcaaatacaaaggaaagtagaaattcctgcaggtcagagatcaagggagcagaatgatctaggaagattagagtgaga

SEQ ID NO: 62947 - DNA, 201 bp, Homo sapiens
aaaaaggcaacaacaacaaaatccttgctattatagagattatattagtgtgtggtggaggggtggtggggaaatagacaataaatcccttattatatgtyatatgttagacagtgaagaggtgaggggatatgccatgtagatatctgaagggggtaaatgttacacatagagggaagagcaaatacaaaggaaagtaga

SEQ ID NO: 62948 - DNA, 201 bp, Homo sapiens
tgggaaaaaaatttattttatcaaataaagctaattttttttcttagtttttaatgtgcccagctttggatgcctagaaacacagacacacagacacacasacacacacacacacacacacacacacacactcttaatttttcatgatgggaattgtttaacatttacaaaagtaacgcggtgaaaccccatgcatgtctt

SEQ ID NO: 62949 - DNA, 201 bp, Homo sapiens
agttgtagtttttgggaaaaaaatttattttatcaaataaagctaattttttttcttagtttttaatgtgcccagctttggatgcctagaaacacagacasacagacacacacacacacacacacacacacacacacacacactcttaatttttcatgatgggaattgtttaacatttacaaaagtaacgcggtgaaaccc

SEQ ID NO: 62950 - DNA, 201 bp, Homo sapiens
agtagctgggattacaggcatgtgccaccacgcctggctaattttttatttttagtagacatggggtttctccatgttggtcaggctggtctcagactctygacctcaggtgattcacctgtctcggcctcccaaagtgctgggattacaggtatgagccaccgcacctggccaaaactctttagtggtagagtagatgaa

SEQ ID NO: 62951 - DNA, 201 bp, Homo sapiens
acaacctaaatactcttttttttttttttttgagacagagtttcactcttgttgcccaggctggagtgcaatggcgtgatctcagcttaccgcaacctccrcctcccaggttcaagcgattctcgtacctcagtctccctagtagctgggattacaggcatgtgccaccacgcctggctaattttttatttttagtagaca

SEQ ID NO: 62952 - DNA, 201 bp, Homo sapiens
agtggtagagctagcaatcaaattcagggttctcagactgcaaagtctctgctctatggactgtaaagtcaaaatgcctagtatgttctgagtttcaaacytacaaggatataattttctatgtctgctcatatttatcagaattgagaaaataagatttaaatgtctttcagtccatatttagagataaataacgttttt

SEQ ID NO: 62953 - DNA, 201 bp, Homo sapiens
cttggcaatgtgggctcttttttggttccatatgaactttaaagtcgttttttccaattctgtgaagaaagttattggtagtttgatggggatggcattgmatctataattaccttgggcagtatggccattttcacgatattgattcttcctatccatgagcatggaatgttcttccatttgtttgtgtcctcttttatt

SEQ ID NO: 62954 - DNA, 201 bp, Homo sapiens
gcttactttatagacaaggaaactgcattatctaaaaagtaatagcagtttatccaaggccacacagctagtaagtcacagagctggtagttgaggtcaarcctgattccaaatgccatgctgttaatgctccagcattccagtttttcttaaaactgagagttatataaattccttttaaagaaaaaataaatttatgga

SEQ ID NO: 62955 - DNA, 201 bp, Homo sapiens
tatgatatatgcacttgatttttttttattcccagagtaatcctctaagtttggtattatctccatttaacaaatgaagaaattgagaatcagatactttragtaacttgtccaaagttccagtgctattaagtggtagagctagcaatcaaattcagggttctcagactgcaaagtctctgctctatggactgtaaagtc

SEQ ID NO: 62956 - DNA, 201 bp, Homo sapiens
cttgttagtctggtagagatgatcttgtctaatttttttttttttttttgagacaaagtctcgctctgttgcccaggctggagtgcagtagcatgatctcrgctcactgcaacctccgcctcctgtgttcaagcgattctcctgcctcagcctcctgagtagctgggactacaggcacacaccaccacacccagctaattt

SEQ ID NO: 62957 - DNA, 201 bp, Homo sapiens
ataatacaaaatttgaaatttttgcttgaaagcttgaattttatcattggcaacaaatattgctggttgttttccttaaagcgatgggcttgcttttttcrtttttgagaaaatgttgtccaaatgccaagtcttaataaccatagttattcaagggtggtgggtaattaacttgctcaggatcacatagctagtaagtgg

SEQ ID NO: 62958 - DNA, 201 bp, Homo sapiens
gttttttaaaagtatatggaaatctttgtatttgttaataaagccttatttaaaatgttttaaattttgtccttcattagtctattgtattatcaggttgmtgagggactgtttttggaaacagattatatgggctgacagagtttaaaagtaatgctttttatctatttaaaatttttctctatattgactgttcaggct

SEQ ID NO: 62959 - DNA, 201 bp, Homo sapiens
gagttctctcctgtccaaacaatgttctaaagttgattatgtttttagtaagaatatagaattcagtaatcattttcacaaatattccacaaataggaacrtctctgttaggtgcaaaagatacagagatgactaagatacagtttctgtcctcagagagtgcatactctaatagaagaaatagaagtaaaaagaactgta

SEQ ID NO: 62960 - DNA, 201 bp, Homo sapiens
ctatgactcagcagttgcactcatcagtgtatatcaaggagaaaatcttgccatgtagaagaatgttcgtgttagtccatttttacattactataaaggartactgaaggctgggtaatttataaagaaaagaggtttaattggcccacagttctgcaggctgtacaggaaacatggtgctggcttttacttctagtaagg

SEQ ID NO: 62961 - DNA, 201 bp, Homo sapiens
aaagagatagagattccatcaaatgggggaaaataagaggactttatgaaaaaggcacaaaaaagggctaggtgtgaattctctgttgaaatagtaattaytgtgaatttttgatttattacactatttattcttctatgactggcattaaacagaagaagagaaacaaagagattaatgaaacagtgagttctctcctgt

SEQ ID NO: 62962 - DNA, 201 bp, Homo sapiens
tacagataaacaagaagtccaaggactgagctctagagcactatgatgttaacatgtctgtttatatcacagattatctataaagatatcacttacacctraaacagtgacagtagtagcaatggggaaaaagacattaattcagaatgagaaggagttagtaagaagattgattgatgactataatgtgaaaaggtatga

SEQ ID NO: 62963 - DNA, 201 bp, Homo sapiens
actgtgattgccacacttccaaagagaagaaaaacttttcaagcaccaaaaaagtagcttaaaaacaaattttgtacaccagtcagggactctttagagtrcactcataggtgggaattgaacaatgagatcacatggacacaggaaggggaacatcacactctggggactgttgtggggtggggggaagggggagggata

SEQ ID NO: 62964 - DNA, 201 bp, Homo sapiens
ttaggaaggcaaatgtgtttttttccccttggaataaattataaacttaaaagttaggtaaatattgagataaataagataagtaattgaaagataaatakattattttaaaattgactagaccctagaaaatttaaatattcattgtgcaataatgtgtttctttcagtcatttaaagttgcagtttaatatttgttggg

SEQ ID NO: 62965 - DNA, 201 bp, Homo sapiens
ctcctgcctcagccttgtgagtagctgggattacaggtgcccaccgccacacccagctagtttttgtatttttagtagagacagggtttcaccatgtttgycatgctggtctcaaactcctgacctcaagtgatctgcccaccttggcctcccaaagtactgggattacaggcttgagccaccacacccagcctagctagt

SEQ ID NO: 62966 - DNA, 201 bp, Homo sapiens
tggtggaggggtggtggggaaatagacaataaatcccttattatatgttatatgttagacagtgaagaggtgaggggatatgccatgtagatatctgaagkgggtaaatgttacacatagagggaagagcaaatacaaaggaaagtagaaattcctgcaggtcagagatcaagggagcagaatgatctaggaagattagag

SEQ ID NO: 62967 - DNA, 201 bp, Homo sapiens
agtagtaggtattcaataattacttgtagctccataatgacatttgaacaaggtcctgatggctctaggagtccaagcaagaacaaaagaatgaaagtgtraggaatatggtgtattgggaacaaacagtctggtttgtttggtgcacagagtatgtatagggaagtggaaaaataaagccagaaaggcaggttgttggtt

SEQ ID NO: 62968 - DNA, 201 bp, Homo sapiens
ttatctagtcaattttcactaacattcagggtattttttcctttggaaagatagaaagtatatgtcaaagattatttcacatagtatattacttgtagaastgaaagtagtactataaccataaagcttttaggaaggcaaatgtgtttttttccccttggaataaattataaacttaaaagttaggtaaatattgagata

SEQ ID NO: 62969 - DNA, 201 bp, Homo sapiens
tacacaaacaaaagtttatatctgtaatatacatagaagaaattcttgaccttaaatctgtatttattacaagattttcaggaacattcattcagctttcrggtggaatgtggttaggtttggatttaattatggttaagtaccaattatgacgttattaggcaaaaaaggctaaatccccattgtagggatttcagtgct

SEQ ID NO: 62970 - DNA, 201 bp, Homo sapiens
ttagtgttggctaatacagtagccagtggccacatgtggctgtgtaaatttaaattaattaaaatgaaaaatttggttgtctggtcacactagccacattycaagtacttaatagctgcatatgtttagtgaccactgtgttggacagagcagataaaaaacatttctatcgttgtaggaagttctgttcaacagtcctgg

SEQ ID NO: 62971 - DNA, 201 bp, Homo sapiens
catgaattatttccaggggcacacaatgctattgaaattactgaaaacaaaatatctgacatcttatttacttgtagaaatctgtaattctattgtgcctrtgataaattcacataggcaatatctttaataggttaatatcaatgaagatttttaattacaataatgagttcactacagacgattaacacaccacactgg

SEQ ID NO: 62972 - DNA, 201 bp, Homo sapiens
tagcgatgtttgttatgattgttggaaggaagaagactgtgtttctacaacacagaaacatgacattcattattaagttgcccttgctcagatgtgtttayttaatattctgaatatcataaattcataggaagggcttgggcatatatactttccatataaattgctcttctttggtccatttcagatgaagtagtggag

SEQ ID NO: 62973 - DNA, 201 bp, Homo sapiens
ctttcacatatgttctgttttagtttgttttactgtcaattccccaaaacattgtgcacatttaataatattaattgaaatttaaatatttctgcttagcracaaagacaaacttgtcttttgacatgttgagctttgacaagcttttggttggtttattttgtctgatttgttgagaattccaacataattctagcttgc

SEQ ID NO: 62974 - DNA, 201 bp, Homo sapiens
caccatttaggcactagggatacagcaacagacaaaaaggcaacaacaacaaaatccttgctattatagagattatattagtgtgtggtggaggggtggtrgggaaatagacaataaatcccttattatatgttatatgttagacagtgaagaggtgaggggatatgccatgtagatatctgaagggggtaaatgttacac

SEQ ID NO: 62975 - DNA, 201 bp, Homo sapiens
tcaccacctcaccccagtactcatgcttcagccacattgaacttgtccttgtttctcaaacctaacatagattttatgccttcatgtctttgtttatattrttcactttgccttgatgtcttttcttgtttcttttttgacctgatagacttccattcatccattaaagttcatgccaccccttttgtgatttccacacgt

SEQ ID NO: 62976 - DNA, 201 bp, Homo sapiens
gagtttagagttagggaagttgttttaaacgaagcatttaaattttactcttgaactaccatcaactatgtatggtagtgtttatatggatcccagacctrtttcatcgaaattacatgttgttgttattaaaacgcagatccctgggaaccactccagacctattaaatcagaatttctggagattggtcctgggaatcg

SEQ ID NO: 62977 - DNA, 201 bp, Homo sapiens
ggtcaggccggtctcgaactcccgacctcaggtgatccgcccgcctcggcctcccaaagtgctgggattacaggcatgagccacggcgcccagcatcattkttatcttttcaattcattttctataccacaaacaaaatgatctttacagaatgataactaggttatgctaccctgtctctttaaaatccttcaatgattt

SEQ ID NO: 62978 - DNA, 201 bp, Homo sapiens
gttgccagggacatttctgctttatatctcattggctggaacatactcaggtggccacatctattaatagttacaagagaggctaagatgcaggctgtackctgggtagccatgtactcagttgtaatttgggagtttgatgtatgggagaaagaaagatgcagaagatattgggggacaaccagcagtgtaatgtaatta

SEQ ID NO: 62979 - DNA, 201 bp, Homo sapiens
ctctacaaaaaataaaaaattagctgagcatagtggtgcacgcctatggttacagtttctctggaggctgaggtgggagaatcacttgacacagaaggtcrgggttgcagggagcagtgattgcatcactgccttccagcctgggcaacagagtgagaccctgcctcaacacaaaacaaaaaactcttcttgtcccttctt

SEQ ID NO: 62980 - DNA, 201 bp, Homo sapiens
agtgggtgcagcacaccagcatggcacatgtatacatatgtaacaaacctgcacattgtgcacatgtaccccaaaacttaaagtataaaaaaaaaaaaaaagaaataccaccttcagcaccttgtccagtggagcatgtgaaattaagtacttagattctttttgtggactgaagcttcattttctttgggctagttcaaa

SEQ ID NO: 62981 - DNA, 201 bp, Homo sapiens
cacttgagcacttttaatttatgcatttctgttggttataatacttgggagtgaaatcactgagtcatagagtatatacatgttcagttttagtagttacscattttgcatcaatttattgttttcccaagtgtttgcactaatttacattccctccagcaacctataaaagttccagttgctgtatttcttgactaatac

SEQ ID NO: 62982 - DNA, 201 bp, Homo sapiens
attaaaaaatatataaagtgcttaatgcatttatatacatagaaacacatgtatgcataagtatatgtgtacacacacacacacacacacacacacacacacacacatatatacatacatacaaacagcctgctaagtatgaggcacgcattaccattactattagctgcctttcagaattacctgttttctattgatatc

SEQ ID NO: 62983 - DNA, 201 bp, Homo sapiens
aattaaaaaatatataaagtgcttaatgcatttatatacatagaaacacatgtatgcataagtatatgtgtacacacacacacacacacacacacacacacacacacatatatacatacatacaaacagcctgctaagtatgaggcacgcattaccattactattagctgcctttcagaattacctgttttctattgatat

SEQ ID NO: 62984 - DNA, 201 bp, Homo sapiens
aaattaaaaaatatataaagtgcttaatgcatttatatacatagaaacacatgtatgcataagtatatgtgtacacacacacacacacacacacacacacmcacacacatatatacatacatacaaacagcctgctaagtatgaggcacgcattaccattactattagctgcctttcagaattacctgttttctattgata

SEQ ID NO: 62985 - DNA, 201 bp, Homo sapiens
gtctcactctgttgcccaggctggagtatagtggcacaatcatagctcactgtaatctcgaactcctgggctcaagtgatcctccgtgatcctcctgcctycttttttttttcttttttggaggcagagtgttcctctgtcccccaggctggagtgcaatggcatgatcttggctcactgcaacctctgtctcccgggctc

SEQ ID NO: 62986 - DNA, 201 bp, Homo sapiens
ctactcgggaggctgaggcaggagaattgcttgaaccggggaggcagaggttgcagtgagccgagatcgtgccactgcactccagcctgggtgacagagcragactccatctcaaaataaataaataaataaataaaactccagcctgggtgacagagcaagactccgtctcaaaataaataaatgaatgaaagaaggaag

SEQ ID NO: 62987 - DNA, 201 bp, Homo sapiens
gagtgattcagtcaagaggaaggaattgatacaaaagaaagaggggctaattatagaagccaagtcccttcgtaggtgtgggagataatccagtgcataaytggaggagttagtctttgaaagtatatgaccatggagtggttggctgtgtgtggtggaagaaaagataattagaaatgaggcattcaaagaacttaaagg

SEQ ID NO: 62988 - DNA, 201 bp, Homo sapiens
tgttcttcaaaaataaaggtaagctgggcgtggtggctcatgcctgtaatcccagcactttgggaggccaaggcggggatcacctgaggtcaggagtttgrgaccagcctggccaacatggtgaaaccccgtctttactgaaaatacaaaaattggccagatgtggtagcacacatctgtaatcccagctactcgggaggc

SEQ ID NO: 62989 - DNA, 201 bp, Homo sapiens
gtctttgaaaagaaccaatttattggaatgatgagggcaaaaacctgatgtaaagggtttaagagggaatatgagataaaaaaggggagatagtaactatmggcaggagaggagagacataggagtggtaaccagaaggaaatgaggagtctaaacaaggttagctttttaaaatgggagatattgtagaatgttggtatg

SEQ ID NO: 62990 - DNA, 201 bp, Homo sapiens
agtggtagagtagatgaataaatacaataggatataacaatggtcaaatcaaataactacagcaaacacaacaataggattgaatctcaataaaataactwctagaatattacatagagcgtgatacctggtttttaaagcaaagaacagtttaacatatatatgaatttgaattattcatatatatgaaatatacatatg

SEQ ID NO: 62991 - DNA, 201 bp, Homo sapiens
tgaggatcaactgtacccctgaaaacctactttactcactaagactaggttaggctctaactcctctttgctctcaaagcactcaatgttcaccttttccraagcccttaaattgtgttgtaattgcacattttcttattggtatttcccacaagactgaagtacttaggagcaggaattatggttttttttttaattcaa

SEQ ID NO: 62992 - DNA, 201 bp, Homo sapiens
taaaaaaatcattttactgtttctcacaatgtatgtatttatatacatatatatatatatatatatatattttttttttttttttttgtagagacagggtytcactgtattgttcaggtagtctcaaactcctgggctcaagtgatccacctatattggcctcccagaatgctgagattatagacatgagccaccatgccc

SEQ ID NO: 62993 - DNA, 201 bp, Homo sapiens
ctctagcttactttactataagaatacagtaaataatacatttaacatgcaaaatgtgtgttaattatttctgttatctgtaaggcttctgctcaacagtrggctattagtagttaagtttaggggtagtcaaaagttaaacgtggatttttgatgcacaggggttgacaccctaacccccacattgtctgaggatcaact

SEQ ID NO: 62994 - DNA, 201 bp, Homo sapiens
gttacacatagagggaagagcaaatacaaaggaaagtagaaattcctgcaggtcagagatcaagggagcagaatgatctaggaagattagagtgagagatraggtcagagacataaagggcattataggccattgtcagggctttggcttttactcttgtctaagatgggaagccattggaaggctttgattagtggtatg

SEQ ID NO: 62995 - DNA, 201 bp, Homo sapiens
agttattttcattttctttttaaaaaaatcattttactgtttctcacaatgtatgtatttatatacatatatatatatatatatatatattttttttttttttttttgtagagacagggtctcactgtattgttcaggtagtctcaaactcctgggctcaagtgatccacctatattggcctcccagaatgctgagattat

SEQ ID NO: 62996 - DNA, 201 bp, Homo sapiens
atgataagtataagttattttcattttctttttaaaaaaatcattttactgtttctcacaatgtatgtatttatatacatatatatatatatatatatatattttttttttttttttttgtagagacagggtctcactgtattgttcaggtagtctcaaactcctgggctcaagtgatccacctatattggcctcccagaa

SEQ ID NO: 62997 - DNA, 201 bp, Homo sapiens
gaaaatgttgtccaaatgccaagtcttaataaccatagttattcaagggtggtgggtaattaacttgctcaggatcacatagctagtaagtggcagagctrggtctagagaccagatcttttgattatattctattatattgccctatgtctaaattatttggacttgccaaaccatgtcttacaataatgtattgtggtg

SEQ ID NO: 62998 - DNA, 201 bp, Homo sapiens
ttgttttccttaaagcgatgggcttgcttttttcatttttgagaaaatgttgtccaaatgccaagtcttaataaccatagttattcaagggtggtgggtarttaacttgctcaggatcacatagctagtaagtggcagagctaggtctagagaccagatcttttgattatattctattatattgccctatgtctaaattat

SEQ ID NO: 62999 - DNA, 201 bp, Homo sapiens
atatcccagaatatctcaatcgttctgtcgccactctcctgatgcatatgctgcaggttgacccactgaaacgagcaactatcaaagacataaggtgattyttctttttgtttctgttctgcatattttctcataggaataataatgttaattaaatgattctcccaaagtctcatttcctgccctcaccacctcacccca

SEQ ID NO: 63000 - DNA, 201 bp, Homo sapiens
gaaatcaaatttagattgtttccttattgttttttaaaattaatttttaaaatataattcacatatcataaatttatccctttagattgtataattcactrgcttttagtgtattcacaaagttccataatcattacggccatctaattccagaactattttatcatccgtgaaagaaactatacacactaatagtcactc

SEQ ID NO: 63001 - DNA, 201 bp, Homo sapiens
ggggaacaaacactgaatattggggagcagccatggacttcattaaagaccttggaaatgaatatgtactgaatgtagactacctatatatagaagtaggrtacatagagaaaaagtgattcttgcatttcaggtttgtgttgtcatcttttttcttagattgtatgcaggtcctgaagttgatatctggagctgtggtgt

SEQ ID NO: 63002 - DNA, 201 bp, Homo sapiens
atatattttttgttttgagatagagtctcgctctgtcacctaggctagagtgcagtggcacaatctcagctcactgtaccacctcctgggctcagatgatyctcccacctcagccttctgagtagctgggactaagatgtgcaccaccatccctggctattttttgtatttttagtagaaacagcgtttcaccatgttgcc

SEQ ID NO: 63003 - DNA, 201 bp, Homo sapiens
aaccaagacattaattaccttagactctagaatgttatagaaagtttgacttattctatatgtccatacataaataagaaaagtactgtcaactcaataarcatgggcaaaagacacagcattttctacgaagaaatgtatatggtgttttgcaactgttggagaatatataaatccaccagttttctaaagattttagca

SEQ ID NO: 63004 - DNA, 201 bp, Homo sapiens
ctgaatgctaatacattctccaacggtgttaaagagtctactgaatgctaatacattctccaacagtgttgaagaatttataatggtaaatgttgttgttkttttttttcttccccccccccgccattttttgtttgtttgtttgttttgttttgagtctgggtctcactctgttgcccaggctggagtatagtggcacaa

SEQ ID NO: 63005 - DNA, 201 bp, Homo sapiens
tacaggataaatactgtctacacagtactaattaagtactttaatgttttaaatatctctctctctatatatatgatatattatatatatatatatatatattttttgttttgagatagagtctcgctctgtcacctaggctagagtgcagtggcacaatctcagctcactgtaccacctcctgggctcagatgatcctcc

SEQ ID NO: 63006 - DNA, 201 bp, Homo sapiens
acattaagagagggcatggtttatgacgctttgggataagtgttgctggcagagtctactgaatgctaatacattctccaacggtgttaaagagtctactraatgctaatacattctccaacagtgttgaagaatttataatggtaaatgttgttgttgttttttttcttccccccccccgccattttttgtttgtttgtt

SEQ ID NO: 63007 - DNA, 201 bp, Homo sapiens
tatgtattagatggtccagagtatgtatatagaggtttttaaagattgtcataagaattaaaattccacccatgagcttggtgactcacctctcctatccwttgtttctttaactttaaaatgggacacctcatttgaggattaaatgtgttggcactggtataatgcctagtgtttgataagcattggcccagagcagga

SEQ ID NO: 63008 - DNA, 201 bp, Homo sapiens
aacggtgttaaagagtctactgaatgctaatacattctccaacagtgttgaagaatttataatggtaaatgttgttgttgttttttttcttccccccccccgccattttttgtttgtttgtttgttttgttttgagtctgggtctcactctgttgcccaggctggagtatagtggcacaatcatagctcactgtaatctcg

SEQ ID NO: 63009 - DNA, 201 bp, Homo sapiens
agatttggaacattcatttagtctttactgctgtacttattgttagtgaactgtggcttattggtatttttaatgaagggacccatgtggtgcatcttacyggcagcaagagtatgccactgactgttcagagcaggcttttatgggattggtgtggatgaccggtgatgactcagttctcacatcactgctaggaaacct

SEQ ID NO: 63010 - DNA, 201 bp, Homo sapiens
attacagaatttaaagaggcttttgaaagcacagggcaaaaaagtagtagtctctattttattctttcaactatggaaataggtaaataatattttgatgytttcatgtttgggaaagttaatatgcttcagaataacctcatttgtgatgggaatcaacatttttatttagaaaggaaatttagtttcactcatatatgt

SEQ ID NO: 63011 - DNA, 201 bp, Homo sapiens
tgttcagaaaggtactagctaccttttaaagcataacaactcattgaactaagaactttacttttcaaccttgtacgttctgtaccatgaaaaggaattarctgaaatctcctcagtagcttttttttttcatttaattaaattttcattaattttcattaaatacactttaaaaatgcagatacctctagagaagttaga

SEQ ID NO: 63012 - DNA, 201 bp, Homo sapiens
aaagtgtgggcagcagatggcatttagtatgaatgggtcattttaaagtcctggtccacttgtagtagaaccaaaatgaggctatacatatattttcagtwcagataatacactctgagctaaaaatgcttttctaccaaactttatcttaacatatccatataaattagaaaggattttgtagtttggtcatatattgag

SEQ ID NO: 63013 - DNA, 201 bp, Homo sapiens
taatagttaaataaaagtgaatgtacacacattcacagtaaattgattttacttttgaaattatgcaaattctaaacaagtgttaaatattggttccaaataatgaaattatgtttcttctcaaatactagattagtgattgaattaaaatcagttgaattattctcacaattaggtaaatacgtgctatttaggtttctc

SEQ ID NO: 63014 - DNA, 201 bp, Homo sapiens
gccaggatggtctcgatctcctgacctcgtaatacgcccgcctcagcttcccaaagtgctgggagtaaaggcgtgagccattgcgcccggcctcacccggmtaattttctgtatttttggtagagacagggtttcaccgtgttagccaggatggtcttgctctcttgacctcgtgatccacctgcctcggcctcccaaagt

SEQ ID NO: 63015 - DNA, 201 bp, Homo sapiens
cacacaaataatacaaaatttgaaatttttgcttgaaagcttgaattttatcattggcaacaaatattgctggttgttttccttaaagcgatgggcttgcktttttcatttttgagaaaatgttgtccaaatgccaagtcttaataaccatagttattcaagggtggtgggtaattaacttgctcaggatcacatagctag

SEQ ID NO: 63016 - DNA, 201 bp, Homo sapiens
atatgataagtataagttattttcattttctttttaaaaaaatcattttactgtttctcacaatgtatgtatttatatacatatatatatatatatatatatattttttttttttttttttgtagagacagggtctcactgtattgttcaggtagtctcaaactcctgggctcaagtgatccacctatattggcctcccag

SEQ ID NO: 63017 - DNA, 201 bp, Homo sapiens
caatatgataagtataagttattttcattttctttttaaaaaaatcattttactgtttctcacaatgtatgtatttatatacatatatatatatatatatatatattttttttttttttttttgtagagacagggtctcactgtattgttcaggtagtctcaaactcctgggctcaagtgatccacctatattggcctccc

SEQ ID NO: 63018 - DNA, 201 bp, Homo sapiens
cttgttttacttgggcaatatgataagtataagttattttcattttctttttaaaaaaatcattttactgtttctcacaatgtatgtatttatatacatayatatatatatatatatatattttttttttttttttttgtagagacagggtctcactgtattgttcaggtagtctcaaactcctgggctcaagtgatccac

SEQ ID NO: 63019 - DNA, 201 bp, Homo sapiens
tagaaatgctgtttctgaaaaatttttaaactacattagtttatttctctgctgtactaggaaaataatactgagaagtatgagtgattcatgattgaatktcttgtaatgcttcaatatacttgtattttagacagcacaagagatttgacttactcaggccaggcttagaatgtaatcctggaatttgccttttccact

SEQ ID NO: 63020 - DNA, 201 bp, Homo sapiens
aatgcttgttttacttgggcaatatgataagtataagttattttcattttctttttaaaaaaatcattttactgtttctcacaatgtatgtatttatatayatatatatatatatatatatatattttttttttttttttttgtagagacagggtctcactgtattgttcaggtagtctcaaactcctgggctcaagtgat

SEQ ID NO: 63021 - DNA, 201 bp, Homo sapiens
acttggaattctaagtgtcacttctcccaaacccaaattattattacatatggtgtgtattaataaattctataatacctttaatatgatagcattatttyatatattatgagttaaatctttcgttgggtaaccacagattgcattatagtataatcattaggaacataggctttagaatcagatagatctggatttaaa

SEQ ID NO: 63022 - DNA, 201 bp, Homo sapiens
aaatcactgagtcatagagtatatacatgttcagttttagtagttacgcattttgcatcaatttattgttttcccaagtgtttgcactaatttacattccytccagcaacctataaaagttccagttgctgtatttcttgactaatacatggcattgtctgtcttttttattgtgctattctggtgggtgtattatggtat

SEQ ID NO: 63023 - DNA, 201 bp, Homo sapiens
aagctagtgtcatttatttattagatatagttctttaataataccttgcatattttccaaagtatatagagcattgttttatattttgtgtttggaaaaaygagattttgggggaaaatattgtttcatgaaattacacaagtagagattgtgtagttactcataacttattcattggtacattataaaaatgtttataca

SEQ ID NO: 63024 - DNA, 201 bp, Homo sapiens
tgggttacttgtcatcttataagttgagttgtgaggattctttgtaaattgtggatacagatcctttaatggatatattttgcaaatattttcttccagtytgttgtgtcttttcattttcttgtgtcttttgaagtataaaagttttgaattttcatgaggtccaatttattagtttttaaaattattttatggactatg

SEQ ID NO: 63025 - DNA, 201 bp, Homo sapiens
cttttctgagtatctttgccaacatttgttattgtctgcctgatttattatagccattctagtgggtgcgaaatagtatctcattgaggcattaattttgygtttccctaaggactaatgatgttgaacattgtctcacgtaattactagtcatttatgtattttcattgatggaatgtctgtttatatctcttgcttatt

SEQ ID NO: 63026 - DNA, 201 bp, Homo sapiens
ctgcttttgaaatgttatactttattcgagttaagtaactagtaagaatagttaagtatggaactttcatttgttttcttttttgttaattagtcacatgkgatttaattaacctgccttctctccagaatagagacagttgtttattaaaaatactttgttgcaaatccagaattataagtgaaatattgacctttattt

SEQ ID NO: 63027 - DNA, 201 bp, Homo sapiens
aggagctgtagcaggaggaggtacagcatgactaacactgaaaaatgtagtatgactcagtgttgtgactcaaaggtgagaccaaacaacagagatggcargggcctgatttattcaggacctaagagcaatgggaaacctttgaagattctaaattgagaggctactggagatcatatttgtgtttgaagagaatcttta

SEQ ID NO: 63028 - DNA, 201 bp, Homo sapiens
aaacatgggcaaaagacacagcattttctacgaagaaatgtatatggtgttttgcaactgttggagaatatataaatccaccagttttctaaagattttakcattgccaaactttctttggaaaactgtctttggtattatcttttcaattggaacatacacaataactatgactcagcagttgcactcatcagtgtatat

SEQ ID NO: 63029 - DNA, 201 bp, Homo sapiens
gtggaaggaagaaatgcaaaaagaaatgaagagcgttgggaagtctaagtatgtgggtaactaaatagatactgactatacaaaataatatcttgcgagaytgagaatatatgtaggaatgaaatgcaagaacagaaaagatatgagaaaaagtagagttatagtgttctaaagtccttgctttgtttgggaaatgtaaaa

SEQ ID NO: 63030 - DNA, 201 bp, Homo sapiens
gtgaatctggagttcaggggagaggtgtaagctagagagataaatttggaagccatcagcagacagactgtatttaagatatttaaagccctaagactggrtgaaatcaccaagataaacaagaagtccaaggactgggctctagaacactatgatgctaacatgtctgaaaaatgaggaggaaccagtaaaagagaatga

SEQ ID NO: 63031 - DNA, 201 bp, Homo sapiens
tagtgtggatgccatgaatgtgttatatgaaaaaacagaatgactatatttatcatagaatatattgatttagcacctctgtgtacaaagcactgtgcgcrtatacttcctgagagattcagatgagcactggtcatcttgtccaaggagagtatgagctaatagctcaggtcatgtgattgtcacaaatgcaaatgttta

SEQ ID NO: 63032 - DNA, 201 bp, Homo sapiens
gttgaataagtgaatctggagttcaggggagaggtgtaagctagagagataaatttggaagccatcagcagacagactgtatttaagatatttaaagcccyaagactggatgaaatcaccaagataaacaagaagtccaaggactgggctctagaacactatgatgctaacatgtctgaaaaatgaggaggaaccagtaaa

SEQ ID NO: 63033 - DNA, 201 bp, Homo sapiens
agtaataagttgactccccaactaaaacagtgaaaacaaggaaaaaatggaatggaatttttttttaccttcgaagaggtaaaagaaacaaactgccagcwtataattttatgcccagcaaaaatgttcttcaaaaataaaggtaagctgggcgtggtggctcatgcctgtaatcccagcactttgggaggccaaggcggg

SEQ ID NO: 63034 - DNA, 201 bp, Homo sapiens
tataattttatttctcatctactctttatgaatatggtatatctgacagtcttcaggcagatgtaatactgtacaagatttatttcagtttatttattgcrgtctccccaccccccaaaacttggaggcgtattaaaaaatctcttctcatgtgtctgtctatgatcaacgtttcttgcatatgctcggcaaatgttttga

SEQ ID NO: 63035 - DNA, 201 bp, Homo sapiens
ggcactagggatacagcaacagacaaaaaggcaacaacaacaaaatccttgctattatagagattatattagtgtgtggtggaggggtggtggggaaatakacaataaatcccttattatatgttatatgttagacagtgaagaggtgaggggatatgccatgtagatatctgaagggggtaaatgttacacatagaggga

SEQ ID NO: 63036 - DNA, 201 bp, Homo sapiens
atgcttgttttacttgggcaatatgataagtataagttattttcattttctttttaaaaaaatcattttactgtttctcacaatgtatgtatttatatacmtatatatatatatatatatatattttttttttttttttttgtagagacagggtctcactgtattgttcaggtagtctcaaactcctgggctcaagtgatc

SEQ ID NO: 63037 - DNA, 201 bp, Homo sapiens
atagctacttacttgagtaggccttcattaaatcgttgttcaacagatgaatgtttctaattgctcctgtcaaagtaggtattgatctggatatttacgtrtatacatgataaattatggcaagattatttattattggtgtttttataattttatttctcatctactctttatgaatatggtatatctgacagtcttcag

SEQ ID NO: 63038 - DNA, 201 bp, Homo sapiens
tcaaattgtttatcggatgttcacattctaaagtcacagagtcacctgaagctaaaattttctctctcttccaaatttacttctctgtttttggagggtgyggtgggagagtggagggaggtaaatgaaaataccattcatgcagtttcccaagccccaaacttgggcaaaatctttaatttcttcttttccctcatttct

SEQ ID NO: 63039 - DNA, 201 bp, Homo sapiens
tgatttctggcccttttgtttctccagatttctgagcacatttatcaaattgtttatcggatgttcacattctaaagtcacagagtcacctgaagctaaamttttctctctcttccaaatttacttctctgtttttggagggtgcggtgggagagtggagggaggtaaatgaaaataccattcatgcagtttcccaagccc

SEQ ID NO: 63040 - DNA, 201 bp, Homo sapiens
aagtttccttggtgtttggaggatttgaggctgaggaggtcaggactgctaaggcatattctgctaaggtctgtcttcatggagataggatccccttttgratgtagaaaaacaggctgcttttgaaatgttatactttattcgagttaagtaactagtaagaatagttaagtatggaactttcatttgttttcttttttg

SEQ ID NO: 63041 - DNA, 201 bp, Homo sapiens
gctagttcaaattattatgcagtatttccatagcctttacattttggcaactcttttctttgatcctagcagaaaaataggttataattttggccccaaakaattattttttaattgttccttttgttttattagatatgataatatcctaaactatataatatattaaaatagaatgaggatgtatctgatatgaattac

SEQ ID NO: 63042 - DNA, 201 bp, Homo sapiens
tgagaatagaaatagtaagtactcaggataatgtgatacaggataaatactgtctacacagtactaattaagtactttaatgttttaaatatctctctctmtatatatatgatatattatatatatatatatatatattttttgttttgagatagagtctcgctctgtcacctaggctagagtgcagtggcacaatctcag

SEQ ID NO: 63043 - DNA, 201 bp, Homo sapiens
ttcttatttcaatatgtcacctttcagtctgaaattttagttttaataaaatataatgagcatagctaagtcaagttccataataaaattttacttcaatmgatttttacagctgaaagagtctagaaatagtagctaacaaaagttagattctcatttgttttatcactgataagctgaaatggaaggaaaaatttatct

SEQ ID NO: 63044 - DNA, 201 bp, Homo sapiens
accttggcctcccaaagtgctgggattacaggcatgagctgccagcagttgtaaattattatagaagtggttgtgacatctattttcttgcgcgcgcgcgsgtgtgtgtgtgtgtgtgtgtgtggtgtgatccacagctcactacagcctcaacttcctgggtttaagtgatcttcccacctcagcctccagagtagctgg

SEQ ID NO: 63045 - DNA, 201 bp, Homo sapiens
cttggcctcccaaagtgctgggattacaggcatgagctgccagcagttgtaaattattatagaagtggttgtgacatctattttcttgcgcgcgcgcgggygtgtgtgtgtgtgtgtgtgtggtgtgatccacagctcactacagcctcaacttcctgggtttaagtgatcttcccacctcagcctccagagtagctggga

SEQ ID NO: 63046 - DNA, 201 bp, Homo sapiens
tggcctcccaaagtgctgggattacaggcatgagctgccagcagttgtaaattattatagaagtggttgtgacatctattttcttgcgcgcgcgcgggtgygtgtgtgtgtgtgtgtgtggtgtgatccacagctcactacagcctcaacttcctgggtttaagtgatcttcccacctcagcctccagagtagctgggacc

SEQ ID NO: 63047 - DNA, 201 bp, Homo sapiens
tggcttcccaaagtgctgggataacaggcatgaaatgccctgcccagctgacatcgctctctttctttctttctttttgttttttgttttgttttgttttkttttattttgttacatcctgagtccttgcttttttctagccaaatctagccctcttactctttcttcctgtttttctaaagggctcataggtagcactca

SEQ ID NO: 63048 - DNA, 201 bp, Homo sapiens
tgaaatgccctgcccagctgacatcgctctctttctttctttctttttgttttttgttttgttttgtttttttttattttgttacatcctgagtccttgcttttttctagccaaatctagccctcttactctttcttcctgtttttctaaagggctcataggtagcactcatccttgctgaatggaaggattgctgacttc

SEQ ID NO: 63049 - DNA, 201 bp, Homo sapiens
aaatctagccctcttactctttcttcctgtttttctaaagggctcataggtagcactcatccttgctgaatggaaggattgctgacttctcagttagtagytcagtcttctctcaaatcccagtattcttaattcttccttttgtgggagactaatgagtaggccaagatcttcaaagtttgggagttggcagaatggaaa

SEQ ID NO: 63050 - DNA, 201 bp, Homo sapiens
tagtgactttcattccttgtacatacacagtgaagtagttctgggcaataaattcttggaaaagtagagtagggattggataaatgtcatagtttatgactgtgaatacatacaaacaggtaaaaactcaagatggagaggtaataataaccacccgataaagagacttaaaaccctttcactgtacaaaaaaaaagattg

SEQ ID NO: 63051 - DNA, 201 bp, Homo sapiens
agtgactttcattccttgtacatacacagtgaagtagttctgggcaataaattcttggaaaagtagagtagggattggataaatgtcatagtttatgactgtgaatacatacaaacaggtaaaaactcaagatggagaggtaataataaccacccgataaagagacttaaaaccctttcactgtacaaaaaaaaagattgc

SEQ ID NO: 63052 - DNA, 201 bp, Homo sapiens
ctaaaaatacaaaaaattagccaggtgtcgtggcaggtgcctgtagtcccagctactcaggaggctgaggcaggaggatggcgtgaacccgggaggcggakcttgcagtgagccaggatcgcaccactgcactccagcctgggcaacagagcgagactccgtctcaaaaaaaaaaaaaaagcaaaatagtctctggtctca

SEQ ID NO: 63053 - DNA, 201 bp, Homo sapiens
atggatgtttgaaggaaggggatcatgaatgaggacctaaactaaggaaagtctaggtcttggggaagataaaaaagaggatgttccaagctgagatcacraaatgatctgaggcccaaatgcacatagcctagtgactgaagctgtaggtaacagtgaataattggatgtatgaaccagtgaacaaattagtatattctg

SEQ ID NO: 63054 - DNA, 201 bp, Homo sapiens
ctttatttattatatttcattcccttctttttcttgactatttcaaatgtatttacaaaaggtttgtagaatttttccatagagaaaaatctaattttaakatgaaattctttattttaaaatattattagtttaattttaattttgaccatacatatttgttgtcctctggtagttcattgctaaaatattgatttaaaa

SEQ ID NO: 63055 - DNA, 201 bp, Homo sapiens
taaaaggcatatggataggaaagaaagaaatgaaactgtccccatttgcagattacatgcttttctaagtagaaaatcccaagggatatataaaacacaataaaaaaaaaccttcctaggacaaataaatgagtttaacaagggtctcaggatataaagccaacatataaaaatcaatcatattgttacatattagcaatg

SEQ ID NO: 63056 - DNA, 201 bp, Homo sapiens
gagccactgcacctggacaagagtacttattattaaagtactttgttattttttgtttttttgttgttgttgtttttgagacagtctcactcatgtcgccygggctggaatgcaatgatgcgatctcagctcactgaaacctctgcctccagggttcaagcgattctcctgcctcagtctcccaagtagctgggattacag

SEQ ID NO: 63057 - DNA, 201 bp, Homo sapiens
ctgtatggatgctcctttttagtaggcctcagtctcattccagacaccagaccaacttggactgtgccccaaaaaacttgtcatccctactgtcttctgtytagtcatactcctattcaccgttctctactcataaatgccctactcttgtttacactgccggtttacacagtttctccaagccatcacagctgatgtctc

SEQ ID NO: 63058 - DNA, 201 bp, Homo sapiens
acaatggaggtttgtataagcacacctacgatgtttgcacaacaatgagatcacctcatgatgcatttctcagaatgtatgtccatagttaagtgacacawaactctatatgtatgtgtgtatgttatgtatcatttatgtattttttaatttgtatgtacattattttgctgccctcctccaacccatagcaagtttctc

SEQ ID NO: 63059 - DNA, 201 bp, Homo sapiens
tgccactcacagattctcttaaaataactacaaaataagttacttctctaagaggtaaagtgaacctcagataaaggagtggaattgcaaaaagcaatgaygaaaaagtgaattagcaaacatgttaatctaattacaagttttgctgactataaagcaaaagtcaaacaattggagggcgggtgaaaaaaaaattggagg

SEQ ID NO: 63060 - DNA, 201 bp, Homo sapiens
tctaagtattactcttagaaatattaaaactcttcatatttaacagctgaaaattatttaaaatcataagtccttccatgagaagactgaggttaatactrttgatccacatttttacagggtgagatatttgactagttctcttataataaaaatatttagaaaggcattgaatacctagtgaaaattcaaataacattc

SEQ ID NO: 63061 - DNA, 201 bp, Homo sapiens
tagagactattttggggtaacaatttaattgtgatagggttttttttgttttgttttttttgaggaagacataggtccaaagtaacaatgagaggaattaytattaatcagtttctgaaccagtggactcaatgaaattgagtttcgtttgactgtttttcattagtggtgaacagtttgggttattcattcatttgcttg

SEQ ID NO: 63062 - DNA, 201 bp, Homo sapiens
ggactcaatgaaattgagtttcgtttgactgtttttcattagtggtgaacagtttgggttattcattcatttgcttgttcattcataaacatcaaaagccrgtatatttaagacactgaaaatcttaactctactaatatgtgtcctcaaatacttgctaattatatatcaaatgtgtttaaagtacatagtgtatatggt

SEQ ID NO: 63063 - DNA, 201 bp, Homo sapiens
gtactctagaacaaacaactaaatagctcataaaacagttatctacttgaccattgataagtacaaacattatgttctactagagctataaaatcaaacamacttacatttcaacccagtgggcatatgaaggattatgacttagttacatcctatgtcttcacgtgtgcatctgtcaatttgtgaaacttgtaaaagttt

SEQ ID NO: 63064 - DNA, 201 bp, Homo sapiens
tcctatgtcttcacgtgtgcatctgtcaatttgtgaaacttgtaaaagtttagataagccatgaccttggataactacatggcattttaaatggaaggtarccatttatttattttattgttatcttaaataaataatgagtgatatacttagatctttccaaggatttactaaataaatatgcatttaaagattcaggtc

SEQ ID NO: 63065 - DNA, 201 bp, Homo sapiens
ggcagatcatgaggtcaggagatagagaccatcctggctaacacaatgaaactctgtatctattaaaaatataaaaaaatagccaggcatggtggcgggcrcctgtagtcccagctacttgggaggctgaggcagaagaatggcgtgaacttgcagtgagccgagatcgcgccaccactgcactccagcctgggtgacaga

SEQ ID NO: 63066 - DNA, 201 bp, Homo sapiens
tctaaatcctagtcatccttcagtgctcaaatcccatatcacagttcccttgcccctcgtaacaaatccttccccaacttctatggtccaaattaacaacwactacaagagaaacagaataaaacccctattgcacacacaaacagtactacattatgtaacgtttaattattctctgatgtctttcaagagtattaattt

SEQ ID NO: 63067 - DNA, 201 bp, Homo sapiens
ttaaaaatatacaaaaaacttaaacttgccttcaacttgactcaggtttaatggcttaattgttagataaaccatggacctctgagctatttgcatcctgyactgatgactaatgatttcaccatcttcttctaagaagaagcaaccttttgattgcatgtgttgccagtcctgaaatgaaggaaaaaattatttcaaaca

SEQ ID NO: 63068 - DNA, 201 bp, Homo sapiens
tgccaatatatttttcattgcatataggcttaaaaaaaagacaatggaagttataagtaatcccttgacatgtgtaaaataaaattttttagtagatgggratgtattgatgatagtctcttatttcttctcccagatatgcaagcgatatatctaaatacttactagagccaaatctgtctcaaaagtttaggtcatttt

SEQ ID NO: 63069 - DNA, 201 bp, Homo sapiens
gttcagtgacaatagagcggatggatgaatcttaacataatgagtgaaataaccaatttgtatgagactacatttgttatccttataaaacttaagaacaygcaaaaataagctacttatggttatatatgtatatgataagattattgttaaaaggcagagaaatgataaatacagagaaatgataaatacagtttaata

SEQ ID NO: 63070 - DNA, 201 bp, Homo sapiens
tcaagaatcaggaagatacttttaacactgcatttgtcactgaaaaaactagttttaatttatattgacctttttctcctttgaacatttagtctgcattsaataaaatgttgatgactgctctttagaagacagctgtatgaaataaagtattataaatattcagcttccctttctaagcattgtcaccaacagctgggc

SEQ ID NO: 63071 - DNA, 201 bp, Homo sapiens
aaggtttctgtgtgaggcttagtaataggcacctctgagagttttcctgccctggccccataattatacttcaagttcagctgaaagcaaaagtcagggtrtggttgggagagttggccatctctaacctgtttggaaataccatctcagaaggtagtaaccctttaatgctaaaatttagtaaatatcaaattgagatgt

SEQ ID NO: 63072 - DNA, 201 bp, Homo sapiens
atgacaggataacaagggagaaactgataaatccacaatcattgtaggagattttaaactacctctttcagaaactgatgaagcggttaaaaaggaaggayatagacaagttgtacacaattagcaagtttatctaatgagctgtggtcaaaaagatataatacccatataataaagcacatgtagaatgttcacaaaaat

SEQ ID NO: 63073 - DNA, 201 bp, Homo sapiens
ctaaacaggaggaacaagttcaattattgtataattgactgtaattaataacaacatattatatacttgaaaattgctgagagagtagactttcagtgttyataccataaaaaatgataagcatgtaaggtaatagatatgttaactagtttgatttagccatttcacaatatatacatatttcagaacatgttatacact

SEQ ID NO: 63074 - DNA, 201 bp, Homo sapiens
catgcatctataatgcctgtattatttataaattgacaaaaaaggaacttaaagctatagtaatgctaccgctgtctctgaccttaaaatggaaatgcacdtaagtggcagaaggatatagatgaaaggtgtagcaagaagcagcagctctagttcatgttactcctttttaaaaaatagtttatctaaaatcaattatta

SEQ ID NO: 63075 - DNA, 201 bp, Homo sapiens
aaaataaaggtggaataatgcaaactggaagcctttatatgatatcattgattaaaatatttgatgaaagtatcctttatctaataaagtttactaatgcrttttaacctaattatagaatcatatttgatttctctttaatataccaaccttcagtggaaattttattcaaaagattattttttcttatatggtattgtg

SEQ ID NO: 63076 - DNA, 201 bp, Homo sapiens
tacaagttttgctgactataaagcaaaagtcaaacaattggagggcgggtgaaaaaaaaattggagggcaggttaaaaacaaacaattggagggcgggtgaaaaaaaaaagtcaaacaattggagggcgggtgaaaaactatcatggaaggtgaggaggcaacagataagagttacgatgttttagacaatattttaaggt

SEQ ID NO: 63077 - DNA, 201 bp, Homo sapiens
tttatattttaataataaagtacataccatggacataaaatgaaaatgcatataaattgaatagattattatttaggtacatcagttaagtagcatttagytgtttaataaataacagactaaatctgaaataattcttagtttggtaagttctaagtataattatttaagaaataagagaatatatacaataatatatcc

SEQ ID NO: 63078 - DNA, 201 bp, Homo sapiens
acaccagaccaacttggactgtgccccaaaaaacttgtcatccctactgtcttctgtctagtcatactcctattcaccgttctctactcataaatgccctmctcttgtttacactgccggtttacacagtttctccaagccatcacagctgatgtctcctggtgctatccccaaacggccactcttaactccctcttaaag

SEQ ID NO: 63079 - DNA, 201 bp, Homo sapiens
gagccaccgcacctggccaggatgcatttctgattgtttttttcattcattaaaataactcagttctagctaataaagccatttttatctttagtaatagsttctttattccatttgtttagatttcttttattttttaaaaccactgcataaagacttggattttttgtttttcttaagaaacagagtcatgctctgtca

SEQ ID NO: 63080 - DNA, 201 bp, Homo sapiens
tcttgtcgctcaggctggagtgcaatggcgtgatctcagctcactgcaacctccacctcccaggttcagattctcctgcctcagcctcccgagtagctggrattacaggcgtctgccaccatgtccggctaatttttgtatttttgtagagatggggtttcaccatgttggctaggctggtcttgaactcctgacctcagg

SEQ ID NO: 63081 - DNA, 201 bp, Homo sapiens
tttccccatgcctatatcttgaatggtattgcctaggttgtctctcagagtttttacacttttgggttttacatttcagtctttatcttaaaatttttttkttgttgttgtttttttttttgagacggagtctcgcactctcgcccaggctggagtgcagtgatgccatcttggctcactgcaagctctgtctcccgggtt

SEQ ID NO: 63082 - DNA, 201 bp, Homo sapiens
gctggagtgcagtgatgccatcttggctcactgcaagctctgtctcccgggttcacaccattctcctgcctcagcctcccgagtagctgggactacaggcrcctgccaccatgcccagctaattttttgtatttttagtaaagacggggtttcaccaggatgaagccaggatgttagccaggatgtcttgatctcctgacc

SEQ ID NO: 63083 - DNA, 201 bp, Homo sapiens
tgtctcccgggttcacaccattctcctgcctcagcctcccgagtagctgggactacaggcgcctgccaccatgcccagctaattttttgtatttttagtamagacggggtttcaccaggatgaagccaggatgttagccaggatgtcttgatctcctgaccttgtgatccacccgcctcagcctcccaaagtgctgggatt

SEQ ID NO: 63084 - DNA, 201 bp, Homo sapiens
tgagcccaggaggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttc

SEQ ID NO: 63085 - DNA, 201 bp, Homo sapiens
gagcccaggaggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttca

SEQ ID NO: 63086 - DNA, 201 bp, Homo sapiens
agcccaggaggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaa

SEQ ID NO: 63087 - DNA, 201 bp, Homo sapiens
gcccaggaggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaac

SEQ ID NO: 63088 - DNA, 201 bp, Homo sapiens
actcagcatagatatatcgtagtacacaatttcatttttcaaaaaatcctaaagttataaatagtgcaaatatattctaaaattagaggaaactgtaatawttctgggtaaattccaatctgcctggttatttagagcatacgttgttatatatttcaaagaattaaaatgcttcatatgtatttgccacttaaagccagc

SEQ ID NO: 63089 - DNA, 201 bp, Homo sapiens
cccaggaggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaact

SEQ ID NO: 63090 - DNA, 201 bp, Homo sapiens
ttttaggtacatacatggaccaaatgtttatgacagagaagtagacaaagcagaggaaggagaagcagctgcacagagagggacagagggagcgaagagayagagacagcgagctgtttgctacctaattctagctcacaaacaaggaagcgcagccaattctcttcggcgattcagcgttcctctcaccgcagctggaca

SEQ ID NO: 63091 - DNA, 201 bp, Homo sapiens
ggattgtaccctgtcacccagactgaagtgatgattagtgaagtgggattacaggcataagccaacacgcctggcctcttgtctgttactttagttgtgtmatttgattagaatgtgtaactgggtttcagtggtttcaatctctcctaagttgacaagttttagaggatcacaataggaaagcaaaatgtttattatttc

SEQ ID NO: 63092 - DNA, 201 bp, Homo sapiens
aggatttgaatcttgagtctgttaaccagctgtgtgctccttagattgttactcagtgtcctcattgataaaatagttgctcaataagtatttattaattdgataaagttgctactttggaaagatttcattctatgtagacagatacatgtctttttagtagctcttgctgtaagtaatcaaatcccattctagaccttt

SEQ ID NO: 63093 - DNA, 201 bp, Homo sapiens
caggaggttgaagctgcagtgagctatgattgtgccactgcactccagccagggtgacagagtaagaccttgtctcaaattaaaaaaaaaaaaagttttakatatatatatatatatatatatatatatatataaattaagaaggcctaatttttaaatttttattacccctatggtttattacgagccctgttcaacttc

SEQ ID NO: 63094 - DNA, 201 bp, Homo sapiens
tgcatagtttgcaacaattttctcccattctgtaggttgtctgtttactttgttgatagtttcttttgctgcacagaagctctttaattagatcccatttrtcaatttttgcttttgttgcaattgcttgtggcatcttcaccatgaaatctttccccatgcctatatcttgaatggtattgcctaggttgtctctcagag

SEQ ID NO: 63095 - DNA, 201 bp, Homo sapiens
aggaggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaacttct

SEQ ID NO: 63096 - DNA, 201 bp, Homo sapiens
gaggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaacttctat

SEQ ID NO: 63097 - DNA, 201 bp, Homo sapiens
ggttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaacttctatac

SEQ ID NO: 63098 - DNA, 201 bp, Homo sapiens
ttgaagctgcagtgagctatgattgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaacttctatacct

SEQ ID NO: 63099 - DNA, 201 bp, Homo sapiens
attgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaacttctatacctatcatgttaatgataataatg

SEQ ID NO: 63100 - DNA, 201 bp, Homo sapiens
tgtgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaacttctatacctatcatgttaatgataataatgat

SEQ ID NO: 63101 - DNA, 201 bp, Homo sapiens
tgccactgcactccagccagggtgacagagtaagaccttgtctcaaattaaaaaaaaaaaaagttttatatatatatatatatatatatatatatatatataaattaagaaggcctaatttttaaatttttattacccctatggtttattacgagccctgttcaacttctatacctatcatgttaatgataataatgatga

SEQ ID NO: 63102 - DNA, 201 bp, Homo sapiens
agccacttgggaggctgaggcagagaatcacttgaacctgggaggcggaggttgcagtgagctgagatcgtgccactgtactacagcctgggtgacagagygagactcagtctcaaaaaaaaaaaaaaaaaaaaagttaagagtttaaagttattcataactttttcaaggggaaaaaataaatgcagattaaattcaatc

SEQ ID NO: 63103 - DNA, 201 bp, Homo sapiens
accttgaaagaatagtgtttactttgagagtgatagttgagtatatttgtaatctgaaaagcaagagcaaggaaacaagtttgaattttgctgattttttwatggtatataatttcaaagatctataactaaacatagctatttctgtccttaattattatttatttccagtcatttgatccttcaaaaatcacaaggaag

SEQ ID NO: 63104 - DNA, 201 bp, Homo sapiens
gtaaatttcacgaacagtttcttctttgttaatgtggatatagtactgaacaatggttactatggggtattagattctactggtggtctaacagcttccartattactctacccagctttgacttctaaaaatagatctccaacctaataaattgaatatttcaagttcaataataagatgacacaggtagggtccccttc

SEQ ID NO: 63105 - DNA, 201 bp, Homo sapiens
agttttactgtgttcctttattaataacaatatttggggtttgtatagcacctctgtacataagagcttaaagaactgtcatacatcttgtcttatccctrttacagcggtcaggtatttttttgtccgttttacagatgaggaaattgaggggtagcaatgtcacccagctagcagtaagtggcaaaaagccgtaaattt

SEQ ID NO: 63106 - DNA, 201 bp, Homo sapiens
taaacatataattgcaccccccgcaggcttggaaacctcccttacttaaaactccggcccgagactgagacaggggcctagagagtacattgcagcaaacrgctccataaataaccagccacacaatagcaagaaaaataaactgttaacaagcgcctaaggcttctacagggccaagtgaaaacagaaagccgtccagtc

SEQ ID NO: 63107 - DNA, 201 bp, Homo sapiens
ggtttcaccaggatgaagccaggatgttagccaggatgtcttgatctcctgaccttgtgatccacccgcctcagcctcccaaagtgctgggattacaggcrtgagccatcacacccagccctagttaatttttgtatatggtgtaaggaaggggtccagtttcaatcttctgcatatggctagccagttatcccagcaacc

SEQ ID NO: 63108 - DNA, 201 bp, Homo sapiens
tataaaaacatttaaaagcattttttcatatcaatctatttttgaaccctataaaataagtcaagcctgaggatagtaatcttaagtttttctgttttgcrgtagtagtataagtaagacaaacgtctacagcagcttttccaaagtcttgaattgcttgcatttagggaaaaaaaatgtactggcatcaaccttttttat

SEQ ID NO: 63109 - DNA, 201 bp, Homo sapiens
ttttttcaagacggagtctcacttggtcacccaggctggaatgcagtggtgcgatcttggttcactgcaacctccacctcccgggttcaagcgattctccygcttcagcctcctgagtagctgagactacaggcatgtgccaccacacccagctaatttttgtatttttagtagagacggggtttcaccacattggccagg

SEQ ID NO: 63110 - DNA, 201 bp, Homo sapiens
tcttctcccagatatgcaagcgatatatctaaatacttactagagccaaatctgtctcaaaagtttaggtcatttttttttcctttttgatagtattcaaygagaaataacactttaaataaaactttttccatgaggaaggtacagtaattatccacctcctggatactctcctgtagtcctctgagtaagctccaaact

SEQ ID NO: 63111 - DNA, 201 bp, Homo sapiens
accgactgcgccagccttggcgaagctccgcctactgccctttgctccaagtaatttttggcgatttttaaagtaatttttccggcggagtcatagtggcsctatactcttggataggttatcctgtctcttccgctagattgatgagatcaggtatcactcgaaaatggcgccgaaaagtgctgaggctcctcattcaaa

SEQ ID NO: 63112 - DNA, 201 bp, Homo sapiens
tccccttgcagtacttctctttgacatattaattttaaaaattgacaaatggaaaaagctaagattaattagcaaataaaaacttagttctggctgggcayggtggctcacacctataatcccagccctttgagaggccgaagcgggtggatcacctgaggtcaggagtttgagaccagattggccaacatggtgaaaccc

SEQ ID NO: 63113 - DNA, 201 bp, Homo sapiens
tctttattgaagttatgagaaaattgtgtcattaccatagctatgtgcaaaaatgcttttcactttattagtaggcttgcctacctgaaatgtaagtaagmatatttaaataataagttcaaggctttaataatattgataactactgaaaaggtgtatgctagctgtataataataacatcataaatgttttctaattca

SEQ ID NO: 63114 - DNA, 201 bp, Homo sapiens
tagccgggtgttgtggtgggcacctgtaatcccagcctcaggaggctgaggtaggagaattccttgaaaccgggaggcggaggttgcagtgagctgagatygtgccactgtactccagcctgggtaacacggcaaaactccgtttcaaaaaaaaaacaaaaacattgagttggtataccattatttagttaactatttcta

SEQ ID NO: 63115 - DNA, 201 bp, Homo sapiens
tgtagacactgcacagttattaataaacttaatgtcaaatttttttcagaaaaagtcatctgttaacttaaaatactatacctttattaaatttggctccrttaactttgagtttcggttaccattagcccccatggtaactgtgaaggaaacagatgttttgaacttcctggttgctgacagtaaagaactcctggtgtc

SEQ ID NO: 63116 - DNA, 201 bp, Homo sapiens
ctgaggcagagaatcacttgaacctgggaggcggaggttgcagtgagctgagatcgtgccactgtactacagcctgggtgacagagcgagactcagtctcaaaaaaaaaaaaaaaaaaaaagttaagagtttaaagttattcataactttttcaaggggaaaaaataaatgcagattaaattcaatcatgaagagaaatgg

SEQ ID NO: 63117 - DNA, 201 bp, Homo sapiens
tgaggcagagaatcacttgaacctgggaggcggaggttgcagtgagctgagatcgtgccactgtactacagcctgggtgacagagcgagactcagtctcaaaaaaaaaaaaaaaaaaaaagttaagagtttaaagttattcataactttttcaaggggaaaaaataaatgcagattaaattcaatcatgaagagaaatggt

SEQ ID NO: 63118 - DNA, 201 bp, Homo sapiens
tagagctactatgtagaaacgatgaaaaaaatatttgacatataatacaaatacattaagaaacctatctagatactgtactatagagactatcaaaaacraatctactttttaaaacttaaaattctcaatcctcattaatttttaaaaaattaacacttgggccaggcgcagtggctcacgcctgtaatcccagcactt

SEQ ID NO: 63119 - DNA, 201 bp, Homo sapiens
ctcttatatatgatattgtaatagtggtattttaaagcagacaaacatactaacttttttataagagtttttataatataggactgatgtttaaattgtayggtagtccttgtatatataactgcatatattttttaaagaaactcatttaaatatttaattatgatcccatttagagatatgcaattagaatcaaacctg

SEQ ID NO: 63120 - DNA, 201 bp, Homo sapiens
tggtggtctaacagcttccaatattactctacccagctttgacttctaaaaatagatctccaacctaataaattgaatatttcaagttcaataataagatracacaggtagggtccccttcaggactcattgcattcctactcaggaggcctaaatcacttgcaccttttcgaattatatagatcatttacacttgggaaa

SEQ ID NO: 63121 - DNA, 201 bp, Homo sapiens
cagagaagtagacaaagcagaggaaggagaagcagctgcacagagagggacagagggagcgaagagacagagacagcgagctgtttgctacctaattctarctcacaaacaaggaagcgcagccaattctcttcggcgattcagcgttcctctcaccgcagctggacagatctcggcctttctctaatcaccatggcaact

SEQ ID NO: 63122 - DNA, 201 bp, Homo sapiens
caaatagctatattttaaaagtcttatttatagcattatcatagttttactgtgttcctttattaataacaatatttggggtttgtatagcacctctgtayataagagcttaaagaactgtcatacatcttgtcttatccctattacagcggtcaggtatttttttgtccgttttacagatgaggaaattgaggggtagca

SEQ ID NO: 63123 - DNA, 201 bp, Homo sapiens
gtagaagaaatctaaaaagcagtctagtccagacttctcttttgattgacaaaaaagtctgaaaaataaagtgatatatgtgaacagctatagttctcaaytgactgcagaactagaaccaaaagctaggtctccttactttctctccagtgtgtaagttatattctaagttctgttctatttcacatttaaatatctgca

SEQ ID NO: 63124 - DNA, 201 bp, Homo sapiens
cttattttcattcataatatataacgaaatgctgaaaagtacaaaaccaaatactaaagcaaaaaattcttgttatcaaaacaaatacatcagtatagtcmcatttttcttggaacactgtagtgaatgaaaatgatttgttttaacatacaaattctgtattattaaaattttcagtgagaaagaattattaagcagtag

SEQ ID NO: 63125 - DNA, 201 bp, Homo sapiens
ttattctgtacattcacaaccaagtacttttcagaatggttataaaacctcaggaatatatgaaatttatgaaataaaaaaagaaaacttcaagtattacwgttcttttagaatttgtctagcaggttctctgtttttccagaaaaccacccaggaagaaacaagacttaaagaaaaatgtggccaggcgtggtggctcac

SEQ ID NO: 63126 - DNA, 201 bp, Homo sapiens
gagctatcaattatttccaaaagacattacattttatatgaaactcacagtattaaaaagttgacagtatgcccttttcttttaatcattaaattatcttwgtaccttttacctaattcccaattatcatccacaccattccctgctcttgacttacatacaaaactttagtctctttgttaaataatcgttatgacttac

SEQ ID NO: 63127 - DNA, 201 bp, Homo sapiens
ttttcagaaaaagtcatctgttaacttaaaatactatacctttattaaatttggctccattaactttgagtttcggttaccattagcccccatggtaactrtgaaggaaacagatgttttgaacttcctggttgctgacagtaaagaactcctggtgtcacctgcaacaagtaatgattatttggtctgacattatgaaaa

SEQ ID NO: 63128 - DNA, 201 bp, Homo sapiens
ctctagtttttctagtgtagtcttgagacattgctcgttggttgtcatatataatttacaaaactacaggaaaaaaaaagtccagtgggtaaaacattcartcatacactggggaagaggagaaagcaaatgcacattagtaggcaaggaacagactgatagatggaatatatttcctattgatggttacgcattttattt

SEQ ID NO: 63129 - DNA, 201 bp, Homo sapiens
gcacattacaaaacagttttacagatcttacctttgttagaaatttataaaggtcagtgtgtaaaatacagccatcatcatttacatctaattgcttaaawgattttagtagttctgcttttgaagtaggtttttccttccttaaaattatacaaaaatcatcaaaattcagtttggcagtttgaggagtccaatacttat

SEQ ID NO: 63130 - DNA, 201 bp, Homo sapiens
gatgtttatcatattgctacactactgctactaataataaaggaaacaatgttcaaagaatcaaggagtggttaactgaatcatggtacatatacagaacrcatttacacaactactaaattatttttatgacaatgaatattatataaaatttcctgcaaaatttcttccttattgttaagcctaaagtgccttttttct

SEQ ID NO: 63131 - DNA, 201 bp, Homo sapiens
ttatataactagttatatagttaaaagcaggacttggtaattattaaatattaggtgatttttcctccagttcagacctcagataagaggagggtagtcayttttattcatactattcacaccaagtgcttcagccctctggaacctctctttcaggaccccagaacactttgctacctttccctctgcctagattgcttt

SEQ ID NO: 63132 - DNA, 201 bp, Homo sapiens
attaggtcatttttaaagatctcttcccacatgccctgtggtaatgtatgccattagttgccaaaggctgcttccttcaagggctttctctcacagaaggrttctaaggctgaagagacatgagcctctaccaccactaggagtccccagagggacatattctgaataggaatctgtcatagtaaatactgtcttttgggc

SEQ ID NO: 63133 - DNA, 201 bp, Homo sapiens
agtagctgggattataggtacctgccaccacacttggataatttttgtatttttagtacaagtggggtttcaccatgttggccaagctggtcttgaattamtgacctcaagtgatccacccacctcagcctcccaaagtgctgggattacaggccaatttttttttttttttctttttaagagacaatttgctctgttgtc

SEQ ID NO: 63134 - DNA, 201 bp, Homo sapiens
tcggctcactgcaagcaccgcctcctgggttcacgccattctcctgcctcagcctcccgagtagctgggactataggcgcccgccaccacacctggctaatttttttttttttttgtatttttagtagagatggggtttctctactaaaaattttagccaggatggtcttgatctcctgacctcgtgatccgcccgcctca

SEQ ID NO: 63135 - DNA, 201 bp, Homo sapiens
atataaaaaataagttactagtttcttcttggatattttctttagaaatacatattccatgtttttttttttcaagacggagtctcacttggtcacccagsctggaatgcagtggtgcgatcttggttcactgcaacctccacctcccgggttcaagcgattctcctgcttcagcctcctgagtagctgagactacaggca

SEQ ID NO: 63136 - DNA, 201 bp, Homo sapiens
ataggtattcagtccaaagaggaaaaaagttttagtagtactatgagaacctgtatctctgaaaatgttagctccataagtgtaagcactcccaaagattrtaagataataaaatgtggaaacaggcaaactatggggcgatttaaagtttctaccacttcctaaagattttcttcaatagaatcattcgtgctaagtgga

SEQ ID NO: 63137 - DNA, 201 bp, Homo sapiens
tattatgtttattatgtattgtttccctcactaaaatttaagttgacgagggcagggatttttgtctttttttaactctaatgtatcctaaacacctaaaytgatgtctggtatataaggccctcgataactatttgataaataaatgaataaaggaatcttgttaataagaatacagagaattaacaactacactgaatt

SEQ ID NO: 63138 - DNA, 201 bp, Homo sapiens
ataaggtaaagaagaagtaagaaaaataaagttggctgggcacggtggctcacatctgtaatcccagcactttgggaggctgaggtgggtggatcatgagrtcaggagttcaagaccaggctggccaacatggtgaaaccctgtctctactaaaaatacaaaatttagctgggcatgatgatgagtgcatgtaattccagc

SEQ ID NO: 63139 - DNA, 201 bp, Homo sapiens
gctttcatcccattttgccaattaaaactaatcatcatgaatcctttttagtggttttcttttttcctcagagatccctgttctgaagtatgttcttttaraagatcacaaatctcatttgaaaagctttatattgcatttagcagaagatgatatctgatgagatcaacttctctgatgattgaactttttaaatgtctt

SEQ ID NO: 63140 - DNA, 201 bp, Homo sapiens
aaagcatttatttgtagaaattaatagtttatacctgacctgaaatattctttcttaagtaagtagaataccttagttgtgatgtggtttgtgatgttctrtaatggttatatatgatgccttaattttaatactcattgagccctgttctccgagcctatgcgtaatagaccagcgcagggtaaaactgaggaagacact

SEQ ID NO: 63141 - DNA, 201 bp, Homo sapiens
gagaacatattaggtggtgatcatagatacatcgtcacagttacacatttagtaaatgaacgtgcaacatttagtgtttgataatctctgtaataaacttrcagggaattcagagtactgagaatagctttgtgttaatggattttagtaaagataaccacattttggggtgttcttttgagtctttgagtaatactttca

SEQ ID NO: 63142 - DNA, 201 bp, Homo sapiens
tggaatttatcctagaaatgaaaggctggttcaaatttgaaaatcagtcaggtttcagatcagaaaataaggtaccatattaacagtctaaagaagaaaamccaaccatacaaccacatcaattgaagtagaaaaaaatatttgacaacattgagcatccacccttttttttttttttttttttttaagagacgggattct

SEQ ID NO: 63143 - DNA, 201 bp, Homo sapiens
ctaattggtcttttagttctagtaatatttattttttcatttcagtgggaatttcagttaatgtcagttacagtctttattacaggaagagtagaattatraaaataacactctagtgttttaaataaatagacatctgacacacattcttaaggctttatataacttattcaagagaaatttaaaacatacacaataaaa

SEQ ID NO: 63144 - DNA, 201 bp, Homo sapiens
taatttttagctcccacagataagaaagaatgtgtgatgtttgcctttctgtgccaggcttatttcacttaacatgatgacctccagttctatccatgttrttgcaaatgacaggatctcattcttttttatgatagctgaatggtactccactgtgtatatgtaccactttttttatttttatccattcatctattgatg

SEQ ID NO: 63145 - DNA, 201 bp, Homo sapiens
ggtatgtaactttttctcacaagtggtagcttagcatatgcttgctgctatctttagtaacaaagaaaatattgttttaaaaaatgtactggtaattagamaagaacaactttctcagaataaaattaattatgccaaaacatgtactcagtaagcagatgtccccatagctaagaaattgatacaatctatttcctacta

SEQ ID NO: 63146 - DNA, 201 bp, Homo sapiens
gatacaatctatttcctactaactttaatctctaggtttagaattagctggatctaatgattaagtttgatgatagtaaaaatatcacgtagctgtagatrtttaaattttgacaccatgatatggatcttttgccagggtttactttaaagttctgacatgcatctataatgcctgtattatttataaattgacaaaaaa

SEQ ID NO: 63147 - DNA, 201 bp, Homo sapiens
tagtagtggaaggcatgttaaacttttaaacttagcagattccttctcttagtatattttcaaaacagtaacaaaaaaaaactcggattattttagaaatwatggcaaattagaagtaattttaatttattggccaggcgtggtggctcacgcctataatgccagcactttgggaggccgaggcaggcagatcacctgagg

SEQ ID NO: 63148 - DNA, 201 bp, Homo sapiens
gaggctgaggcaggagaatcgctggaacccaggaggcagaggctgcagtgaatcaagatcgtgccactgcactccagcctggaagacagagcaagactccrtctcaaaaaaaaaaaaatttattggatgtctgcctaaacatttaatgtatatgaattaaacacaaatacttaaaattcaaaatagagcattttagtaatt

SEQ ID NO: 63149 - DNA, 201 bp, Homo sapiens
taactatatgatatgacataatagcttactgtagttccattgctcaagcttcactaagaaactgggatgattcaacaaggtaattctaatttcagtctttyggacctatttattaactttcaacaaaaaggtgaaagatttaaaaattttaaaaatttacctaagtaaagttgatctttagaaataatgttttccaagctg

SEQ ID NO: 63150 - DNA, 201 bp, Homo sapiens
cagctctacaattcatataaaatatttcctcttcagttagtggaaatttctttgttcgaggactctctgaaggtgttgatttctgactggagaaagttgcrtcgcttcgtggactgatcgccattctattggaaaataatttaaaaatgtgtttgtcaatgtgagtcactaaaacacaaatgtcaccatgtctttcaaata

SEQ ID NO: 63151 - DNA, 201 bp, Homo sapiens
aaagtgaggagatcaacaaacaaggactgacatggctggaaaagtttcacgggggatagcaaggtcaaccaaggggatttgattattaagtaggaatcttyagtctttcttgcttttcggtttagtatctcccttaatttgatgagagtggttgtctcctctgttcaagaaacctgtcattttggtaaagtggcaaaaaac

SEQ ID NO: 63152 - DNA, 201 bp, Homo sapiens
tttgagctcctgtatggatgctcctttttagtaggcctcagtctcattccagacaccagaccaacttggactgtgccccaaaaaacttgtcatccctactrtcttctgtctagtcatactcctattcaccgttctctactcataaatgccctactcttgtttacactgccggtttacacagtttctccaagccatcacagc

SEQ ID NO: 63153 - DNA, 201 bp, Homo sapiens
tttcggtttagtatctcccttaatttgatgagagtggttgtctcctctgttcaagaaacctgtcattttggtaaagtggcaaaaaacttggctttacaagrtgtgtgctcttgggaaagttagttaatgtccgtgggcatcaatttccttactgtaaaataaacatatcacctactttggaatatttttgcaagatttaat

SEQ ID NO: 63154 - DNA, 201 bp, Homo sapiens
gtgaatgtaatcaaggttatctaactccacaaaatgaaaatatagcatagattcactgagccttcaaaatacctaccttagagttgtatggtttagatagwgaatatacagctcctaccacagtgctaataagtaagtcatcaataaatgataacttgtaaagtcacgggcccaaattcagatctcatgccctttctatat

SEQ ID NO: 63155 - DNA, 201 bp, Homo sapiens
tgaatgtaatcaaggttatctaactccacaaaatgaaaatatagcatagattcactgagccttcaaaatacctaccttagagttgtatggtttagatagtsaatatacagctcctaccacagtgctaataagtaagtcatcaataaatgataacttgtaaagtcacgggcccaaattcagatctcatgccctttctatatt

SEQ ID NO: 63156 - DNA, 201 bp, Homo sapiens
aaatagttgggcgtggtggcgcacacctgtaatcccagctactccgaaggctgaggcaggagaatcgcttgaacctgggagatggaggttgcagtgagccrtgatcatgccactacactccagcctgggagacagagtgagcctctgtctcaaaaaaaaaaaaaaaagaaaaaagaaaaaaagaaaagaaaagaataaaac

SEQ ID NO: 63157 - DNA, 201 bp, Homo sapiens
atggtttctcagatatgacaacaaaagcacaagcaacaatcaaataaattggaattcatcaaaattaaaaacttttgtgcatcaaaggacactaccaacaraatgaaaaggcaattcatgaaatgggagaaattatttgcaaatcacatatccaaaaagggattaatatatagagcatataaagaactcctacaattcaac

SEQ ID NO: 63158 - DNA, 201 bp, Homo sapiens
tatgacaacaaaagcacaagcaacaatcaaataaattggaattcatcaaaattaaaaacttttgtgcatcaaaggacactaccaacagaatgaaaaggcarttcatgaaatgggagaaattatttgcaaatcacatatccaaaaagggattaatatatagagcatataaagaactcctacaattcaacaacaaaacaaacc

SEQ ID NO: 63159 - DNA, 201 bp, Homo sapiens
ttttctctatttccttttattttcattttggttatttctcaatttatacaagttttctatttttatctttatcttttctttggaaatttcttcttaaactkcattttaagattttatcattataaactgaactatactcaagctttcagtcagtcattaatcacctgcactgtcacacctttggggtatacaagatatgtg

SEQ ID NO: 63160 - DNA, 201 bp, Homo sapiens
aaacaaaaatgtggctcttgagagcaatcagttcagttttctaacagcagttatagtatgtggtcataaccattttttccccttttacagaggtctctagrtgcacatttttaatgtatcctagcagtttccagttaatgttttatatttctgtaactattattttctgttgaaagaaaactagtaaaggttgagtctaga

SEQ ID NO: 63161 - DNA, 201 bp, Homo sapiens
tctgtgccaggcttatttcacttaacatgatgacctccagttctatccatgttgttgcaaatgacaggatctcattcttttttatgatagctgaatggtastccactgtgtatatgtaccactttttttatttttatccattcatctattgatgaactcttacgttgcttccaaatttgggctattgtgaatagtgctgca

SEQ ID NO: 63162 - DNA, 201 bp, Homo sapiens
atttttttattattatactttaagttttagggtacatgtgcacaatgtgcaggttagttacatatatatacatgtgccatgctggtgagagtatttttaastgataaatgtggtattattaaaatgttagttctcaccaatgtttagatttaatgcaatccctgtcataatcctaacaaacatttctttttaagttttgct

SEQ ID NO: 63163 - DNA, 201 bp, Homo sapiens
gataaatgtggtattattaaaatgttagttctcaccaatgtttagatttaatgcaatccctgtcataatcctaacaaacatttctttttaagttttgctcyttttttatttctactgtttaaaatggatcttttttaaaaaaagttaagtggatgaaaacttgtataatagtatttggtattatctttatcttttctgttt

SEQ ID NO: 63164 - DNA, 201 bp, Homo sapiens
ggttatagattttaaagttatcagattcttagacaacaggacaaatttaaaactctttctgttctaacactataaaatagtttgatattgcctcttcattytaaccacccactgaagtattttttaaacataaaaatatgttgttctttccccaactcaggcttgaaaaagtattcatcatatcagctgaataatttcact

SEQ ID NO: 63165 - DNA, 201 bp, Homo sapiens
ttgtgattttaggtgatggttttggtactggtgatgggtccctttcaggggacccttcgatgtggtttccaaactggtgacgcatcaatttactgtcaacytctagtttttctagtgtagtcttgagacattgctcgttggttgtcatatataatttacaaaactacaggaaaaaaaaagtccagtgggtaaaacattcaa

SEQ ID NO: 63166 - DNA, 201 bp, Homo sapiens
tatgtattttggggcaaaaatatagaagaatgttgaattacatcaagagatattttgtcctattattgatgaattttaatcatttgattacagtgatgttyaccaggtttatctatattaaaagtaatcattttccctttgtaattaataaatactttgtggggaggtactttgtcatgtttcacccagtagttttaacat

SEQ ID NO: 63167 - DNA, 201 bp, Homo sapiens
ctcccaaagtgctgggattacaggagtaagccaccacgcctggccaattttttgtatttttagtagagacgggctttcaccatgtgggccaggatagtctygatatcttgaccttgtgacctgcctgcctcggcctcccaaagtgctgggattacaggcgtgagccaccgtgcccagctgcagacttcttttaatcattgt

SEQ ID NO: 63168 - DNA, 201 bp, Homo sapiens
caattctatagatcaaaaggtttggccaggttcaatcctggtaatcacggatatataacagcttataaacatcaaggagaaagtattttgaccttcattamattctttttaaggcaagcatacctgtttaaactgatttgtctatagccagttggtttaatttcattgaattcttcccagagcctcaagataagaacccac

SEQ ID NO: 63169 - DNA, 201 bp, Homo sapiens
taaaaacaaaacagctctatatctatgtatcctcatcttcctgtctggtggtgtcaagtaatggtggaataatctatattgaggaatattgaggatgtctmcagtttaggactagaatgtcctaaactagtctctaactagagactagtctctcagttaacagagctctaatagagtaagtcagttgtaaataatcttcta

SEQ ID NO: 63170 - DNA, 201 bp, Homo sapiens
gccgccctgtgaaaaggtgccttctgccatgattttaagtttcctgaggcctccccagccatgcagaactgtgagtcaattaaacctattttctttatgawttacccagtttcaggtatttcttcatagcagcatgagaacagactaatacacagatgctttaattttatggagggctatgagccacaaaacttatggctt

SEQ ID NO: 63171 - DNA, 201 bp, Homo sapiens
aatgatcaatacagttaacacaataccagttaaaatcccagcaggatttattttttgtagatataaacaagccagttctaaaatttatatgaaaagggaargaaactaaaatagctaagatgattctggaaaagaacaataccattggggaaatcatgttacctgaatataagacttacaatgaagctactgtaatcagga

SEQ ID NO: 63172 - DNA, 201 bp, Homo sapiens
gatttattttttgtagatataaacaagccagttctaaaatttatatgaaaagggaaagaaactaaaatagctaagatgattctggaaaagaacaataccaytggggaaatcatgttacctgaatataagacttacaatgaagctactgtaatcaggacaatgtagtattagtgaagggaaagacacatcgatcaatggaac

SEQ ID NO: 63173 - DNA, 201 bp, Homo sapiens
ttatatggtattgtgagtaagaaattaggaaaatgggaaatgaaaaaaaacaaaataggatactttttctttgcccacctcccttccatttgtcctttttrctttctatttaaaatttgacaaactaaattctatttaaaatttgatgatttctcctttaactttatgtccttttctttattacacatatatagaaaagag

SEQ ID NO: 63174 - DNA, 201 bp, Homo sapiens
acctggggttagacaacgacttctaacttgacaccaaatgcataatccattaaatgaaaaactgattaattggacttcatcaaaatgtaaaactttcactmtctatacgatccagttaagagaacaaaaagactatctacagaagagaagaaaatactttcaaataacatatccaataaaagacatatccagaatttataa

SEQ ID NO: 63175 - DNA, 201 bp, Homo sapiens
aaatgtaaaactttcactatctatacgatccagttaagagaacaaaaagactatctacagaagagaagaaaatactttcaaataacatatccaataaaagrcatatccagaatttataaagaatcaaatggtaagaaaatgaaactcaaaactcaacagtaagaaaacaaataacctaatttcaaatgggcaaaaggcttg

SEQ ID NO: 63176 - DNA, 201 bp, Homo sapiens
tggatgacagagcgagactgtctcaaaaaaaaaaaaaaaatgtatgttagaggtacagcctgtaatacttgttcacaatctatcttctctgacagactatrtataatgagggcaggagcaatgtctggcttgttcacctctatataagcaataattaaagcagtactttgcacacattagggactcaatttatatatgatt

SEQ ID NO: 63177 - DNA, 201 bp, Homo sapiens
ttgctcgcgcacacccggatccttcgtcgcggggaggatgtttccgcccggccgcggtgggcttgacgcaacgtccagcgcgcgcttttcatgccttggcktttcctttggcggattttctgttttcggaagttgctgggttcgttttattcagcggcagtggtgctttcccgaatctcagaatgccgtaggtatctcctc

SEQ ID NO: 63178 - DNA, 201 bp, Homo sapiens
tcgctcctttgctcgcgcacacccggatccttcgtcgcggggaggatgtttccgcccggccgcggtgggcttgacgcaacgtccagcgcgcgcttttcatkccttggcgtttcctttggcggattttctgttttcggaagttgctgggttcgttttattcagcggcagtggtgctttcccgaatctcagaatgccgtaggt

SEQ ID NO: 63179 - DNA, 201 bp, Homo sapiens
atgtctgcttacaagtaaggtattttttgtctgttaaaactagtctgtagcttgtttcatgaatgctttgtcaaattatggaagttaaagtgcaatgatawttgaagactataagtgatggtgtatcttgtttctaataagataaaactttttgcctttgttttatcttattagggaattatatgtcagtgtttgaaacat

SEQ ID NO: 63180 - DNA, 201 bp, Homo sapiens
tgtctgctcaacctagcatgccttttccctcattattgtcaaaattttacccgtctttcaaaacctgcttagaactcatcttctgcataagcttccccaartccctctcccccatattctctcattgctcttttgtatatttgtcatagctgcctgactggtatgcgtaagggaggatgtgaatgaaactcctgattttgt

SEQ ID NO: 63181 - DNA, 201 bp, Homo sapiens
tttgagaggccaaggcaccaaatcgcttgaccccaggaattttagagcagcctgggcaacatggcaaaaccccacctctacaaaaaaaaaatatgaaaacsagctgggtgtggtagcgtatgcctgtagtaccagctactcggaaggctgagatggaagaatcacctgagcccagaaaaacaaggctgcagtgagctgaga

SEQ ID NO: 63182 - DNA, 201 bp, Homo sapiens
tcattttaattttccactcattttatccaactatccttccaagagagaatatagtatatactttctgccccgctccactacctctcagcaagctgaactcrctgccttaactcgagacctcgctctcgcaaaaggactacgcgtcaatatttatactgactgtaaatatgccttccatatcttgcaccaccatgctgttat

SEQ ID NO: 63183 - DNA, 201 bp, Homo sapiens
caagagagaatatagtatatactttctgccccgctccactacctctcagcaagctgaactcactgccttaactcgagacctcgctctcgcaaaaggactaygcgtcaatatttatactgactgtaaatatgccttccatatcttgcaccaccatgctgttatatgggcagaaagaaatttcctcactatgcaagggtcctc

SEQ ID NO: 63184 - DNA, 201 bp, Homo sapiens
cttcataaactttactggttccctgtagacactgcacagttattaataaacttaatgtcaaatttttttcagaaaaagtcatctgttaacttaaaatactrtacctttattaaatttggctccattaactttgagtttcggttaccattagcccccatggtaactgtgaaggaaacagatgttttgaacttcctggttgct

SEQ ID NO: 63185 - DNA, 201 bp, Homo sapiens
tggtcttgaactcctgacctcaggtgatccacccacctcggcctcccaaagtgctgggattacaggcgtgagccaccgtgcccggcctagtgatattatcytaattttacatttagagagactggaacatagaaataaatgaacttcccatagtcactcaaccaaacagtgacagaactggattagaaccaaagtctcctg

SEQ ID NO: 63186 - DNA, 201 bp, Homo sapiens
tagaatgatactgatacaaatatcatacttaaaataattttccactccattttatatttacattttactcatagcattaatagcaaatttttttcaaagayataaaacaaaaggctttaattagaaaataatacattaccattgtagatttgggtcccacttctactgcaaatatgttgagtcctctgttgtttatgcagt

SEQ ID NO: 63187 - DNA, 201 bp, Homo sapiens
acttcatatatacccttcgccttgtttcgccttacactgtttcccctgcttctaaaggctgtctgtctgcatatctaaatcctagtcatccttcagtgctyaaatcccatatcacagttcccttgcccctcgtaacaaatccttccccaacttctatggtccaaattaacaacaactacaagagaaacagaataaaacccc

SEQ ID NO: 63188 - DNA, 201 bp, Homo sapiens
tagaactaagaatctttgtttatatatcttcccttaattattgggctactttaaataaagcgtgtcaaatctaaaatttctttaaattttttgtttgtagygttaaaagatcactgaagttggatggtctgttagaagaaaatgtaagtatttgcttaaaagtttgtcattgaataagattgtgttttcagtttttaacta

SEQ ID NO: 63189 - DNA, 201 bp, Homo sapiens
ctaaaggctgtctgtctgcatatctaaatcctagtcatccttcagtgctcaaatcccatatcacagttcccttgcccctcgtaacaaatccttccccaacytctatggtccaaattaacaacaactacaagagaaacagaataaaacccctattgcacacacaaacagtactacattatgtaacgtttaattattctctga

SEQ ID NO: 63190 - DNA, 201 bp, Homo sapiens
tctcgatcattagcttccattagattcaaatccataaatccttgtcttgttagttcattcctctttgtatcaaaattctctgtttaaacaaccaaaagttktttcttacataatttaaaaattcataactttaataaaatgtctatgatatattattattcatagatatttattttaaaagaggcctatgaatctatgagc

SEQ ID NO: 63191 - DNA, 201 bp, Homo sapiens
atattaaataataataatttataggatctctgcaacgttagtgtaaaacgctgggttgaaatttttcctttgcttataatatttctttaaaacatgatatmtattattaaaatagctatgtatacataaaaacttttagaaacaaactaaataaaatactttgtacccagattgtgctctatattcactaatatccaaatg

SEQ ID NO: 63192 - DNA, 201 bp, Homo sapiens
ttaaagattatttataataattatgagtatggcatttttaaaggtttatttgttcagtactggtaaattctggtaatattctgccattttttaagtcatgrctatcagttttattcaaccaaagaggatcaatatttgaatattcactgaaagcaaaacatcttaaaaggtccatgttaaaacatattctctaattttttt

SEQ ID NO: 63193 - DNA, 201 bp, Homo sapiens
taaagattatttataataattatgagtatggcatttttaaaggtttatttgttcagtactggtaaattctggtaatattctgccattttttaagtcatggytatcagttttattcaaccaaagaggatcaatatttgaatattcactgaaagcaaaacatcttaaaaggtccatgttaaaacatattctctaatttttttt

SEQ ID NO: 63194 - DNA, 201 bp, Homo sapiens
gaagcagaagaggcaggcacacttggtgtaacttggaaatacactgtaatttttttcttttttcaagacaagatcttgctccattgcccaggctggattgyggtggtgcaatcatagctcactgcagcctcgaactcctgggctcaagtgatcctctggcctcagcctcatgagtagccgggactacaggtgtgtgccacc

SEQ ID NO: 63195 - DNA, 201 bp, Homo sapiens
atcctactaacttaatataggaagcaaacaacaagcaagaaaactattaactgtaaattattcattgtaaaattattaacaatatatgtgataaggaagayggggaagactgcaataataaaacctagattatgggatgttacttaaatttagcacaatatttagctctcaactacctgttaacccatacaaaagggaaat

SEQ ID NO: 63196 - DNA, 201 bp, Homo sapiens
gtcagttaggtcccagattagccaaccaaaataagatccctgcactccagaacattaaaatagggaaatctagacatgtacacaaattaataaaatatacraagtataagctacaaaaaggtactgatttttaaagctaatattaaaaagcaagatcttaataatctaagcttctaccttaagaaactaggaaaagaacaa

SEQ ID NO: 63197 - DNA, 201 bp, Homo sapiens
tatgtgataaggaagatggggaagactgcaataataaaacctagattatgggatgttacttaaatttagcacaatatttagctctcaactacctgttaacmcatacaaaagggaaataaaaagttatgtagtgcttaaactctaaaaaagaaagtaaattttcccagttctgaatctagaaagaaattaatatcatgaaat

SEQ ID NO: 63198 - DNA, 201 bp, Homo sapiens
atgtgataaggaagatggggaagactgcaataataaaacctagattatgggatgttacttaaatttagcacaatatttagctctcaactacctgttaaccyatacaaaagggaaataaaaagttatgtagtgcttaaactctaaaaaagaaagtaaattttcccagttctgaatctagaaagaaattaatatcatgaaatt

SEQ ID NO: 63199 - DNA, 201 bp, Homo sapiens
aaatggagacagtatttcccacagacagttgttttgaaaattaagtaagatatagtttgtaaagtagtaagtatagtgccttaaactaagaaagcattaaraaaatgttaacaatatatttcattgttttcataattcaactgtcatccaaaattatcagtttaggtcaagggagatggagattcagtgacctatttacct

SEQ ID NO: 63200 - DNA, 201 bp, Homo sapiens
ttttcccagttctgaatctagaaagaaattaatatcatgaaattctattttaaaaaggaaaacagaaaaaaaaggggggcaaaactaaacatgtaagtttyacttctcaaattcagtaaaagagcaactattcaattacagtatataggggcaatgcccttataaagaagttatattgctctttaacagaggatcttcata

SEQ ID NO: 63201 - DNA, 201 bp, Homo sapiens
gagacagtatttcccacagacagttgttttgaaaattaagtaagatatagtttgtaaagtagtaagtatagtgccttaaactaagaaagcattaaaaaaawgttaacaatatatttcattgttttcataattcaactgtcatccaaaattatcagtttaggtcaagggagatggagattcagtgacctatttacctttttc

SEQ ID NO: 63202 - DNA, 201 bp, Homo sapiens
atttctgttgttttaagctaccaagtttgtggtaatttgttacagcacttatagaaaactaatacagattgatatggtttggctgtgtccccaccctaatmtcatcttgtagttcccataatccccacatgtcatgggagggacctggtgggaggtaattgaatcataggggcagttaaccccatgctgctgttcttgtga

SEQ ID NO: 63203 - DNA, 201 bp, Homo sapiens
cccttaattattgggctactttaaataaagcgtgtcaaatctaaaatttctttaaattttttgtttgtagtgttaaaagatcactgaagttggatggtctrttagaagaaaatgtaagtatttgcttaaaagtttgtcattgaataagattgtgttttcagtttttaactactgatttatctcgttaaatattaaaattat

SEQ ID NO: 63204 - DNA, 201 bp, Homo sapiens
aactccccgctcgctcctttgctcgcgcacacccggatccttcgtcgcggggaggatgtttccgcccggccgcggtgggcttgacgcaacgtccagcgcgygcttttcatgccttggcgtttcctttggcggattttctgttttcggaagttgctgggttcgttttattcagcggcagtggtgctttcccgaatctcagaa

SEQ ID NO: 63205 - DNA, 201 bp, Homo sapiens
agcataaactacaatgttcctgtattctttagttaactttctgtattcttacatagtaaaattcgtcttggttatagattttaaagttatcagattcttaracaacaggacaaatttaaaactctttctgttctaacactataaaatagtttgatattgcctcttcattctaaccacccactgaagtattttttaaacata

SEQ ID NO: 63206 - DNA, 201 bp, Homo sapiens
agaattaaaatgcttcatatgtatttgccacttaaagccagcagaaactggatgaatttgatataatactccccaaactactgagtttcagaaagaaaaaygggaatagtgtcatatttaaggagattactatatgcctgattcctctaattttagctaaattgtccccaagtcttgaaagactgacagataatggggagc

SEQ ID NO: 63207 - DNA, 201 bp, Homo sapiens
tgagaaattgtcagaagaaatcatggagataatgcaaaatttaagtagtatacaggtttgcattttttcatacttctaccctgtttgaaaaggataaaatsaaagaagtgtcccagattggagaatccaatccaggaaagagtttgcatagagtatgtttaatttacttttcatgggaattttttttttaataggagaaca

SEQ ID NO: 63208 - DNA, 201 bp, Homo sapiens
gaggcacaaacgaggttaagtaccttgtcccagaatcacctaaaacagggccaggatactaaactgagtagtctggtgccagtgcctgtgctcttgccacyacccagtagtaatctgtgaatgtcaggtttcactactggccaaggtttttatatcctgttaagtaaggataatatataaatattatccttataaatccta

SEQ ID NO: 63209 - DNA, 201 bp, Homo sapiens
gggggatagcaaggtcaaccaaggggatttgattattaagtaggaatcttcagtctttcttgcttttcggtttagtatctcccttaatttgatgagagtgrttgtctcctctgttcaagaaacctgtcattttggtaaagtggcaaaaaacttggctttacaagatgtgtgctcttgggaaagttagttaatgtccgtggg

SEQ ID NO: 63210 - DNA, 201 bp, Homo sapiens
tctcaatcctcattaatttttaaaaaattaacacttgggccaggcgcagtggctcacgcctgtaatcccagcactttgggaggctgaggcgggcagatcaygaggtcaggagatcgagaccatcctggttaacatggtgaaaccccatctctactaaaaatacaaaaaattagccgggcgtggtggcgggtacctgtagtc

SEQ ID NO: 63211 - DNA, 201 bp, Homo sapiens
ctaacatgatccccatgttccttgcctcctgataatcatgcctttatgcaatccccttgtattacagattgagtatcccttatccgaaatgtttggtaccagaaatgtttcagattttagattgttccggattttggaatgtttgcattacaatggttgtgcatcccaaatccaaaaatcccaaattcagaatgttccaat

SEQ ID NO: 63212 - DNA, 201 bp, Homo sapiens
actcctgacctcaagtgatccgcccacctcggcctcccaaagtgctgggattacaggcgtgagccactgcgcctggcccaagttcaactattaatgatgartaatgatacacagactttcatttagcttccctgtaaatctcttggatgggcatatatatggactaacaacagatgctggcattacctcagacccaattgc

SEQ ID NO: 63213 - DNA, 201 bp, Homo sapiens
caaaacttacttaaattcctttgtaaggaataattcccctgtttcatctctatatacaagttgggcttcatctgttactggttttatttttttcctcagcytacagccagttgtggaaggaattaaccagtaaattccaggtcctagttcaccagtccatccaaacaccttttctcaaaacaatgaaataaaacaatcatc

SEQ ID NO: 63214 - DNA, 201 bp, Homo sapiens
acaatgaaaaatacataagaactatgagatcatttctttactttgatatgcaatttactggagagacaagctgctctcacagtttagcatcacagcatgcrgtgttttcagtggatactcacaacacttgagtttactgcaatagcagcaggaggtagctatgaaattattacaatactgcaatatgtactacagttaatt

SEQ ID NO: 63215 - DNA, 201 bp, Homo sapiens
accccacctctactaaaaatacaaaaattagctgggcatggtggcgggcgcctataatcccagctacttgggaggctgaggcaggagaatcacttgaaccyggaggtggaggttgcagggagctgagatcgtgccattgtactctagcctgagtgatagaacgagactctgtctcaaaaacaaaaaaacaaaagaaagaaa

SEQ ID NO: 63216 - DNA, 201 bp, Homo sapiens
catctacaaaaacatccacagctaacataaaatagtggtaaaagactgaatgctttccccactaagattgtgagcaaggaaaggatatccactgtcattgktcttatttgatatcttaatgggaagtcttagccaatgcaataaggcaagaaaaaagacataaaaggcatatggataggaaagaaagaaatgaaactgtcc

SEQ ID NO: 63217 - DNA, 201 bp, Homo sapiens
aagggaaagaaactaaaatagctaagatgattctggaaaagaacaataccattggggaaatcatgttacctgaatataagacttacaatgaagctactgtmatcaggacaatgtagtattagtgaagggaaagacacatcgatcaatggaacagaatagagttcagaaatagactcatgcaaagatatggttctatatgac

SEQ ID NO: 63218 - DNA, 201 bp, Homo sapiens
ttcttgtctgtaaggaagcctacaaaaaagacttttatataacattctatcagggaaatgtttgtgtgtcattgagcctatataaagattaaatatgataytgtagtaagcccttaaatagcattatttctgttttgtgtagcagatgtattttgtagtcctcataaaataaatagccacatttatgtattggcttcacat

SEQ ID NO: 63219 - DNA, 201 bp, Homo sapiens
gttgaaatttttcctttgcttataatatttctttaaaacatgatatctattattaaaatagctatgtatacataaaaacttttagaaacaaactaaataawatactttgtacccagattgtgctctatattcactaatatccaaatgtttaattttcctaatattttaagagaaaaaattggaaacctttaaaaatcatat

SEQ ID NO: 63220 - DNA, 201 bp, Homo sapiens
aggatcttcataggctgatacagggaatgtgtaatcagtaattctacagcctaaattagagaatttaataaggaaaaataaagaaataagtaataagaatktaataagaaacaataaagaaatttagtaagaaaaaagattttaaatctgttcaactgatgaggaacagctccacttcaattaacacacttatgttaggca

SEQ ID NO: 63221 - DNA, 201 bp, Homo sapiens
ctttgtatgagccagccactgttccaagtgttttacaagtattaaccccaaaagtaccctttataaaaagaccagaaatccaagttctaatgcagacacaktctccttattctaagagagcctttaaactgttaagacaaagtgtttccctatagaaatgagactttagtaactcaaactgccttttccaattttaatttt

SEQ ID NO: 63222 - DNA, 201 bp, Homo sapiens
ggattataggcatgagccacagcacccagcctgttttttctgtaaacctaaaattgctctaaaaataaagtttattaggaggcagtgcttgcagtgagccragatcacgccactgcactccagcctgggcaacagtgtgagactccatctcaaaaaaataaataaataaataaacaaaataaagcttattaataaacaaaa

SEQ ID NO: 63223 - DNA, 201 bp, Homo sapiens
ctataaaataagacacagaatcccaaataaaccagctttatatgaaattctgtttcctatcaaatgttggatatttatcatgggtaccagaacatttgtayaggaaaacattttattctccagttctataaagaaagcaggctgggcatggcggttcacgcctgtaatcccagcactttgggaggccaaggtgggtggatc

SEQ ID NO: 63224 - DNA, 201 bp, Homo sapiens
aagactgccaaccaatcctcaattctttatttaaatttttttttagagacagggtctggttatgttgcccaggctgaagtacagtggctattcacaggtamgatcatagaataatacggctttgaactcctgggctcaagtaatcctcctgcttcagtttcccaagtagcagggacttcaggtgcatgccaccatgcccag

SEQ ID NO: 63225 - DNA, 201 bp, Homo sapiens
cctcaattctttatttaaatttttttttagagacagggtctggttatgttgcccaggctgaagtacagtggctattcacaggtacgatcatagaataatayggctttgaactcctgggctcaagtaatcctcctgcttcagtttcccaagtagcagggacttcaggtgcatgccaccatgcccagctcctcccatccttaa

SEQ ID NO: 63226 - DNA, 201 bp, Homo sapiens
cctagtcacctcaaatttgaaaatatccagatgtccatcaacagtcaaatggataaacaaattatggtatttatctaatggactacagtgaaaattatctrtagctaacaacaatggctgaatatcacaaacataatgttggatgtggaaaaaactagacacaaaaggtttcatagtgtataattccatttgtatgaagta

SEQ ID NO: 63227 - DNA, 201 bp, Homo sapiens
ccaagagaacaggtccaggctagtttactgaaggattattaaagatcatatgaggctgagtcaagttgtcccagatgggacttcatacgtaagaaagaacycagccaagattagcaaagccagccaccagctaacctgtagctaaccataactgtgtgagcaagccctatagagaaaaaacaagcctggctcagactaaga

SEQ ID NO: 63228 - DNA, 201 bp, Homo sapiens
tgtctcttcttttatttctatactaatagactcccaaactctcatgtaaatgaagtcttgtgccgagaccagctcggtcggggagaccctaacccagtggygctagaggaattaaagacacacacacagaaatatagaggtgtgaagtgggaaatcaggggtctcacagccttcagagctgagagccccgaacagagattt

SEQ ID NO: 63229 - DNA, 201 bp, Homo sapiens
tcggtcggggagaccctaacccagtggcgctagaggaattaaagacacacacacagaaatatagaggtgtgaagtgggaaatcaggggtctcacagccttyagagctgagagccccgaacagagatttacccacgtatttattaacagcaatccagtcattagcattgtttctatagatattaaattaactaaaagtatcc

SEQ ID NO: 63230 - DNA, 201 bp, Homo sapiens
tctttatcagcagcatgaaaacagactaatatacctcttctaatgaaggaagcagagatatggaccataccctgtgttcttcctataatatacgggatgtrtactgccagtaccacaatttgctaaacctcacaaattgttgggtgttgtaaggaggtgaagaaagttccaatttataatcatctactgtatttggcctgc

SEQ ID NO: 63231 - DNA, 201 bp, Homo sapiens
cttgtggaactgtaagtgcaattaaacctctttttcctcccagtctcaggtatgtctttatcagcagcatgaaaacagactaatatacctcttctaatgarggaagcagagatatggaccataccctgtgttcttcctataatatacgggatgtgtactgccagtaccacaatttgctaaacctcacaaattgttgggtgt

SEQ ID NO: 63232 - DNA, 201 bp, Homo sapiens
tcctggatcaatgccatggctccatggaaggcgatggatagtagatacatattaaaatatctatctgtaacactaatttgttaccattatgaatcctttcrgctgcatttgaggaaaaagtagttggctatttagaagtgtgtacatcattgttagtcattcttacagataaaaacatcttgggtcagcccactctgtcca

SEQ ID NO: 63233 - DNA, 201 bp, Homo sapiens
cctaagagcagcaataaatttgcacatttgcttaatcctacatcatacacaaaatacttgcagaattcccatgctcacagcactgctaaaaacaaacctgyaaagcattcaagatttgtttgcagttttttgtctctaaagatatatagtcaaattactgttttcaaaaattatttggattagttcttcatttgaagaagt

SEQ ID NO: 63234 - DNA, 201 bp, Homo sapiens
tttttgtctctaaagatatatagtcaaattactgttttcaaaaattatttggattagttcttcatttgaagaagtattcatttgaaataggttttcttgtycgtgaattttacttttttctcatcctttttgactttttaaaatgagataagccatcattatggttctaaaagtcaaaactgttgccaaaaaaggatactc

SEQ ID NO: 63235 - DNA, 201 bp, Homo sapiens
aacataaaatagtggtaaaagactgaatgctttccccactaagattgtgagcaaggaaaggatatccactgtcattgttcttatttgatatcttaatgggmagtcttagccaatgcaataaggcaagaaaaaagacataaaaggcatatggataggaaagaaagaaatgaaactgtccccatttgcagattacatgctttt

SEQ ID NO: 63236 - DNA, 201 bp, Homo sapiens
cagcaggatttattttttgtagatataaacaagccagttctaaaatttatatgaaaagggaaagaaactaaaatagctaagatgattctggaaaagaacartaccattggggaaatcatgttacctgaatataagacttacaatgaagctactgtaatcaggacaatgtagtattagtgaagggaaagacacatcgatcaa

SEQ ID NO: 63237 - DNA, 201 bp, Homo sapiens
gctggttcgaactcctgattttgtgatccgcctgcctcggcctctcaaaatgctgggattacaggcatgagacacagcacccggccaagagcacttattattatttatttatttatttgagacagagtctctctctgtcacccaggctggagtgcagtggggtgatctcagctcactgcaaactctgcctcccgggttcaa

SEQ ID NO: 63238 - DNA, 201 bp, Homo sapiens
tggtatataaggccctcgataactatttgataaataaatgaataaaggaatcttgttaataagaatacagagaattaacaactacactgaatttgcagggytatcttgattcctctctctgaaaaataactattgttattgtcatttaaaagtatcatctgccaaacattatatgtatcccacaagagatgcagtgaaaac

SEQ ID NO: 63239 - DNA, 201 bp, Homo sapiens
attaacaactacactgaatttgcagggttatcttgattcctctctctgaaaaataactattgttattgtcatttaaaagtatcatctgccaaacattataygtatcccacaagagatgcagtgaaaactttcaaaatctctactttaggagggaaaaagaatggggaggtgggaatcctttagtaagaaaatgcttgtatg

SEQ ID NO: 63240 - DNA, 201 bp, Homo sapiens
gaccttatgtagaaacctattttttacattttaataaacactgctttatgttctgcttttaaaaattaattttatatccaaaatattttgctgttgaaaaygaataaagctagaggactcagactttctgatttcaaaacttactacaaagatacagtaatcaaaagggtgtggtactagcatgaaaacagacatacagaa

SEQ ID NO: 63241 - DNA, 201 bp, Homo sapiens
aaactggaagcctttatatgatatcattgattaaaatatttgatgaaagtatcctttatctaataaagtttactaatgcattttaacctaattatagaatyatatttgatttctctttaatataccaaccttcagtggaaattttattcaaaagattattttttcttatatggtattgtgagtaagaaattaggaaaatgg

SEQ ID NO: 63242 - DNA, 201 bp, Homo sapiens
tctgtaatctcagcattttgggaagccaaggtaggaggatcgcttgagcccagaagttcaaggccagcctgagcaacatagcgagactccatctctacattcaatcaatcaatcaatcaatcaatcagcaagcaagcaagctggatgtggtggtgtgcctgtagtcccactactcgagaggctgaggtgggaggatcacta

SEQ ID NO: 63243 - DNA, 201 bp, Homo sapiens
aaaattgaggtagccagagattatatgggttcagagttttataaggagtttgtagcaatattaggtctagagtccaagacatttggcctctacatttagamcaagtttctaaaagaaaatgtactcagggtacgaattcaaattttttattatctgtgatacaatgaggttcaaagttgggcttgtggcagaagttgaagt

SEQ ID NO: 63244 - DNA, 201 bp, Homo sapiens
cctatagaaacttaaaaaagccattaaaggttgggggagtggggtggatatcaaacacctgtaatttctccttggccgtccttgtcctcaggttgatttargtaccccctctagtgtaacctgttccttagtttatttcaggattaagtaaaatgcaaagtaacacagctggggaaatttttgtatcaaataggaattgac

SEQ ID NO: 63245 - DNA, 201 bp, Homo sapiens
ctgtaatctcagcattttgggaagccaaggtaggaggatcgcttgagcccagaagttcaaggccagcctgagcaacatagcgagactccatctctacattcaatcaatcaatcaatcaatcaatcagcaagcaagcaagctggatgtggtggtgtgcctgtagtcccactactcgagaggctgaggtgggaggatcactag

SEQ ID NO: 63246 - DNA, 201 bp, Homo sapiens
ggggcttactctaattctagacatgactggtcttagcaaggaaggtgaagctattcctctctgaaaggaaaattcctgacattccttgaccatcacagaayctaagtaaatggatagaattcgggattttaaaaagaataataatgcagtaactaagtatggccaatggaaagtaatatgcgtatagtacctgtaaggatc

SEQ ID NO: 63247 - DNA, 201 bp, Homo sapiens
tgtaatctcagcattttgggaagccaaggtaggaggatcgcttgagcccagaagttcaaggccagcctgagcaacatagcgagactccatctctacattcaatcaatcaatcaatcaatcaatcagcaagcaagcaagctggatgtggtggtgtgcctgtagtcccactactcgagaggctgaggtgggaggatcactagg

SEQ ID NO: 63248 - DNA, 201 bp, Homo sapiens
gtaatctcagcattttgggaagccaaggtaggaggatcgcttgagcccagaagttcaaggccagcctgagcaacatagcgagactccatctctacattcaatcaatcaatcaatcaatcaatcagcaagcaagcaagctggatgtggtggtgtgcctgtagtcccactactcgagaggctgaggtgggaggatcactaggg

SEQ ID NO: 63249 - DNA, 201 bp, Homo sapiens
atcatacactggggaagaggagaaagcaaatgcacattagtaggcaaggaacagactgatagatggaatatatttcctattgatggttacgcattttattkttttgaatcagattgaccagcctcaagtgacctagtgaaatgtagccgtgattcaatgaggagttcatactctgtgtgaaaataaaatgttacacaagga

SEQ ID NO: 63250 - DNA, 201 bp, Homo sapiens
aatacagttccatgttctaggtttaaaaatgtttttttcttcacaaaacaagtagttaatggcatgtcaataaagcccatttgtaaaaaaacagctacacrttaatattttatgtgaacttccatatcctttatgttttgcaaggaatatatataatttactgcgattggcttttcttcctcttggcaatttgctgctgct

SEQ ID NO: 63251 - DNA, 201 bp, Homo sapiens
agttgatctttagaaataatgttttccaagctgcttttgaagacagttaagtaggcagctctacaattcatataaaatatttcctcttcagttagtggaawtttctttgttcgaggactctctgaaggtgttgatttctgactggagaaagttgcatcgcttcgtggactgatcgccattctattggaaaataatttaaaa

SEQ ID NO: 63252 - DNA, 201 bp, Homo sapiens
aattttaatatggaggaagtggagattgggttaggctgtcatgttgagcagaaatttgtgaaagaagattcattaaattaggtacatggagagttaagcarcattgggtgctcagcaaaatcatacttctaatattgactgtcaattctactgtgagacttttttttttttccatagtactgacagcttagactaggagca

SEQ ID NO: 63253 - DNA, 201 bp, Homo sapiens
ttatgttttcttaatttatcttgaaatggcaggcaaccacatctgcaaacctcaatccacaatgcatatcaagcaattcaactttttcttgtaatgtcatkactttgctatgcttcttaggagcacttccggcatcactaatgtcactagtggcattttgaatgggtcccatagtgttagacaaggtttacaatattccat

SEQ ID NO: 63254 - DNA, 201 bp, Homo sapiens
ctggaccaggtcttttttattctgttcattgatccatcaaatagttactgggtccctcccataactgcaggcactttattagttaacacaggttgtaacartaaataaggtagataccgcccttgccttcacggaacttacaatatggtaagggagacctatgtcaaacaattggaagttacaaaaaaggagggaaatcaa

SEQ ID NO: 63255 - DNA, 201 bp, Homo sapiens
cataatttttagctttttcataatgctatcaaaagtctcttgtttcttgttcgcatacttagataaaattttacttagttgaaacttactgtacatatacrttgtatatcaaaattttaacatatttgtcttatttttaataacaaaaatgtcaatgactaacactgatgtaatcttgaaaaagcatttaaatagaatttc

SEQ ID NO: 63256 - DNA, 201 bp, Homo sapiens
tcaataatttttatattcattatatgttgaaatattttgaatatattgatttaaatacttaaacatgaaaattattaaagaaaatttacctttttattccytttagtgtggctactaaaaattttaaattacatatatggtttacattatttttctatcagactgtgttgatatagattatcacaaacagctgtggggtct

SEQ ID NO: 63257 - DNA, 201 bp, Homo sapiens
acacattcacaccttcacacctcaataagcaaagtaatcatgaactgtaaaataccaaaacctttagactaatacaggagtgattaatagtacctacatgwatgccatttagcaatttctgcaagtggaattaggccttaaaatgggtggccgtgttttcagcctaccacttttaaataccgatgactgccatttattgag

SEQ ID NO: 63258 - DNA, 201 bp, Homo sapiens
gagccaccgtgtcaggcctacccctcagactttcaataatgattcctagagttcctggctcacacattacctcaccacatgaatctcatctatatcctctraatcaggtccactatttgctttatttttcctcaaatcattacagttcttttttcccccagaaattaagctaggctgagcatcaaagataggctttataag

SEQ ID NO: 63259 - DNA, 201 bp, Homo sapiens
tgtgaagcatatacaatattgcttgacacgtagtaagtgctaaataaactgcagataatgagaaactccagaataatgagaatcgggatatgagtggtagytgacacccatcttccacagcaggatcaacaagatcatttcattaacatctcaataatgcagccccacatttcaaatagctatattttaaaagtcttattt

SEQ ID NO: 63260 - DNA, 201 bp, Homo sapiens
ctgttaacaagcgcctaaggcttctacagggccaagtgaaaacagaaagccgtccagtcaccgtccctacacagtgaaataccgtcacaggtaatctcggrcaccatctctctatttttgtattcctctggaaataaaaccgcatttacatgtacattttaggtacatacatggaccaaatgtttatgacagagaagtaga

SEQ ID NO: 63261 - DNA, 201 bp, Homo sapiens
gctgggattgccagccagtcagatctaaaggccagctgggtcatggcagggctgcagccatggcaagactcctccaaagctcatgtgggaagggagctgartaggcttcctgagcttttcagttgaacaactaacatctactgtgatgccaagaatttaagaacatgaaaggtggctttttcttggatgtggcttgggatc

SEQ ID NO: 63262 - DNA, 201 bp, Homo sapiens
ctgggtcatggcagggctgcagccatggcaagactcctccaaagctcatgtgggaagggagctgaataggcttcctgagcttttcagttgaacaactaacrtctactgtgatgccaagaatttaagaacatgaaaggtggctttttcttggatgtggcttgggatctttttaaaaaaaaaaaagaaagaaagaaaagaaaa

SEQ ID NO: 63263 - DNA, 201 bp, Homo sapiens
cattgttagtaaattaagtgtttttttttttttttaatgtggttactggtgaggtcataaatgagtggtgcaaatagttatcttggcaagttacatatgcrggtggattcatttttaagtgatgttgaaatggtgactatttggtatgtatttggaagactaaatgtgtaatataacttatgggagggtgtgatctatctt

SEQ ID NO: 63264 - DNA, 201 bp, Homo sapiens
ggttatatatgtatatgataagattattgttaaaaggcagagaaatgataaatacagagaaatgataaatacagtttaatagatgccttttgggggaagcmaatagatgcatgtatacccagtcatattggtaatgatctagttcttaaattatgtggtgagtttatgcgtgcttattttctaatgttttataacttgcac

SEQ ID NO: 63265 - DNA, 201 bp, Homo sapiens
taatagaggaaggtataatagagcctttttggctgagcgtggtggctctcacctgtctatttaacttagaattttttgacttcataatagtgtgaaagcartatgcattcagtagaaactactttaagtacccatacaaccattcttttctttactttcagcacaatattcaataaattacatgagatgttcaacacttta

SEQ ID NO: 63266 - DNA, 201 bp, Homo sapiens
atagtgctacaataaatgtacaagtacatttgtctttttgatataatgatttattttcctttgatagatacccagtagtgcggtggttgctgggtagttcyttttttttttttttttttttttttaagttggagtcttgctctgttgtccaaactggagtgcagtggtgcaatcttggctcactgcaacctccgcctcccg

SEQ ID NO: 63267 - DNA, 201 bp, Homo sapiens
accttaatttgtgagtaaaactctagctttttggctttttgctgccctctcctggtcacagtttgtggttcttgaccacttcaggcccagtggtatcaagygcaaggacaagttttttgtcttctaaaccccgaagagtagagaatcaaaactaaaattatgattaagtaattcacactttcttttaacttgagtattata

SEQ ID NO: 63268 - DNA, 201 bp, Homo sapiens
ttcttggaccaaagaaaatacctccttccagtctcacaagcccattctattctgtcatcatttcataacctcttccatgtaggttacaagccattaagccygcctcatagaacctctcatttcctttccatcatgggactctaccctcaaggaaatcacttctcagtgttccagctgcaattctactacctctcagggatt

SEQ ID NO: 63269 - DNA, 201 bp, Homo sapiens
aactaaataaaatactttgtacccagattgtgctctatattcactaatatccaaatgtttaattttcctaatattttaagagaaaaaattggaaacctttaaaaatcatataaaaattaccactcccagtttgagttagaaacctgaggagaaaaaataattatgcattataaacattattaatgtgatgggatacttaat

SEQ ID NO: 63270 - DNA, 201 bp, Homo sapiens
accaactatggatctagatagaaacactaatactgagatacttatgacctcagtaatcttaaatgcaggtaaattggtgagaaagtaaattaaaacaaatmgctagtcaataagtaggctcctccaaattcacatatgaatgccatttcaataaatgggttttatatggaatttttctttggaagacacactggtatttaa

SEQ ID NO: 63271 - DNA, 201 bp, Homo sapiens
taatctcagcattttgggaagccaaggtaggaggatcgcttgagcccagaagttcaaggccagcctgagcaacatagcgagactccatctctacattcaahcaatcaatcaatcaatcaatcagcaagcaagcaagctggatgtggtggtgtgcctgtagtcccactactcgagaggctgaggtgggaggatcactagggc

SEQ ID NO: 63272 - DNA, 201 bp, Homo sapiens
aaataaccaaaactaatcaatactgctaaaagttagtagttattcttagtttctgggatgttgtcagtgttctctttcgtgatctgggtactaactgcaaytgaatgagctgtacacttatgtgtacccttgtctcttcttttatttctatactaatagactcccaaactctcatgtaaatgaagtcttgtgccgagacca

SEQ ID NO: 63273 - DNA, 201 bp, Homo sapiens
tccaaaacatattttatctgttttgagaataattgtgtaggttgcagtatgcatattttaaatgaaatggaaccatctgaactttacattgttcagtgttycagctgtttgtaatagaaaatatttcagaatttccaactttggtctgttttaaaaagcataaactacaatgttcctgtattctttagttaactttctgta

SEQ ID NO: 63274 - DNA, 201 bp, Homo sapiens
acgacttttaggagaaacaacagaaattccccctatgctttaacattctgggtttatctggagataaaaaatgaagccattaattttgatagcacaaatayacattaatgtacaactatagtcctcagctctttataatgattcagctatcatgtatgccatatgtgaatcataacctttcctattaataatgttaatgct

SEQ ID NO: 63275 - DNA, 201 bp, Homo sapiens
ctgcacccaggtgaaataaacagccttattgctgagaaaaaaaaaaagaaaaagatttcctactaaataagaacaccacacaatgaaagcattatttataktttaataataaagtacataccatggacataaaatgaaaatgcatataaattgaatagattattatttaggtacatcagttaagtagcatttagttgttta

SEQ ID NO: 63276 - DNA, 201 bp, Homo sapiens
gattttctgaggtgtcattcctggttttttattaggaatcaaatgatagggtttttttttcctagaataatttctttaatactgtaactgatgttagtcartaacattgtgtaataaaactcatctgctttttctgttctgatgaaccagagaatcctattcaggatactaccatatgttaagctaaatagaaaagaggtc

SEQ ID NO: 63277 - DNA, 201 bp, Homo sapiens
ccaacttccctacctgcacaactgctccagccctctgtcacacttcagtgattattcctcttgacctgtaattgttcagtggggaggactgtcccatacarattcactcccagagcctttaaaaagtgaagcctttgtgaaacaatgctagaataagagagaaagtaagggtgacagcaacccagaggccacagccagagt

SEQ ID NO: 63278 - DNA, 201 bp, Homo sapiens
aacattgtgtaataaaactcatctgctttttctgttctgatgaaccagagaatcctattcaggatactaccatatgttaagctaaatagaaaagaggtcartcttagagaataatataattatacaaacatagttactctctctataaaattgcatgtcacatgctttctatctttttaaaattctcaacagcagtatttc

SEQ ID NO: 63279 - DNA, 201 bp, Homo sapiens
ctgcatccttgacctcctgggctcaagcagtccctctgccttggcctaggagtacaggcatgagccaccacccccagccttattaggtcatttttaaagawctcttcccacatgccctgtggtaatgtatgccattagttgccaaaggctgcttccttcaagggctttctctcacagaagggttctaaggctgaagagaca

SEQ ID NO: 63280 - DNA, 201 bp, Homo sapiens
aggatactaccatatgttaagctaaatagaaaagaggtcagtcttagagaataatataattatacaaacatagttactctctctataaaattgcatgtcamatgctttctatctttttaaaattctcaacagcagtatttctggtagcaaccagaattttgatcccagtgaatctaaacctagtatacctagaaatataat

SEQ ID NO: 63281 - DNA, 201 bp, Homo sapiens
tgaataagattttgttttatatatatatcacattttgtttatcggttcatctgtcagtggatatttgggttgcttttctaccttttggctattgtgagcartgctgctgtgaacattggtgtacaaatatctgtttgtgtcccagctttcaattatttttggaagtggaatcatggaatcatatggtaattctatttttaa

SEQ ID NO: 63282 - DNA, 201 bp, Homo sapiens
gtgttgtaaaagagtggttgggcccagttctaatataatattaagaatagatggtcataaactctgtagtgggtttgctcttctcttcccttctttaattyccttcccctcaattccataaagatttattatgcacagggcctgagatctgagtttctctccctcaagatgtgtgacaataggcaagttgcacaaactgtt

SEQ ID NO: 63283 - DNA, 201 bp, Homo sapiens
tctgtttctttggtcagaatggttttttggtagatgagtagtccagcttgaaatgaaatactgttctttcctaccccaaagctgttctttgggagatggtmacattgtttaaatggaaaagaatgaccgtttcagaacccgttctcttcatgaagtaaattgtcatcatggcaggccttctttgtattttttcttcagatg

SEQ ID NO: 63284 - DNA, 201 bp, Homo sapiens
agccagactgtgtctcaaaaaaaaaaaaaaaattgtagtggcccagaatgaagtaggagtaagcttaggagttgcaaatctgcagctgtttcctcaactgccccttttgcccataatcatacccgttgcttggaatagttcccggctccctatctcaagaatgggttatgagtagacacatggaaaagccctgccctaatc

SEQ ID NO: 63285 - DNA, 201 bp, Homo sapiens
gttttggttactgtagccctgtagtatagtttgaaattaggtagcatgatgcctccagctttgttctttttgcgtaggattgccttggctattcgggctctttttttggttccatatgaattttaaaattttttttctagttctgtaaagaatgccaatggtagtttagtgggaatatcattgaatctataaattgctttg

SEQ ID NO: 63286 - DNA, 201 bp, Homo sapiens
acgaaaaatacaaaaattagctgggcatggtggcacacgcctgtagtcccagctacttgagaggctgaggcaggagaatcacttgaacccgggaggcggasgttgcagtgagcaagatcgcaccactgcactccagcctggcgacagagcaagactccgtctcaaaacaaacaaacaaacaaacaaaaatgaaatgtttac

SEQ ID NO: 63287 - DNA, 201 bp, Homo sapiens
taaaagcagaatttacaaacattttgttccttgcagtacacctttcaaaagacatcttcatcaaataggtaagaaaggtaagaattgctgaggtaagtagwggtctcttttattatggtcttcattctatcattattaaaccttaatctcatgtcctgttccaaagcattatgtgagtattcaatcaaagaagtgaggctg

SEQ ID NO: 63288 - DNA, 201 bp, Homo sapiens
aaacaagacttcaggttgttttaatttcattttgcttcaacatttattctgcatcatatactgtggcaagttgctttgaattgttttctgaaaaaaaaaamctttcttctttcatatagcatcacgtcatcttgacagctatgaattccttaaagccattttaaactgaggtactgtttcacctttctaatttagtttaac

SEQ ID NO: 63289 - DNA, 201 bp, Homo sapiens
gccgagaccatgccactccactccagcctgggggagagtgagactccgtctcaaaagaaaaaagcaaatgagaggttgccagcagcatctaactaaactakgtaccaaactagattgttattaggtgttaaaatcacttcttaagtcatgtatgacgtgcatgttaactaattcttgataatataattatcttttatatct

SEQ ID NO: 63290 - DNA, 201 bp, Homo sapiens
tcaatttactgtcaacctctagtttttctagtgtagtcttgagacattgctcgttggttgtcatatataatttacaaaactacaggaaaaaaaaagtccartgggtaaaacattcaatcatacactggggaagaggagaaagcaaatgcacattagtaggcaaggaacagactgatagatggaatatatttcctattgatg

SEQ ID NO: 63291 - DNA, 201 bp, Homo sapiens
atacctattagcagttagtctcaatttcctcctctccccctccccctggaaaccactaatctactttctgtctgtgtagatcttcttctgaacatttcatrtaaatggagtctcataattttgtgtctggcttctttcatttagcataacattttcaagattcaatttacctgtttctttctttgattgtccttttgatgt

SEQ ID NO: 63292 - DNA, 201 bp, Homo sapiens
gctgaacccatttattagcattaataatttggagattttcttttttttttgttttgagacagagtcttgctcttttgcccaggctggagtgcaatggcgcratcccagctcactgcaacctccgcctcctgggttcaagcagttctcctgcctcggcctcccaagtacctgggactacaggtgcacacaaccacgcccagc

SEQ ID NO: 63293 - DNA, 201 bp, Homo sapiens
taagttctaagtataattatttaagaaataagagaatatatacaataatatatccattcttgtcgttcattcaaaggcattacatgttgacaaacctgcamataaaaatagaaagcttttactctctttttatatattgttacttttggctaatttttaaacaggacaacatttctaggccttgtataagaatatccctgt

SEQ ID NO: 63294 - DNA, 201 bp, Homo sapiens
agtagagacagggtttcaccacattggccaggctggcctcgaactcctgacctcaggtgatccgcccgtctgggcctcccaaagtgctgggattacaggcrtgagtcacagcccccccgccctacttagggtattctatatataagatcaggtcatctgcaagtagggatagttttacttcttcttttgcaatctacgcct

SEQ ID NO: 63295 - DNA, 201 bp, Homo sapiens
gagagaaggtgctctgttacaccagcaggaaataggtgctgtcctgggcctagaactccccgctcgctcctttgctcgcgcacacccggatccttcgtcgyggggaggatgtttccgcccggccgcggtgggcttgacgcaacgtccagcgcgcgcttttcatgccttggcgtttcctttggcggattttctgttttcgga

SEQ ID NO: 63296 - DNA, 201 bp, Homo sapiens
cccgccctacttagggtattctatatataagatcaggtcatctgcaagtagggatagttttacttcttcttttgcaatctacgccttttatttctttttcrtgcccattgctttggccagaacctcctgaaaaatattaagtagaagtggcaagagcagacattcttttcttgtacctgatcttagagggaaagaatccag

SEQ ID NO: 63297 - DNA, 201 bp, Homo sapiens
aaccttgctttccttgcataaattctgcttggctatgacatataattcttttatgctgctgatttcaatttgccaggatttttacatctgtatttataagkgatttgggtctgtaatgttctggtatcaggataatactggcttcaaagaattaggaagtgtttcctcatatttttggagagtttgagaatacttggtgtc

SEQ ID NO: 63298 - DNA, 201 bp, Homo sapiens
tacaaaattagccaggcatggtggcacatgcctgtaatcccagctgaggcaggagaattgcttgaacccgggatacggaggttgtggtgagccgagatcgygccattgccctccagcctgggcaacaagagtgaaactacatctcaagaaaaaaaaaaaaaaaaaacgctagtggaattcacttgtgaagctacctggtcc

SEQ ID NO: 63299 - DNA, 201 bp, Homo sapiens
ttctatagatgtctgttaaatctagttggtatatagttttattcaaattttctgtttccttgctgattttctatctaggttttctattcattattgaatgyggggaattgaagtttccaactattatagttgaattttcaatctctcccttccaattctgccagtttttgttttatgtattttgggcctctcctgttagat

SEQ ID NO: 63300 - DNA, 201 bp, Homo sapiens
tttgaacaaagggatgtaagtttatagtgcttttacggcaggtaaatgaaactccctttctctttagctactatgactctacaatcactactgcaacaatrcaggacagtggctccagatactattaacaaaagcccttggtaatgggtctaggtctctaagtccagaatgttcaaaagttaaggattttttgttttattt

SEQ ID NO: 63301 - DNA, 201 bp, Homo sapiens
ttgaacaaagggatgtaagtttatagtgcttttacggcaggtaaatgaaactccctttctctttagctactatgactctacaatcactactgcaacaatgyaggacagtggctccagatactattaacaaaagcccttggtaatgggtctaggtctctaagtccagaatgttcaaaagttaaggattttttgttttatttt

SEQ ID NO: 63302 - DNA, 201 bp, Homo sapiens
aggtctctaagtccagaatgttcaaaagttaaggattttttgttttattttatttttttagaatagggatctcattctgtcatccaaactggtgtgcagtsgtataatcatgtttcactgcagcctcgaactcctcgactcaagtgatcctcccaactcaacctcccgagtagctaggactgcaggcacatgccaccacac

SEQ ID NO: 63303 - DNA, 201 bp, Homo sapiens
gaggcaagagaatcacttgaacccgggaggcggaggttgcagtgagcagagatcgcaccactgctttccgggctgggctggcaaagtgagactctgtctcaaaaaaaaaaaaaaaaaaaaattaacattgttattttttgtgagttgatcctccaaagaggttatttaccctccactctattaatattaatttggtttatt

SEQ ID NO: 63304 - DNA, 201 bp, Homo sapiens
aaaattgtgatttaattatgtatggatcttgctacagctgatttttctcttctctcaaataatttaataccttaatataggtattactttggacataaatrtaaacttttggcacttattttaaaatgcaactgcaggctttgttcccttactatcccatccattaaatagaaattatggcctgacttgccttcagctact

SEQ ID NO: 63305 - DNA, 201 bp, Homo sapiens
ggtggcgcatgtctgtagtcccagctacttaggaggctgagttgggaggatcacttgagcccacgtggtagaggctgtagtcagccatgatcactgcactcagcctgggtgacagagcgagaccctgtctccaaaaaaaaaaaaaagaattcttagcttaccaggtgttttgcctgctatctcttaggggaaaaaaaatca

SEQ ID NO: 63306 - DNA, 201 bp, Homo sapiens
aaaaaaaaagaattcttagcttaccaggtgttttgcctgctatctcttaggggaaaaaaaatcaaagcacaattaaagaattatattctacctccaagatrcttttctttggaaatggtatctcaagtgattaatattagcttcctgacaagctagtcttaatatttgcaaagcatcttatatagaaaattgtgtccgttt

SEQ ID NO: 63307 - DNA, 201 bp, Homo sapiens
attaatattagcttcctgacaagctagtcttaatatttgcaaagcatcttatatagaaaattgtgtccgttttttatgaaaacgtttattctgttgtatgyagtaacaatagcttatattctgttgtttgcagtgagtaatagcttataataatagctaatatttattgagtactttctgttgttttgtttgtttgttttt

SEQ ID NO: 63308 - DNA, 201 bp, Homo sapiens
tttattctgttgtatgtagtaacaatagcttatattctgttgtttgcagtgagtaatagcttataataatagctaatatttattgagtactttctgttgttttgtttgtttgttttttgaaatggagtcttgctctgtcactcaggctggagtgcagtggcacgatctcggctcactgaaacctccacctcctgtattcaa

SEQ ID NO: 63309 - DNA, 201 bp, Homo sapiens
ttattctgttgtatgtagtaacaatagcttatattctgttgtttgcagtgagtaatagcttataataatagctaatatttattgagtactttctgttgttttgtttgtttgttttttgaaatggagtcttgctctgtcactcaggctggagtgcagtggcacgatctcggctcactgaaacctccacctcctgtattcaag

SEQ ID NO: 63310 - DNA, 201 bp, Homo sapiens
tattctgttgtatgtagtaacaatagcttatattctgttgtttgcagtgagtaatagcttataataatagctaatatttattgagtactttctgttgttttgtttgtttgttttttgaaatggagtcttgctctgtcactcaggctggagtgcagtggcacgatctcggctcactgaaacctccacctcctgtattcaagt

SEQ ID NO: 63311 - DNA, 201 bp, Homo sapiens
attctgttgtatgtagtaacaatagcttatattctgttgtttgcagtgagtaatagcttataataatagctaatatttattgagtactttctgttgttttgtttgtttgttttttgaaatggagtcttgctctgtcactcaggctggagtgcagtggcacgatctcggctcactgaaacctccacctcctgtattcaagtg

SEQ ID NO: 63312 - DNA, 201 bp, Homo sapiens
aagataatcaaaaagcaaataaggccgggcacagtggctcatgcctgtaatcgcagcactctgggaggccgaggtgggcagatcacgaggtcaggagttcragaccagcctggccaacatagtgaaaccccgtctctactaaaaatacaaaaattagctgggtgtggtggcacacacctgtagtcccagctactcaggaga

SEQ ID NO: 63313 - DNA, 201 bp, Homo sapiens
ccaaagcattatgtgagtattcaatcaaagaagtgaggctgttctccagaattggttctctgctacaggtcaaaaccgactgcgccagccttggcgaagckccgcctactgccctttgctccaagtaatttttggcgatttttaaagtaatttttccggcggagtcatagtggcgctatactcttggataggttatcctgt

SEQ ID NO: 63314 - DNA, 201 bp, Homo sapiens
gctctttgctagttgagtgagggaatatattagttaagtgaggaaactgaaattcagatgagtggtgtgtccatgatagcatagctggggagcagcaaaascattatgtgagcccaggctttccaatgttaagtctgcggttccttccatataccacagctatctttcctttagtgtaattgtttaaagacttcatgattc

SEQ ID NO: 63315 - DNA, 201 bp, Homo sapiens
agaattgcttgaggctagcaatttgggacaagcttgggcaatgtagtaagaccctgtctctaaaaaaattttgtttgttaaataagctggcatggtagtgygtgcctatagtctcagctactcaggtgggtaaagtgggaggatcacttgagcccaggagttcaaggctgcagtgagctgtgatagtgccactgcacttca

SEQ ID NO: 63316 - DNA, 201 bp, Homo sapiens
aggctagcaatttgggacaagcttgggcaatgtagtaagaccctgtctctaaaaaaattttgtttgttaaataagctggcatggtagtgcgtgcctatagyctcagctactcaggtgggtaaagtgggaggatcacttgagcccaggagttcaaggctgcagtgagctgtgatagtgccactgcacttcagtctaggcgac

SEQ ID NO: 63317 - DNA, 201 bp, Homo sapiens
gttggagaccaacctggtgaacatagtgaaaccttgtctctactaaaaatacacaaattagccggacgtggtggtgggtgcctgtaatcccagctacttcrcttgaacccgggaggcagaggttgcagtgagccaagaccgtgccactgcactccagtccggaagacccagcaagactctgtgtcaaaaaaaaaaagaagg

SEQ ID NO: 63318 - DNA, 201 bp, Homo sapiens
aattgacattttaaaaatatacaaaaaacttaaacttgccttcaacttgactcaggtttaatggcttaattgttagataaaccatggacctctgagctatwtgcatcctgtactgatgactaatgatttcaccatcttcttctaagaagaagcaaccttttgattgcatgtgttgccagtcctgaaatgaaggaaaaaatt

SEQ ID NO: 63319 - DNA, 201 bp, Homo sapiens
ttaaaagttctataagagaagctcaaatcataaaattttgtgattttctgaggtgtcattcctggttttttattaggaatcaaatgatagggttttttttycctagaataatttctttaatactgtaactgatgttagtcagtaacattgtgtaataaaactcatctgctttttctgttctgatgaaccagagaatcctat

SEQ ID NO: 63320 - DNA, 201 bp, Homo sapiens
cagtaatcttaaatgcaggtaaattggtgagaaagtaaattaaaacaaatagctagtcaataagtaggctcctccaaattcacatatgaatgccatttcartaaatgggttttatatggaatttttctttggaagacacactggtatttaacaaaacagaaatttaccatttagaaaacttgctacatgctttttaaaaat

SEQ ID NO: 63321 - DNA, 201 bp, Homo sapiens
actataaacacctctacgcaaataaactagaaaatctagaagaaatggataaattcctcgacacatacaccctcccaagactaaaccaggaagaatttgamcctccgaatagaccaataacaggctgtgaaattgaggcaataattattagcttaccaaccaaaaaaagtccaggaccagatggattcacagccgaattct

SEQ ID NO: 63322 - DNA, 201 bp, Homo sapiens
gggcaaaggatatgaacagacacttctcaaaagaagacatttatgcagccaaaagacacatgaaaaaatgctcatcatcactggccatcagagaaatgcaratcaaaaccacaatgagatatcatctcacaccagttagaatggcaatcattaaaaagtcaggaaacaacaggtgctggagaggatgtggagaaataggaa

SEQ ID NO: 63323 - DNA, 201 bp, Homo sapiens
atggaatactatgcagccataaaaaatgatgagttcatgtcctttgtagggacatggatgaagctggaaaccatcattctcagcaaatatcgcaaggacaraaaaccaaacaccgcgtgttctcactcgtaggtgggaattgaacaacgagaacacatggacacagtaaggggaacatcacacaccagggcctgttgtggg

SEQ ID NO: 63324 - DNA, 201 bp, Homo sapiens
cacgttgtgcacatgtaccctaaaacttaaagtattaaaaaaaaaaaaaaaagaagtgccttttgcctcccgccatgattctgaggccttcccagccttgkggaactgtaagtgcaattaaacctctttttcctcccagtctcaggtatgtctttatcagcagcatgaaaacagactaatatacctcttctaatgaaggaa

SEQ ID NO: 63325 - DNA, 201 bp, Homo sapiens
ttgggtggggctgattgcagcatcttagaatgtggcatttcttttgtttagaaatggtgttaaataactctaaggagtcaggaattattacaagcaggttkgtttgtttgtttgtttgtttgtttgtttgtttgttttttgagacagaatctccctgtgtcgcccaggctagagtgcggtggcgtgatcttggctcactgc

SEQ ID NO: 63326 - DNA, 201 bp, Homo sapiens
aattattacaagcaggtttgtttgtttgtttgtttgtttgtttgtttgtttgttttttgagacagaatctccctgtgtcgcccaggctagagtgcggtggygtgatcttggctcactgcaacctctgcctcctgggtccaagtgattctcgtgcctcagcctcctgagtagctaggacaacaggcgcgccaccatgcctgg

SEQ ID NO: 63327 - DNA, 201 bp, Homo sapiens
gtgatttacccaccttggcctcccaaagtgctgggattacaggcatgagctgccagcagttgtaaattattatagaagtggttgtgacatctattttcttscgcgcgcgcgggtgtgtgtgtgtgtgtgtgtgtggtgtgatccacagctcactacagcctcaacttcctgggtttaagtgatcttcccacctcagcctcc

SEQ ID NO: 63328 - DNA, 201 bp, Homo sapiens
caccttggcctcccaaagtgctgggattacaggcatgagctgccagcagttgtaaattattatagaagtggttgtgacatctattttcttgcgcgcgcgcgggtgtgtgtgtgtgtgtgtgtgtggtgtgatccacagctcactacagcctcaacttcctgggtttaagtgatcttcccacctcagcctccagagtagctg

SEQ ID NO: 63329 - DNA, 201 bp, Homo sapiens
agtgagtttaagtaagagctgagacattttacaacatataaaaataataggccgggtgcccattattatctactaaaaatacaaaaattagctgggcatgktggcaggcgcctgtggtcccagctacacaggaggctgaggcaggagaatcacttgaacctgggatggggaggttgcagtgagttgatatcgtgccactgt

SEQ ID NO: 63330 - DNA, 201 bp, Homo sapiens
aattgtgatttaattatgtatggatcttgctacagctgatttttctcttctctcaaataatttaataccttaatataggtattactttggacataaatgtraacttttggcacttattttaaaatgcaactgcaggctttgttcccttactatcccatccattaaatagaaattatggcctgacttgccttcagctactat

SEQ ID NO: 63331 - DNA, 201 bp, Homo sapiens
gtttcagaggtgctggcaatgttctgttttttgacctacatagtggttacactgattcactctagttattcatcagactgcacatacatgtttcatatgtrctgtaatatatatatctcacatatagaagtctcgaaacagaattttgtccagaattctgtatgagattatgtcatttgtaatcattacattgcttatcct

SEQ ID NO: 63332 - DNA, 201 bp, Homo sapiens
gtttcatatgtgctgtaatatatatatctcacatatagaagtctcgaaacagaattttgtccagaattctgtatgagattatgtcatttgtaatcattacrttgcttatcctaatatgtcatcttgtacatgttttaaaaataaaaaagcttgatttttatgaagtaacttaagttcaaaataaatgagaaaatatgacgt

SEQ ID NO: 63333 - DNA, 201 bp, Homo sapiens
taaaatattatacaaaacataatataaaatttaaattacattttcaaggacatttttggtgttactcacttcccatcacacttatgataagatccaaaacmcttatcatgacatggaaggccatatatccatctaacacccaaacacctcatctgcctcattttctaccccttttttacactactttagccactcttacct

SEQ ID NO: 63334 - DNA, 201 bp, Homo sapiens
cttatgataagatccaaaacccttatcatgacatggaaggccatatatccatctaacacccaaacacctcatctgcctcattttctaccccttttttacaytactttagccactcttaccttcttgctatttgtcagtcatgctgagccccttcttgccacaaggtcttgcagttctctccacctggaataatcttcctcc

SEQ ID NO: 63335 - DNA, 201 bp, Homo sapiens
gtaatgatacacagactttcatttagcttccctgtaaatctcttggatgggcatatatatggactaacaacagatgctggcattacctcagacccaattgcccttaacataatcaacatgaccttggatggtgatgactgctaaagaatagaaatgaaagaaatgttatacagcatttagacaagttacactttgagacag

SEQ ID NO: 63336 - DNA, 201 bp, Homo sapiens
ctggagaacccatcaagtccttgttacactttcagccttcttcaggggaaaccaagtacactggaaccttggactgtgcaaagaagttgtaccaggagttwcagatccgaggcatctacaaagggaccgtgcttacccttatgtgagacgttccagctagcggaacgtatttcatgacaaatgaatggctaaaaaatatct

SEQ ID NO: 63337 - DNA, 201 bp, Homo sapiens
accttggactgtgcaaagaagttgtaccaggagtttcagatccgaggcatctacaaagggaccgtgcttacccttatgtgagacgttccagctagcggaaygtatttcatgacaaatgaatggctaaaaaatatcttcactccggaaggaaagagggtctgtgagctcagtgtgccttgaatcctggtggctgggtgcatt

SEQ ID NO: 63338 - DNA, 201 bp, Homo sapiens
gggaccgtgcttacccttatgtgagacgttccagctagcggaacgtatttcatgacaaatgaatggctaaaaaatatcttcactccggaaggaaagagggyctgtgagctcagtgtgccttgaatcctggtggctgggtgcattgcagggatcttcaactgggcaatggcagtcccgcaagatgtgctcaagtatcccttc

SEQ ID NO: 63339 - DNA, 201 bp, Homo sapiens
ttatctggtacattcaccacaggcatcgcgacccctggagaacccatcaagtccttgttacactttcagccttcttcaggggaaaccaagtacactggaaycttggactgtgcaaagaagttgtaccaggagtttcagatccgaggcatctacaaagggaccgtgcttacccttatgtgagacgttccagctagcggaacg

SEQ ID NO: 63340 - DNA, 201 bp, Homo sapiens
aaaccaagtacactggaaccttggactgtgcaaagaagttgtaccaggagtttcagatccgaggcatctacaaagggaccgtgcttacccttatgtgagaygttccagctagcggaacgtatttcatgacaaatgaatggctaaaaaatatcttcactccggaaggaaagagggtctgtgagctcagtgtgccttgaatcc

SEQ ID NO: 63341 - DNA, 201 bp, Homo sapiens
gagctcagtgtgccttgaatcctggtggctgggtgcattgcagggatcttcaactgggcaatggcagtcccgcaagatgtgctcaagtatcccttccagaygcacctcctgggaaatatcctaacagttttggagatgtgctgagggagctgatctgggatgaaggaatcacatccttgtctaaagggtctgatgcagtga

SEQ ID NO: 63342 - DNA, 201 bp, Homo sapiens
agtcaaggacacgtggcctgtggtcccccgatgtcctcctgaagggaagatccccccactccctgtgggatgtgcccccacctctgccgtggcatttcacsacctccatcagcttctggaagcttccagatgccagaggcctcttctccatctcttgttccctgagccgggcatggatgggcccaggtgcctgtggagatg

SEQ ID NO: 63343 - DNA, 201 bp, Homo sapiens
gcaagcgggcccccacagggagggacgccctctaaatcctggccacaaaacccattctgtcctgccctctctcccctctcccactcacatccccaaactcrgccttccaccatcttgttgtgaagggggcgattattcacatctgtgttctcttcccttaagcattttctagggagatttggtgtctgtgtggctcactcc

SEQ ID NO: 63344 - DNA, 201 bp, Homo sapiens
cacacatgaatgttccaggcttcccttgtctggacgatgtgatcagggagacaccatcccagattctggctggtaacagagcaggcctcctcaaccctggyaccattgacacttgggctggacaattctctgtcatggggcagcatccgtggcctctgcctactgccagtagcacctcctgcccagttgggacaaccaaaa

SEQ ID NO: 63345 - DNA, 201 bp, Homo sapiens
gccctcctgcctctgctctcaggagaaggacactcctggaattccacatggatcccaccttctccctggagccctgccatactcctgggcaccgctgatgygctctcctgctggctgacttggccttgaacacgggtggctcaggcctttcccagggacccttgcttcatgccccagctggaggaagccacactcacagca

SEQ ID NO: 63346 - DNA, 201 bp, Homo sapiens
aactcaaagctccaggcttggctcattgtgggagagaaatgcaggcccttcccgtccctggaaaagggaccttcccacacagcagtcgctgtccaggcacytggactgtcccctgtctatccatcttggggtctcactcgtgcacctagtctcacttagagatgtagttcagtgccgcgcagacaaggggcggaggcatca

SEQ ID NO: 63347 - DNA, 201 bp, Homo sapiens
ctctactaaaaatacaaaaattaaccagtcgtggtggcgggcacctgtagtcccagctattcgggaggctgaggcaggagaatcacttgaacctgggaggyggaggttgcagtgagccaagatggaacaaaagtacactccacaggatgggagtgggcaagcggctcaagaacctggatacagaattttctggggtttaaa

SEQ ID NO: 63348 - DNA, 201 bp, Homo sapiens
ttaggaaccagacctgagctgcctggttgggagggggctgaggagctggggaccgccactgggggttgtcttttcctccctttcatttgtctgccctgtgytgaactgtgtccaaggggagatgacataagtaatagctcttggggaagtgggctattagcatttatggaaattaatacatccacatccgaggagcaagaa

SEQ ID NO: 63349 - DNA, 201 bp, Homo sapiens
gctgagctgagggatgagggtgcaggcagagatctgggagctgagctaaggggtgagggtggagtagggggacgcgggggctgagctgaggggtgagggtrgagtgggggacatggaagctgagctgaggggtgagggtagagtggggggatgtgggagctgagctgaggggtgagggtgcagtggggggacgtgggagct

SEQ ID NO: 63350 - DNA, 201 bp, Homo sapiens
ggcagagaagcagcgagcttgcacggagacaagttccaacagcgaccactggccgaggcagcaaagcaggacaatgcaatgaagaaagaccagggaggccragggggaaccctctgagagagggatcatctgaagatgtggagaacattccagcccaagaggagaggggtctggaatggatgcctctctcagctggaggag

SEQ ID NO: 63351 - DNA, 201 bp, Homo sapiens
cgttccccctttgcctgtgggtttgacctgatctggaactcacagagctcctcaggctcattgaaggttaatgcctgcttgggggtgtgcagtactgataygacgtggatcagtgacatctttctgatatgtttttctgttggtgaattaacaaaccgggcacctggcgagagactgtgccccagcaggatgtgacatcaa

SEQ ID NO: 63352 - DNA, 201 bp, Homo sapiens
tgggccctgcaccccgtccgccagacggacacgctggaactgcagcggctgcgggaggtgcgggcggctgcccaggccaggaacatggagagcttcctccrcatgcacggcctttccctggacggctgcaccgcccagcgcacaggcatgaagtatcggtaagggccgggcaggggggcggtggggtgggaagtctgattt

SEQ ID NO: 63353 - DNA, 201 bp, Homo sapiens
ctgagctgagggatgagggtgcaggcagagatctgggagctgagctaaggggtgagggtggagtagggggacgcgggggctgagctgaggggtgagggtakagtgggggacatggaagctgagctgaggggtgagggtagagtggggggatgtgggagctgagctgaggggtgagggtgcagtggggggacgtgggagctg

SEQ ID NO: 63354 - DNA, 201 bp, Homo sapiens
gcagagtatgtattgagcgtctgctgtaacctaagttttactgggagtgttggaatctctctgtccctttgacccccgcgtttccttccttgggccatctktgtcataaccatcaagacgcagtggcttcttcacatttctggtgatgttgcttctccatgtgccaatcccccagcggataccccactctccggagggaga

SEQ ID NO: 63355 - DNA, 201 bp, Homo sapiens
ccctgcaccttgtccacaggatcttcgcggcgtctcagcctctccggagctcactgttcccatctgtaagagggtgtgtgtgggaccgttccggcagggcyatcctgagggtcagtggccccaagtctgtaaatcacccacccagctcagggcgggacgtgtcacactcctctgggaagtggtcccctccagcacagaccg

SEQ ID NO: 63356 - DNA, 201 bp, Homo sapiens
gatctgggagctgagctaaggggtgagggtggagtagggggacgcgggggctgagctgaggggtgagggtagagtgggggacatggaagctgagctgaggrgtgagggtagagtggggggatgtgggagctgagctgaggggtgagggtgcagtggggggacgtgggagctgagctgaggggtgagggtagagtgggggga

SEQ ID NO: 63357 - DNA, 201 bp, Homo sapiens
gggagctgagctgaggggtgagggtgcagtggggggacgtgggagctgagctgaggggtgagggtagagtggggggatgtgggagctgagctgaggggtgrgggtggagtagggggacgtgtgagctgagctgaggggtgggggtggagttgggggatgtgggatctgagctgaggggtgagggtagagtgggggacatgg

SEQ ID NO: 63358 - DNA, 201 bp, Homo sapiens
gggtccctgcttgcaaagtgtcaggccaaaaagagcttggcgtgagaacgggcctgggtacagcaaaggcgtgctgctacagaagatgtgggtgcaaagcrcttccacttctttggctggagcacttagggtcaggggagccagggggccagagaagggagtggctcagagagcttgggggcctggggttggatcccaccc

SEQ ID NO: 63359 - DNA, 201 bp, Homo sapiens
ctccacatgtgatagataaagtcatctccctgttgtaatacacagtggcctcagaggagggtatattgtctgagggaggaggggcttccccttcatttagwcaaggacacgtggcctgtggtcccccgatgtcctcctgaagggaagatccccccactccctgtgggatgtgcccccacctctgccgtggcatttcacgac

SEQ ID NO: 63360 - DNA, 201 bp, Homo sapiens
gtggaaggacctccacgacatatagggtgggagtgtggagtgatggagtgtggaaacccttctcacagttgtcacctgctctccagcccctcctgagcccrtggacctgcctgcctgccgtgtgtctgtctgtcgtctgtctgtctgtctctctgctgaggggctccccgatgccctgaacccagacagcctcctcagcct

SEQ ID NO: 63361 - DNA, 201 bp, Homo sapiens
gaagtgtggggtgggctacatgccctgttaaaggcacaggcatcccagcccccatccccttctgcaaggctgtgtgaggacatcctgcctcccgtgggccrtgtttgcttatgcagcatccatgggagggctccctggggacgggctgtggtgatgactctgctctcagcagaaccctccactctgaagccctggtttcct

SEQ ID NO: 63362 - DNA, 201 bp, Homo sapiens
gggagctgagctgaggggtgagggtagagtggggggatgtgggagctgagctgaggggtgagggtggagtagggggacgtgtgagctgagctgaggggtgrgggtggagttgggggatgtgggatctgagctgaggggtgagggtagagtgggggacatggaagctgagctgaggggtgagggtagagtggggggatgtgg

SEQ ID NO: 63363 - DNA, 201 bp, Homo sapiens
gggtagagtggggggatgtgggagctgagctgaggagtgagggtgaactgggggatgtgggagctgagctgaggggtgggggtggagttgtgggttgtgtragctgagctgaggggtgagggtggaggcggggacgtggcagcccagctgagggccttggagcacacctggtaggaagccagcctgtggacctggagccga

SEQ ID NO: 63364 - DNA, 201 bp, Homo sapiens
agacagcagcctgtgtaagatgagcactgggttctggggaaggacggtaaacagttcgccttattctgtgctgggcactgtgcttaagcccagcagcgggccctggctggactcagtgtccagagtgtctctgctcagggctggccgagagtcagcgctttctgtccctgtggcggacagtccgacctctccgaggctgcc

SEQ ID NO: 63365 - DNA, 201 bp, Homo sapiens
ctccgaggctgccatagagactcatatcagccaggcgagctgggagcgccaccactccccagatagttactgcccgggcctccctgcccagtcactgcatgggggggggctcagctcctgggtgtgagtttgtgccaggctccagagaggtggggaccccagccacacccagggacagggccaagtggccaagagaccact

SEQ ID NO: 63366 - DNA, 201 bp, Homo sapiens
ctctgtctctctatgtctttagcaggtgtttcccacactttagtcattggcctttcatctcatgatttgggtcatctgtgctatttcttttctttttttctttttttttttttttccgacagggtctcactctgccgcccaggctggaatgcagtggcgcaatcttatctcactgcaacctccaactcccaggctcaggcg

SEQ ID NO: 63367 - DNA, 201 bp, Homo sapiens
gtggcacgatcttagctcactgcaacctgaggctcaggccatcctcccatctcggcctcccaggttgctgggaccacaggtgcacatcaccatacctggctgtgtgtgtgtgtgtgtgtgtgtgtgtgtgtatttttagtagagatgggttttcagtatgttgctgggctggtctagaattccagggctcaagagatttac

SEQ ID NO: 63368 - DNA, 201 bp, Homo sapiens
tggcacgatcttagctcactgcaacctgaggctcaggccatcctcccatctcggcctcccaggttgctgggaccacaggtgcacatcaccatacctggctgtgtgtgtgtgtgtgtgtgtgtgtgtgtgtatttttagtagagatgggttttcagtatgttgctgggctggtctagaattccagggctcaagagatttacc

SEQ ID NO: 63369 - DNA, 201 bp, Homo sapiens
ccctctcccactgtggatccccttggaggagactgctgcagctgcagggcaccctctgtcgccctaagaggagcagcagaacatgacctcccatcgctccrcttcccactgctctgcttggcttcagcctcatgctggcatctgtgttatctataagcagaaagctgcttgttcagagcgggctgagacaccttcgtgcgt

SEQ ID NO: 63370 - DNA, 201 bp, Homo sapiens
agaacacttggacactgatcacttgctgaactccccgtggagccaccagggggaccacagtccctctggtgccaaagatgctgtgctgggtgagaggcgcratggagctgctgtcctgggctctcctgatgtgcctgacattttgacatttcatgtctcacttgtgcaactagggctgcagggcctcagagctggggaggg

SEQ ID NO: 63371 - DNA, 201 bp, Homo sapiens
gacagggtcctgcagtggccaatggtgccagagggcaggtggcccaccctcgccgtcagggagggtggctggccccatccccactgccacccagccccacycactgttggaagagggaccagcgcgaggtggtgcccagggtgggcactgctgcttaatgcgaggcacacctggggcagctgagccccccgaaggctgcgg

SEQ ID NO: 63372 - DNA, 201 bp, Homo sapiens
gaaacacttgcactcccactcactcccacactgcctttggcggtcgaacttgcaagcactgtatccgacccgtgagaagcctagcgccatagtccctcgcyctgcaaagctcagaggcttctgaaatttgaaatttcgacgccaagttctgtttttaaaatcacaatatccccatgaggctgagagggagctataaccagc

SEQ ID NO: 63373 - DNA, 201 bp, Homo sapiens
atggaaaatgcagccagcatagacagcagtctgtggagtagagctgcagttttctagggaaagggcagaaaaacctggaagagaaagtacagcaaaatcakagccgtcaaaacataaataaataaaatagtgagaaagcagagccccacagtgccgtgagtcgctccctctctttcctgcctctggtcctgccaatcccag

SEQ ID NO: 63374 - DNA, 201 bp, Homo sapiens
ttggttaggaggcctacgctgccaggctctgccgctgctgttgggcctggctgtggctgtaacaaaggaagggctggccttgcttgagaactggcagcccyaccatggagctccccgcaccccgagggacagatgcacaggccatgtggtccagtgaagtgggacgatctcctgccccagtcgctggagacaggaagaaga

SEQ ID NO: 63375 - DNA, 201 bp, Homo sapiens
ccaggggtcttcaaagcatggtccctgggcctgcagcatcagcgttacctggaacttgtgggaaatgcagattcttggacccccaccctatgttcatggarccagtgactcagtccctgcactgttttccaacccaagttgagtttgtgattccggaattctggaagttagctcagcacctagacccaagagagagtgaag

SEQ ID NO: 63376 - DNA, 201 bp, Homo sapiens
agagaaataataacttattgggtgcagctggcagtgcgtcctgaagaaggaggaatgggcttgggatgcccttgagtgggtgtggggctggggacagccaygtgaccatggacactgtggggccggttcactgggtagccacaggagggaaggcaggtggctttgagcacagatcgtgtcgctgtgtgtggaaggtggctt

SEQ ID NO: 63377 - DNA, 201 bp, Homo sapiens
ggcacgatcttagctcactgcaacctgaggctcaggccatcctcccatctcggcctcccaggttgctgggaccacaggtgcacatcaccatacctggctgtgtgtgtgtgtgtgtgtgtgtgtgtgtgtatttttagtagagatgggttttcagtatgttgctgggctggtctagaattccagggctcaagagatttaccc

SEQ ID NO: 63378 - DNA, 201 bp, Homo sapiens
gcacgatcttagctcactgcaacctgaggctcaggccatcctcccatctcggcctcccaggttgctgggaccacaggtgcacatcaccatacctggctgtgtgtgtgtgtgtgtgtgtgtgtgtgtgtatttttagtagagatgggttttcagtatgttgctgggctggtctagaattccagggctcaagagatttaccca

SEQ ID NO: 63379 - DNA, 201 bp, Homo sapiens
aagtggaattgctagatcatatagtaattcgacttttagttttcaaagaaccaccatactgttttccatagtggctgtaccattttacattcccaccaacdgtgcacagggtccccatttctccacatcttgccaacccttattattctgggcttttttatagcggccatcctaatggctgcgaggtagtatctcactgtg

SEQ ID NO: 63380 - DNA, 201 bp, Homo sapiens
ttggcaccggctgcgcttcctcagagactgccctgagcaggcgactggtgggggcccgggggcatgggacattggtggttctttctgacctgcacctgctkgggttgatgccaactgtggactctctctcttctctccctttctcctttttctcttttctccattgctgtccgaagtactcggtatgggagtcccaaaaga

SEQ ID NO: 63381 - DNA, 201 bp, Homo sapiens
ataactcactgtagcctcaaactcctgggttcaagggatcctcccacctcagcctcctaaatagctgggaccactggcatgcaccaccatgaatgactaatttttttttttttttcgagatggaaagtttcactcttgtctcccaggctggagtgcaatggcacaatctaggctcactgcgacctccgcctcctgggttca

SEQ ID NO: 63382 - DNA, 201 bp, Homo sapiens
cctcaaactcctgggttcaagggatcctcccacctcagcctcctaaatagctgggaccactggcatgcaccaccatgaatgactaattttttttttttttycgagatggaaagtttcactcttgtctcccaggctggagtgcaatggcacaatctaggctcactgcgacctccgcctcctgggttcaagcaattctcctgc

SEQ ID NO: 63383 - DNA, 201 bp, Homo sapiens
tgaccctgggggacagcagtgcagtcaggagctcagaaagtacacagatgccccctgggcggtctcttctgcaccatgtgggcagcagaaactacacctayggtttcagaacaacagttggggtggtgtggaaggacctccacgacatatagggtgggagtgtggagtgatggagtgtggaaacccttctcacagttgtca

SEQ ID NO: 63384 - DNA, 201 bp, Homo sapiens
catgaatgactaatttttttttttttttcgagatggaaagtttcactcttgtctcccaggctggagtgcaatggcacaatctaggctcactgcgacctccrcctcctgggttcaagcaattctcctgcctcagccttccgagtagctgggattacaggcgcccaccaccatgtccagctaatttttgtatttttagtagag

SEQ ID NO: 63385 - DNA, 201 bp, Homo sapiens
ggcaagtctcctgtgactgagacatctgatcaccttccggtggccaaagcaagtcacatggttgcacaggagcgcaaggctaggaattcacccctccaacktgtgtgtgtgtgtgtgtgtatgtgcatatgtacgtgtgtctgtgcattgtgtatatgtgttatgtatgtatgtgtgtatgtgtgtgtacatatgtgtgta

SEQ ID NO: 63386 - DNA, 201 bp, Homo sapiens
ctaggaattcacccctccaacgtgtgtgtgtgtgtgtgtgtatgtgcatatgtacgtgtgtctgtgcattgtgtatatgtgttatgtatgtatgtgtgtakgtgtgtgtacatatgtgtgtatgtgtgtatgtctatgtgtgtatgtgtgtaggtatgtttgtatgtgtatgtatctgtatgtgtgtaggtatgtgtgtat

SEQ ID NO: 63387 - DNA, 201 bp, Homo sapiens
ggctgaggcaggagaatcacttgaacccaggaggcagaggttgcagtgagccaagatcatgccactgcagtccagcctggcaacagactgagactctgttaaaaaaaaaaaagagagagagagagaaagcaagcaagaaagaaagagaaagaaagaaaaggaaggaaagaaggaaggaaaaagaaaagaaaagaaagagct

SEQ ID NO: 63388 - DNA, 201 bp, Homo sapiens
tccagcttcagcgtaggacttggtgtccgcaagaatgaggcccacatccaggagcaggccagtttcacgtgaagcccagggctgaagccagaggccacgcrgcaccacgtcggacagtgtttatctgtgctaatcatgaagtaacacaagtgaggtttaaaaatactacgcttatttcatttcagtgcaggagggagaaag

SEQ ID NO: 63389 - DNA, 201 bp, Homo sapiens
ggagaatcacttgaacccaggaggcagaggttgcagtgagccaagatcatgccactgcagtccagcctggcaacagactgagactctgttaaaaaaaaaaragagagagagagagaaagcaagcaagaaagaaagagaaagaaagaaaaggaaggaaagaaggaaggaaaaagaaaagaaaagaaagagctatgccctggc

SEQ ID NO: 63390 - DNA, 201 bp, Homo sapiens
ctgagggggcagtgcctaggagtgggaggaaagagcatgggaccagattcactttggaaatagaagcccccaaccagcagccagccaggtggaggaaggcrtgcagagctgagagggttcaggaggcggtggggggagccactgggaggggacccaggggttcaggtgaaagacagcagtggctcagcccaagggtggcag

SEQ ID NO: 63391 - DNA, 201 bp, Homo sapiens
ttttgggcaataaaccctacagcaaaaaggactacagatcctaagccgcccccgcccgcctgctcggacagtttccgttccctcctagtctctgttcgctygcttaagctgttttgaagccaagtgaagagtgtggtttgcatccaagagaaaacaccacactgtgatgtcatcgggaaatgatctcccaagtcgctgcca

SEQ ID NO: 63392 - DNA, 201 bp, Homo sapiens
actcagccagagctggcaggaggcggggatgcacctcctgcagctgaggttgagacaaagccaggtgcctgccacggcagctgtggcctgagctggcatcrgtggctgatggccacagactccctgatgcctgtcatctgtactgagggctctgtcccagcccctgaaccgtacgtgatgcccacaccaccgatgaggaca

SEQ ID NO: 63393 - DNA, 201 bp, Homo sapiens
atttcagtgcaggagggagaaagaacacacagtctgtatgagcaactcaaatcaaaaataaatgaggcaaaagagtcaccaaaaatagtgtggcattagaracagcagcctgcgtggctcggccagctgtcctcggctctctgccggcaagcagcaccacagagagggctgcgaggatgccttgatggtgtttactccaga

SEQ ID NO: 63394 - DNA, 201 bp, Homo sapiens
ctgcatgctctctgtgctcccgttttcatttggacacttggggtgcagctgtcctgcctggaatgcagctttgcctgtgcttgtctcacagatgcaggggrcagaaaagggcagcttagccagagttcctggcaagcactgctttgcggactgagaatctcatgccaagaggtgtttacatccaggggccgggtcccactc

SEQ ID NO: 63395 - DNA, 201 bp, Homo sapiens
tgggccagaggttgttgttacacccaggtcagggtgaaggtggggcggggagggtggtggcctcactctatctggtgaatttcattttgctgcaccagggytgacggggtgggtgggatgctccgtgactcagaccaccagttattaaagatcccagataaatttattctgtgcttacctcttctccgtcagcgactgggc

SEQ ID NO: 63396 - DNA, 201 bp, Homo sapiens
aggctggcaggtttgcagtctgtggaccagagttcaaatcccagccctggcactctctgactgagggcgggtttgcagtctgcagaccagagttcaaatcmcagccctagcactctctgactgagggacccccatctctccagtggagttgcaaacaccgccttatacctggccaggcctgggagctttccttgctgctgt

SEQ ID NO: 63397 - DNA, 201 bp, Homo sapiens
gaataaagagaggctggctgtagaggtggatgttggtggggggcctcgaatgcctagcgatggggcacagatgcactcagagggcactggggagccatctrtggtgtttgagcagggcaggggtcagagatctgctctaggaaggaagcctggtagcagggagtaagacagggaagagagaggctaatgcaaggagaccag

SEQ ID NO: 63398 - DNA, 201 bp, Homo sapiens
actgcctcggtggctgcctcctggctccatgaggagcccacgcaccccggctgggcacgtggtacacatcatatgatggagaagtgcccatttcatgcccyaggctcctgggtgggagggctttcaggacctctgtgtgagagatgaggacgtcggggatgaaggaggaccccccaggggccgggcttatcacaccccttc

SEQ ID NO: 63399 - DNA, 201 bp, Homo sapiens
cagcaggatgtgacatcaagatgccaggcttagggccctgcagggtgctcttggggagacccgttcctctctctgggctgcctctccctcacctgtaaggyaggggatgcatgttcttggtgcagcctccaaccctaggaagtaaaatgtcagggctgcctggagcccatgggcagcagcctccccatgccttgggactgt

SEQ ID NO: 63400 - DNA, 201 bp, Homo sapiens
atgcctctgccacagtatctgtgcaatagggacagtaagagcgcacccggcgagggtggctgggatgcccgcagcgcccaggagaaggtgccacacagccyggggctcagcactcgcaggcaccggagcaaggcaccggggtgtctggctcttgctgtatctttattgtcttcatgcctttcctgtccgtgttcattttct

SEQ ID NO: 63401 - DNA, 201 bp, Homo sapiens
gggcagaggctgattggagttggtttataagccggaagaagaagaggaatcgcagataagtgaaggaaaactttttgaggaattttctcaaatggaaggcragaaacagtggagaagaaagtgggtctaagaaactgcttttttaggccgagtgaggtggctcacatctgtaatcccagcatttagggaggccgaggcggg

SEQ ID NO: 63402 - DNA, 201 bp, Homo sapiens
acggtgtacagttcccgtctgtggctgcaggctggagagctgactgctggcacagatacagcctgacctcgggtcaacacttctcggagtccagaggggtkgggagtgggacaggtggcctcccagggacgcctccctgagtggccagtggtgccgcttgtccctgcacctgtagctgccctgagcacccccactggacac

SEQ ID NO: 63403 - DNA, 201 bp, Homo sapiens
ctgggccctgcaccccgtcagctgctaggctcccctcttgggtctggtgtgttggtttctgaagcctgttctcccaagtcccggaggtgtcagggatcccrgggccacccagcttagctgtgcctgcctccctctgcgctaaaggagccactgtgccagcctggaactcacggcatcccctttaggatgttggctccacag

SEQ ID NO: 63404 - DNA, 201 bp, Homo sapiens
ctcaggcagaccacggtggtcagaagttgaattcaggccggaggaggaggagtgcatgaagccctgaggtgggagtgagtctgtctgctgggttcacagaccccccagggagccagtgtggcaggggccagtgtgtgaggggctcagcgggggatgtggctagaaaggttgtggacccactgttgagattggactttggct

SEQ ID NO: 63405 - DNA, 201 bp, Homo sapiens
ggcggatcacttgaggccgggagttggagaccagcctggccaacatggtgaaactccgtctctactaaaaatacaaaacttagccaggcatggtggtgcaygtctgtaatcccagctatttgggaggctggggcatgagaatcgcttgaacccaggaggcggaggttgcagtgagctgagattgtgccactgtactccagc

SEQ ID NO: 63406 - DNA, 201 bp, Homo sapiens
gtgtttctggcacgcggggatggtggaggcagcaagggtaggcctgagggacgggcaggacctccccctcaccttgggctgcaccccaaccccacgcaccgggagtcagccttgccaggttgcagcacggaactgcacttcccgagcttttaggggaagaggcactcgtgaataattcagcctctttcactgagatgaaaa

SEQ ID NO: 63407 - DNA, 201 bp, Homo sapiens
tcacttgaacccaggatttcaacgctgcagtgagccctatttgtgccactgcactccagcctgggcggcagagtgagaccctgtcttaaaaaaaaaaaaaraagaagaagaagaagaatgtgacattatttggaaatagggtcattgcagatatcattaagatggggcaatggggccatacaagactagaatggaccctaa

SEQ ID NO: 63408 - DNA, 201 bp, Homo sapiens
ctgaggcaggagaattgcttgaacccaggaggtggaggttgcagtgagccaaggtcgcaccactgcactccagcctggcaacagagcaagactccgtctcaaaaaaaaaaaaaaaaaaaaagccatatctaaaaccttctccagaccttgagccctccacaggcctcgttctgtgcatgagagggcatccgcccccttcca

SEQ ID NO: 63409 - DNA, 201 bp, Homo sapiens
gtgtcttttcacacgggaaaaagtggttcagaatgcctgggcagagccggagctacagggattcctgccgctcgcgttcccaagagtgctcacaaatgcaycttgcaccctgctttcatttttaaactctgaatggctttaggaggtgctattttcatggggctggaattgcagaacacttggacactgatcacttgctga

SEQ ID NO: 63410 - DNA, 201 bp, Homo sapiens
tgaggcaggagaattgcttgaacccaggaggtggaggttgcagtgagccaaggtcgcaccactgcactccagcctggcaacagagcaagactccgtctcaaaaaaaaaaaaaaaaaaaaagccatatctaaaaccttctccagaccttgagccctccacaggcctcgttctgtgcatgagagggcatccgcccccttccac

SEQ ID NO: 63411 - DNA, 201 bp, Homo sapiens
accgtggatatttcatatgaatggaatcatacgtgttctttcatgaccgtctttaacttagcatcatgttttcaaggttcatctgtgcctgtgccagtaattttttttttttttttttgagacagagtcttgccctgtcacccaggctggagtgcagtggcatgatctcagctcactgcaacctccacctcccgagttcaa

SEQ ID NO: 63412 - DNA, 201 bp, Homo sapiens
cccatagccgccacccggtgcgcccctttcctgaaagaaaactcagcttttcttatgttctcctttagggaaaatcccagctctgcctacaggagcaataktgctggcagctggagtggttttaataggaaattgaaaaataaacctaggcaattttaaagtaccttcagtttggtgacacgttcaactgttttcaagctg

SEQ ID NO: 63413 - DNA, 201 bp, Homo sapiens
gccagtgctcacaggagcccatgaagggatcaaactatgctaggaaccctaaaatgacgtaatgcctgtcggagccaccacggtggtttcaggtctccagccctcccattgttaggtgccctttctgtggcctcacactccccattagaagcatgtgttcaagacaagctggacaataaaaatttaatagatgtaatggtt

SEQ ID NO: 63414 - DNA, 201 bp, Homo sapiens
ccacagccaagattcccaaagtcaaggcccaaagatttccaaggttcccaaagtcaaggccaggccaaggcctggttgggtccttggggcgggcagggccrgcctctcctctgctgagaatccccacttggtgtagggggagaggggaaaggggtctggcccatcgaggggccccttctgccagggccttggttgctgggg

SEQ ID NO: 63415 - DNA, 201 bp, Homo sapiens
tgagcccctgtgtctccttccaggaacatgggtgaccttcggaggccagatcaccgatgaggtaagatggggctctcccagcaccccagaacccagcacgrgctcgccagagcacatggttaagtctgccgcgtggaccagtgagcacgtgctcccgggagccagcgcagcagcctccctccctctttctgttttgtgagg

SEQ ID NO: 63416 - DNA, 201 bp, Homo sapiens
caggacgtcacacctagcccagaacagcccccctctctccatcccttctgcgatgttcactaggcattaccacatgctggtggccgctctgggtgcggggktacatccgtgaaggaaagagatgaagctccctgcccagaggagctgacctcccagcagtcttacaggatatggttacagaggtgaatctgggggagagtc

SEQ ID NO: 63417 - DNA, 201 bp, Homo sapiens
cttgaccccagtgcactcagagtcagcacctgccttcgttgcagcattgaccctctgccatcagatcccacccagggaaggaatgggctcctgtgtgggckcctggcttctgggtgagaggggaagtgtgtgttgtgtaagtgcccttctgtgtcatgcggttttgagcagttatacctcttcctgtctccgctggaagca

SEQ ID NO: 63418 - DNA, 201 bp, Homo sapiens
agctgggcttggtggcatgcacctgtagtccagctactcaggagactgaagcaggagaatctcctgaagccaggaggcaaaggttgcagcgagccaagatygtgccactgcactcccgcctgggcaacagaatgagactccatctcccaaaaaaaaaaaaataaccccagtcttggatattctggacatgtgatacccctt

SEQ ID NO: 63419 - DNA, 201 bp, Homo sapiens
aagcaggagaatctcctgaagccaggaggcaaaggttgcagcgagccaagattgtgccactgcactcccgcctgggcaacagaatgagactccatctcccaaaaaaaaaaaaataaccccagtcttggatattctggacatgtgataccccttggatgaaccttgaaccttgaggacattacactcactgaaacaagccac

SEQ ID NO: 63420 - DNA, 201 bp, Homo sapiens
gtattgtgagtgaaaaaatcaaagtgcagaaacatatgggtagtgtgccacccctcctggaagaaagatgggggataagaaaatacatgtgtctgaaatayaaaaacagaaaacggagccctgggtcccctcctctgagaagccctgccaggagcgtgagtgccctaaccacagacttagccccttcggggcccagcgcac

SEQ ID NO: 63421 - DNA, 201 bp, Homo sapiens
ctcctgggctcaagtgatcctcctgccttagcctcccaaagtgctgggattacaggcgtgagccactgtgcccagcctgatgtgttcttaatttaaaaaataataataataataataataataagtccaaatcaaacagacgggttaggttgaaaatcaaagccccccaccccctgctgctgcccccctcccctctgagcc

SEQ ID NO: 63422 - DNA, 201 bp, Homo sapiens
gagtgggtcttcagcaggggcaccctgccccatgcctctgccacagtatctgtgcaatagggacagtaagagcgcacccggcgagggtggctgggatgccygcagcgcccaggagaaggtgccacacagcccggggctcagcactcgcaggcaccggagcaaggcaccggggtgtctggctcttgctgtatctttattgtc

SEQ ID NO: 63423 - DNA, 201 bp, Homo sapiens
taggtggtctgcggcggcgccaccggttaggcctgggcggggtctgaagggtctgaacctggggttgtagaggccgccagcatgggccctgctgggcaccygggtgagccgtgagaggaggccgggtccagggtggggggcgagggggcaggcctcccctcagtagggggtgaactcagcctctggctgcagacccctcgc

SEQ ID NO: 63424 - DNA, 201 bp, Homo sapiens
attgaccccaggagagcaggactttctctgaaggccagctgtccacacacactaaggacaccctggccacagagcagcacagagggacacctgtggctgcyccctgtgccctacagcctgaggtctgagcaccgacgggataatctggcttcctgccaggttcctaacttgagcccctgtgtctccttccaggaacatggg

SEQ ID NO: 63425 - DNA, 201 bp, Homo sapiens
aatgcataaagaggggaaagagcaccctatgagaacaccttgcaagtgaaggaaaagcaaagtggtgttggagcccctcgcccccagccccccatcccctygttcctccttcctcccgtgcatggcccccacccctgggcttgcactgctgagctccgcggcggccgggggtcctcttgatctgaggatgctgtgatcccc

SEQ ID NO: 63426 - DNA, 201 bp, Homo sapiens
attacaggcataagccaccacacccagccaggcgtggcctaaaaggctgtgttcctggaggagatgttgtcctggaacagggttcagcaaaaaaaaatttytttttagacaagatctcactcagttgcctaggcgggaatgcaatagtgtgatcataggcgactgcagccttgacctgccaggctcaagcagtcttcccac

SEQ ID NO: 63427 - DNA, 201 bp, Homo sapiens
gccctgcccccatgcagctcccaggcaaggaattggcataggacactgtgccaatcagctgtccaccaagtgctgcataacaaacaactccaaaactcagygccacgcagcaatcagcatctcttccttgctcccgtgtctgcgggttgaccaggcagctcgtctaagctggcttggctgggtttgtctccaagctgcaag

SEQ ID NO: 63428 - DNA, 201 bp, Homo sapiens
gtggggctccagcccccagaggagcaggacagcatgtgctgtacacagcaagaggatttgcacttttgccttaattttattacagacggggtcaccttccyttttttttttttttttttttttttttgttttttgagatggagtctcactctgtcacccaggctggagtgcagtggcgggatctcagctcaccacaacttc

SEQ ID NO: 63429 - DNA, 201 bp, Homo sapiens
tgccaaaaccgctggtgacatcacacgcggtcggcctgttttccagggcggagacggagcggggcctgtccaggaagcacataatcgaaggtgaggacgcrctcgggcacctcagggcccccatacctgtgggatcatcctcggaggccaaagtgatggcagcacagggcccgacccccccagttaacccactgagggccc

SEQ ID NO: 63430 - DNA, 201 bp, Homo sapiens
acagagggaaccaagtggccagtggccacagtgggtctgggtttgatttttctgtttggctgtgatgagagctcggtgtcttgttttgcagggctgaagtrgtactgggaaacatcattaagaagaaaggatggaggtaacggccctgctctctgcggcctgtccctggggtgggtgcgggcgaactatcccggggtcagc

SEQ ID NO: 63431 - DNA, 201 bp, Homo sapiens
cacggcatttgctgaccctgtttttgcgtctaacattgcatcgtaaacgttttttgggaggggccagggtgccaaaaccgctggtgacatcacacgcggtyggcctgttttccagggcggagacggagcggggcctgtccaggaagcacataatcgaaggtgaggacgcgctcgggcacctcagggcccccatacctgtgg

SEQ ID NO: 63432 - DNA, 201 bp, Homo sapiens
agccaggaagtacactgcttgcaagacatcttcgcagcccctgtccctcctcccagcgtcctgcctgtatttgcagaatgtcccgaggctggccctgagcyctggctgccccccacctgcggtttccctttctctcacgacagagaccgtccgcgccatgacccacgtcatcaaccaggggatggccatgtactggggcac

SEQ ID NO: 63433 - DNA, 201 bp, Homo sapiens
agctgtgtacctatgccaggagagggggtgccagcctccctcctggaatcacacacacgggggtggcctgggaccagggactcaacacggtgcaggtggcyggcaccatgggagatggaatgttccacccgagtcctccctttgcctggtaccccaaagagcttgggctgtgcccagagtgagtcaccagagagcctggcc

SEQ ID NO: 63434 - DNA, 201 bp, Homo sapiens
gccgggaacacacagcagcacccctggtgtaggcttcagagctgtgtacctatgccaggagagggggtgccagcctccctcctggaatcacacacacgggkgtggcctgggaccagggactcaacacggtgcaggtggccggcaccatgggagatggaatgttccacccgagtcctccctttgcctggtaccccaaagagc

SEQ ID NO: 63435 - DNA, 201 bp, Homo sapiens
tgggcacaaaagaaacaaccacccaatccagggctggggaggagccctgtcagaggacagcaccagcctccccacgtggatgcccgaccagcatctgaggycagacacagccgccactggctccagggctcccccacaccactgcacccacaactcccctgtttcagaaactgaccactcacctctggaaacccaggagcc

SEQ ID NO: 63436 - DNA, 201 bp, Homo sapiens
gaaagcggatttgtgtgtcacatccccaggagaggaggttatggtctcacaagaggaaaacccagcagaatcccagagttggctggaaagtcaacaaaccrcctaaaactcacccacaaaataccgtgaccaggagtatgcatggagacagtgccgagctccgtacaggccgtctgacttcagtgagaccccctccccacc

SEQ ID NO: 63437 - DNA, 201 bp, Homo sapiens
gcggtgtgactcgggcggggcaggcagtagacggcagcggtgacactgcagtgacgctatggagcatggacactaatacgtcccactggacttctgcgtgrgccccagacaggagcttgaccagcgtcaactggacctgctgcatctgatcctctcccagagtgaggttttgaacagagatgggcagaacaccactaatca

SEQ ID NO: 63438 - DNA, 201 bp, Homo sapiens
tgtcgcagtcatggcccagtgcagcctccacctccccgggctcaagtgatcctcccactcagcctcccaagtagctgggaccacaggcatgcgccaccacrcctggctaatttttgtatttttttgtagagacggggttttaccatgttgcccagactggtctggaactcctgggctcaatctgcccacctcggcctccca

SEQ ID NO: 63439 - DNA, 201 bp, Homo sapiens
ggtcaggggagccagggggccagagaagggagtggctcagagagcttgggggcctggggttggatcccaccctgcaccttgtccacaggatcttcgcggcrtctcagcctctccggagctcactgttcccatctgtaagagggtgtgtgtgggaccgttccggcagggctatcctgagggtcagtggccccaagtctgtaa

SEQ ID NO: 63440 - DNA, 201 bp, Homo sapiens
agggtggcccaaaccttggcactccccagggagtagctgcacccagagcccaggattcaggggggctcggttgccatggcaacaaagaggcaggtgggagsggggctgggatagagggagagagacacagtctcagcagaggaggtgaggcggatactaggggcccctccacacatggtccccaccccacaccacaaaatc

SEQ ID NO: 63441 - DNA, 201 bp, Homo sapiens
ggccctgctgggcagagggcccatcccagcccgagccccgtccagtgcatcctcccaggctcgtcctgcgtgccaggctctgttctaggcactcaggatgygcccgtgaaccatcagagttgtgctcctggagagcttgctttccagcaggaacagacatgaacactaactgcacgaaacaaggaggttagaatgtgtgtc

SEQ ID NO: 63442 - DNA, 201 bp, Homo sapiens
ctggggaaggtgcagggagagaggatggaagcagagagctaggaggctattgtgagaaaccacccaagagccgctggaggctcagagcagggtgggcaccrtggaggtggggagacgggtcagattctggactaatttgcaggggaagccgcggcaggggctgaacttcaggctccagtgatgggaggattagtcaaggag

SEQ ID NO: 63443 - DNA, 201 bp, Homo sapiens
gggccgggggcagttggcactttacccccggggtgggtgagcagaggcacctctctgaaggtccccggtgcctttcggagcctccaaacacacattgactsttgggggagtgggtggggggctggccctggcgggaactgagcctggctggcagggtcctgcctgggtgctgagaactcacgtggcgtttgtttttcagga

SEQ ID NO: 63444 - DNA, 201 bp, Homo sapiens
ggaaacatcattaagaagaaaggatggaggtaacggccctgctctctgcggcctgtccctggggtgggtgcgggcgaactatcccggggtcagcctcgtcrgcctgtcgtgcagtgtcgtaaggcccgcaagtccccacatctttcttgctgggaagtggagaggaaaattcagttctccaagaggaggaggtgactctgc

SEQ ID NO: 63445 - DNA, 201 bp, Homo sapiens
gtgaaagacagcagtggctcagcccaagggtggcagccagagatgtgggtggacggctggatattggcagccatactcattatcaatgctgctgtaacagytcatcacaaaccctgcagcttccaactgcccagagtgagatctcctggttcttgtgggtcaggcattggggcagagcagggctgggtctgctgttttggg

SEQ ID NO: 63446 - DNA, 201 bp, Homo sapiens
cgtgcccagcactgcagggcttcctagaccccctcagacccccagaccaagatgctgggtctctcggcccagtcagaggcaaggcagacccatcaggggcycctgtggtgggtgtttctccctcaccttgggtctcgccgccacagcctggtgcctgaggaatgagggagtcagctccgtgctcctgggggcctccaatgc

SEQ ID NO: 63447 - DNA, 201 bp, Homo sapiens
actatgtggatggactgtcacttaggtaaccagtttccctactgatggacatttacattgcttttagtttccaagaatgtgcattcatcatttcagctatwtttcagtggttcttcacatagaaactttgaaactcccctgtcccaactaagcctatttccccaggccactctcctccgcaacctgcttaaatgcattctg

SEQ ID NO: 63448 - DNA, 201 bp, Homo sapiens
cctgtggtcacaagttccttcccgccctgcctgctggcccctggtggtggatttttctttccacagcatttatcataattggtgtcttatcccacgccccmcaacagactgtcttctggctgcgtcaccaactcccacccagttgtccaaagcctcatctcatgcagcccacagcagcctggtacaacaggcctctgccca

SEQ ID NO: 63449 - DNA, 201 bp, Homo sapiens
ccacacccaacttcagagccaggaagtacactgcttgcaagacatcttcgcagcccctgtccctcctcccagcgtcctgcctgtatttgcagaatgtcccraggctggccctgagccctggctgccccccacctgcggtttccctttctctcacgacagagaccgtccgcgccatgacccacgtcatcaaccaggggatgg

SEQ ID NO: 63450 - DNA, 201 bp, Homo sapiens
tctccgaagagatgaaatttgagcaggaaccccaaggaacagcatcccaggtagagggatctgagtctgcaaaggccctgggcacaaaagaaacaaccacscaatccagggctggggaggagccctgtcagaggacagcaccagcctccccacgtggatgcccgaccagcatctgaggccagacacagccgccactggctc

SEQ ID NO: 63451 - DNA, 201 bp, Homo sapiens
aggtaacggccctgctctctgcggcctgtccctggggtgggtgcgggcgaactatcccggggtcagcctcgtcggcctgtcgtgcagtgtcgtaaggcccrcaagtccccacatctttcttgctgggaagtggagaggaaaattcagttctccaagaggaggaggtgactctgcttgagaaagaagttgaagggaggccga

SEQ ID NO: 63452 - DNA, 201 bp, Homo sapiens
taggcgcttggcagaagacacacttgtgacgctcagagctctctggagcagcctctccgaagagatgaaatttgagcaggaaccccaaggaacagcatccsaggtagagggatctgagtctgcaaaggccctgggcacaaaagaaacaaccacccaatccagggctggggaggagccctgtcagaggacagcaccagcctc

SEQ ID NO: 63453 - DNA, 201 bp, Homo sapiens
gggaaacatcattaagaagaaaggatggaggtaacggccctgctctctgcggcctgtccctggggtgggtgcgggcgaactatcccggggtcagcctcgtyggcctgtcgtgcagtgtcgtaaggcccgcaagtccccacatctttcttgctgggaagtggagaggaaaattcagttctccaagaggaggaggtgactctg

SEQ ID NO: 63454 - DNA, 201 bp, Homo sapiens
tcaggtgaacagtcacacaggctggggtaggcgcttggcagaagacacacttgtgacgctcagagctctctggagcagcctctccgaagagatgaaatttkagcaggaaccccaaggaacagcatcccaggtagagggatctgagtctgcaaaggccctgggcacaaaagaaacaaccacccaatccagggctggggagga

SEQ ID NO: 63455 - DNA, 201 bp, Homo sapiens
ggggtgggccgccccatcttccccttagctgatgggcaggctggatgggcagggagggtctttcctgggaaggtagtggcccgggagctgggctggccctygagtgttgaagatttaacttgaaagccatgagggcgctcttccccagaaatcatcgtggaagcggcgaatgagtggcaggaggtgcatggagagtcctgg

SEQ ID NO: 63456 - DNA, 201 bp, Homo sapiens
catgggctgagaaatgctcctggtatcaacagaactgcagcagatgatgaaaacaaggctgtgatcagggaagtggctgagggagtgaggcccccgaaccrccaccccagagctctgtcccaggcccctggggtctcatgctgtgacctcctgcgccacatggggagaggtcacctgggggacttgtttccgtgggaacct

SEQ ID NO: 63457 - DNA, 201 bp, Homo sapiens
tccctcgttcgtttgaaggactcctttctttgggctgttgggctgagggctcagcttctcgccagctgtcggcccgaggctgccctcagttcctgccccargggcctctccaacaccacagcttgcttcatcagagccaggagggacagtctctagcaagacagaagtgacagtcttgccattacctttgccgtgttctgc

SEQ ID NO: 63458 - DNA, 201 bp, Homo sapiens
tctttccacgacctggttcctggatgtcctgcttgctccacacccatctacagggaggatgtgagggggctctgcctcctagggccaggtcccccctctcrggagggggtattgggtaggaccatccaagaaagggcagaagaccaagggcagtcggggtctagaaaggagggcgctggccctgctgggcgcttcggagcc

SEQ ID NO: 63459 - DNA, 201 bp, Homo sapiens
agagcagctcatgaccttggcctatgataatggcatcaacctcttcgatacagcagaagtctacgcagccggcaagtacgtgtcttttcacacgggaaaamgtggttcagaatgcctgggcagagccggagctacagggattcctgccgctcgcgttcccaagagtgctcacaaatgcaccttgcaccctgctttcatttt

SEQ ID NO: 63460 - DNA, 201 bp, Homo sapiens
gcagaaaccatcccagcacgtccccatcaggtgttcccaggtggcaggcagagaaggccaaggtcccttgagtggatttccaggggagctgaagggctacrgccctgccaggactgggaggtactgggaggggctggacagctgagagcggctgcccccctgcaggaagaggaggcaggcgcttcacccgactctggacga

SEQ ID NO: 63461 - DNA, 201 bp, Homo sapiens
attttttttttccctgcgccagtcagcaaatgctttgtaggtgctagtcaacacctgggggctgagccaggcactggagttggggggtgtcgtgaaaaagygtgaaacccttttcgtgtgtttcttggttgagaaccgtcttgggtctggatttggagcctggatgggaagcagtgtgcacagaagccattgcacccggga

SEQ ID NO: 63462 - DNA, 201 bp, Homo sapiens
gctgaagtggtactgggaaacatcattaagaagaaaggatggaggtaacggccctgctctctgcggcctgtccctggggtgggtgcgggcgaactatcccrgggtcagcctcgtcggcctgtcgtgcagtgtcgtaaggcccgcaagtccccacatctttcttgctgggaagtggagaggaaaattcagttctccaagagg

SEQ ID NO: 63463 - DNA, 201 bp, Homo sapiens
ctccatgtatccagaatcaacgacgggctccccggctcggctctcgctgcggcagacgggctcccccgggatgatctacaggtgaccccctgccccctcayccaggccccctcccagggtcagtcctgcttcgaggacgggttcccaaggccactgtcctcccctctggaggtggaagggcccaagcagggcccacaggct

SEQ ID NO: 63464 - DNA, 201 bp, Homo sapiens
ttgaccaggcagctcgtctaagctggcttggctgggtttgtctccaagctgcaagttggatccccatgtcctccatcttcccatgcttaactggggcctaycccaggcatgtccttcccatggcaaaagtaccagaggaaaagcagaaacatgcagggtctcttacggcctatggttggggtcagagcgctgtcacctctg

SEQ ID NO: 63465 - DNA, 201 bp, Homo sapiens
caactccaaaactcagtgccacgcagcaatcagcatctcttccttgctcccgtgtctgcgggttgaccaggcagctcgtctaagctggcttggctgggttygtctccaagctgcaagttggatccccatgtcctccatcttcccatgcttaactggggcctaccccaggcatgtccttcccatggcaaaagtaccagagga

SEQ ID NO: 63466 - DNA, 201 bp, Homo sapiens
cctggatgtccctggacccccgccatccaatgtccagcttcagcgtaggacttggtgtccgcaagaatgaggcccacatccaggagcaggccagtttcacrtgaagcccagggctgaagccagaggccacgcagcaccacgtcggacagtgtttatctgtgctaatcatgaagtaacacaagtgaggtttaaaaatactac

SEQ ID NO: 63467 - DNA, 201 bp, Homo sapiens
gggtctctgccccgtggccaccgggtggcgctgctgcagagcacttggcaccggctgcgcttcctcagagactgccctgagcaggcgactggtgggggccygggggcatgggacattggtggttctttctgacctgcacctgctggggttgatgccaactgtggactctctctcttctctccctttctcctttttctcttt

SEQ ID NO: 63468 - DNA, 201 bp, Homo sapiens
gaccagggcgacatgtggggatctgacagagtgggcttgggcctttggggacaaaccatttcaattgccaaggccttcgcagctagtcacccgcagccagrcacctccagactctacgtgctctcccagcctcccacttcatttaccttccacactgcgactggggcactgatttcctgtcccccaccttcccccatggca

SEQ ID NO: 63469 - DNA, 201 bp, Homo sapiens
tcgggccgcagcacatccctcgagagcagcatggtaggggcttccctgttgacacccagggccattttttttttccctgcgccagtcagcaaatgctttgkaggtgctagtcaacacctgggggctgagccaggcactggagttggggggtgtcgtgaaaaagtgtgaaacccttttcgtgtgtttcttggttgagaaccg

SEQ ID NO: 63470 - DNA, 201 bp, Homo sapiens
cccctgggcggtctcttctgcaccatgtgggcagcagaaactacacctacggtttcagaacaacagttggggtggtgtggaaggacctccacgacatatarggtgggagtgtggagtgatggagtgtggaaacccttctcacagttgtcacctgctctccagcccctcctgagcccgtggacctgcctgcctgccgtgtgt

SEQ ID NO: 63471 - DNA, 201 bp, Homo sapiens
caccaggtccgtggtgggatgaaggaaaggagggaccctccccacactggaactacactcatgacctcagttcgcctccggcacttgtaaacaaccctgtragggaggctggatagggaaactgaggcacagagcagcagtgaaactgatcctggcctcccagctagtgaggaaaccttgattctgttcctgccctgccag

SEQ ID NO: 63472 - DNA, 201 bp, Homo sapiens
gaggagccgcaagcgcaagcatccgcagacagtgtgagctcagcgtgctgggaaggcgggggcctgggtcaagggccaggcggcagagcataggggcctgrgggggcagtgcctaggagtgggaggaaagagcatgggaccagattcactttggaaatagaagcccccaaccagcagccagccaggtggaggaaggcgtgc

SEQ ID NO: 63473 - DNA, 201 bp, Homo sapiens
ggtgggccagctgctgccaaggaggcagcctctgttgagaggggaagcagagctgggctcccaggagcagcgagggggcgcaggaccccagattcagcacyaccagcttccaagcactcgccaaccaacttatacccatctgactgaggcagaaacactgaaagtcaaagtggcttccctaaggcctccaagctactaggc

SEQ ID NO: 63474 - DNA, 201 bp, Homo sapiens
gaggcgtccagggaagacctccatgagaaggtgaccttggcataaagaggcaaacgtgggagcatgctcaggcagaccacggtggtcagaagttgaattcrggccggaggaggaggagtgcatgaagccctgaggtgggagtgagtctgtctgctgggttcacagaccccccagggagccagtgtggcaggggccagtgtg

SEQ ID NO: 63475 - DNA, 201 bp, Homo sapiens
gagacgagtaggtggaggagaaggcgtgtgagcaggtgacaggcgctggggagaaacagcccaggggagggaccagggagtgtgggggagacggggactgygatgaaagggaggcgtccagggaagacctccatgagaaggtgaccttggcataaagaggcaaacgtgggagcatgctcaggcagaccacggtggtcagaa

SEQ ID NO: 63476 - DNA, 201 bp, Homo sapiens
tccggagaaagctgcccttgttccacgtgcgagccctgtccccagcgccatgggctgtgctacctgcagtaacgcagactgcgagccccggctgcctctcyagtgctctctctcctctggccttcagcaggctgggtcacagaggtatccatccactcattcattcactcaacaaatatctgttccatgtctactaggtgc

SEQ ID NO: 63477 - DNA, 201 bp, Homo sapiens
ccaggctttgcagaccacgcggggcagggctccactgaagccacccccacccctcgccagctagctccatagggaagcctgtgtctcctgcccccagggcrcaccctcagtgcaggcacctctgttcccgctttgcccctggaggagccactattccagaaggctccaccctgccgtcctgcgggagcctgctgtccagtc

SEQ ID NO: 63478 - DNA, 201 bp, Homo sapiens
cctctccatcagggagcagcgggctcccccatgcctcctccagccacctcttagacaaagcccgtgcccagcactgcagggcttcctagaccccctcagayccccagaccaagatgctgggtctctcggcccagtcagaggcaaggcagacccatcaggggcccctgtggtgggtgtttctccctcaccttgggtctcgcc

SEQ ID NO: 63479 - DNA, 201 bp, Homo sapiens
tctgctcatcctccaagaccacccagctttctcccagccacagccaagattcccaaagtcaaggcccaaagatttccaaggttcccaaagtcaaggccagrccaaggcctggttgggtccttggggcgggcagggccggcctctcctctgctgagaatccccacttggtgtagggggagaggggaaaggggtctggcccat

SEQ ID NO: 63480 - DNA, 201 bp, Homo sapiens
tggaagagcctggccccacctcctccccaggccaggcccgtcttgttggtgggattctgatttgttgttgttcttgcacgcaggtccttccgaaactgtcrtcttccattatccacgagattgatagtattttgggcaataaaccctacagcaaaaaggactacagatcctaagccgcccccgcccgcctgctcggacagt

SEQ ID NO: 63481 - DNA, 201 bp, Homo sapiens
aaacagagcgtgacttgatgaataatttacctttgaaaaaagatacttgtcccggcgcggtggctcacgcctggaatcccagcactttgggaggccacagygggcggatcactcgagatgaggagttcgagaccagcctggccaacatagtgaaaccccgtctctactaaaaatacaaaaattagccgggcgtggtggcag

SEQ ID NO: 63482 - DNA, 201 bp, Homo sapiens
caaaacagagcgtgacttgatgaataatttacctttgaaaaaagatacttgtcccggcgcggtggctcacgcctggaatcccagcactttgggaggccacrgtgggcggatcactcgagatgaggagttcgagaccagcctggccaacatagtgaaaccccgtctctactaaaaatacaaaaattagccgggcgtggtggc

SEQ ID NO: 63483 - DNA, 201 bp, Homo sapiens
gtggcagctgggcaggagaggagacagggagaggcacggggcccctggcccagggatggattggatgtgggaggcgggacgtgggaggaagggaggagtcrgggtgactcccgggagtgggactgacacctgggagggtggggagctcgttactcatctggggccaccctgggaagaactgggctgggggtgagggcagtc

SEQ ID NO: 63484 - DNA, 201 bp, Homo sapiens
gctttccagacagatgagcccagcggaggggtctgaggtcaaaaagcccagtgcagatgccaagccgagaggcacctcccgtcccgagccccccacctctycgctgcctgctttggcctgggttatgctgccctgaagaatgtgtgggaggcagctccgtgcagcctccgtggatgaggccgggcacaccccatgtcacag

SEQ ID NO: 63485 - DNA, 201 bp, Homo sapiens
gccggacagtgagtgcacggccaaccccggcatcctgttcctcccactttatacatcgcagcccctgtggccctgccagtttctcctgagcgaggatgacraccttgcaggcctttggggaaccacgtctgccggtttcccaacactggagggagtgggggcggccaaatgctcctggggcatcctgaccccctccttgtg

SEQ ID NO: 63486 - DNA, 201 bp, Homo sapiens
gtctctgagtccagagccttgattgcgtccagaaccatcctccaggcataaaggaagtctccacaacacgtggtctacagaagctggaaaagctaaattargtctctggttcccaggtttcctgggaaagttttcccaaaacaggaaccgaactggggacaactctgcttttcagtgacctgaaactggagtgcaggccac

SEQ ID NO: 63487 - DNA, 201 bp, Homo sapiens
ttaaacctaccgtggttcctcagctaactgcattccctacccaggcagagactgtcctatgcctcgagcttccaaacgagactcagaccgcgacacagccmccgtatttatggaatgacaaaataaataaagcccaaacccatcggtctctgtgactttttgctcctctcatttcctcagggtcagggctgggccagggtg

SEQ ID NO: 63488 - DNA, 201 bp, Homo sapiens
aggcatcccagcccccatccccttctgcaaggctgtgtgaggacatcctgcctcccgtgggccatgtttgcttatgcagcatccatgggagggctccctgsggacgggctgtggtgatgactctgctctcagcagaaccctccactctgaagccctggtttcctgtccacgtccctcagctactcaggggagcctgggggc

SEQ ID NO: 63489 - DNA, 201 bp, Homo sapiens
gctgccgggccagacgcaggggctgggagaaagccagctggcaggcccagtgctctccttgagggcctgcccaggaccacggctggcagctgtgtggggcytgggtcggggctgggagggcttctgctggcagcgggcaccacattggagcctcggtggtcatggtcatcccaggcctggaaacagcatccgtctgcagcc

SEQ ID NO: 63490 - DNA, 201 bp, Homo sapiens
agacgtgtgctccccaccccacacgcagcagccatgcttacaaagcgttcagcctggaggcgccctgtcccttcgcatcccttctcccgaggcctggcagyggatggcagaaccaataccatcattttcacagggaaacaagttgagcagggtaattgcggcatcacgtggtgccctagttttgttaaattagtcctgtgg

SEQ ID NO: 63491 - DNA, 201 bp, Homo sapiens
taacacttattatctcacctaatcctctatcaacccagggaggcaggtgctattcccagttcagggaagctgagcctctggctataaacaggtgcaggggyctcacctggcctctggccacagggggttccacctggtgctctttgcctcaacgcttgcggccagtgctcagctgtggggtaaccgtactggggtagggac

SEQ ID NO: 63492 - DNA, 201 bp, Homo sapiens
tctcacctaatcctctatcaacccagggaggcaggtgctattcccagttcagggaagctgagcctctggctataaacaggtgcaggggcctcacctggcckctggccacagggggttccacctggtgctctttgcctcaacgcttgcggccagtgctcagctgtggggtaaccgtactggggtagggacagattccttgtc

SEQ ID NO: 63493 - DNA, 201 bp, Homo sapiens
gtggagctgatgggagggacctagcctgtgggctccctgcttggaccctgggccctgcaccccgtcagctgctaggctcccctcttgggtctggtgtgttkgtttctgaagcctgttctcccaagtcccggaggtgtcagggatcccggggccacccagcttagctgtgcctgcctccctctgcgctaaaggagccactgt

SEQ ID NO: 63494 - DNA, 201 bp, Homo sapiens
aattggtgtatgattgcgatcaagagtatatgggtatttattgctattctaattatttccacttttatgaggtttgaaagttttcaaagtagtgagttggyaggaagaaagaaaatgcccaaagagggagcctaccgaccttcctgggtcccctgtccttgtcagccaaccacgtaaagggaaagagctaggatttaatga

SEQ ID NO: 63495 - DNA, 201 bp, Homo sapiens
gaattagctgggcatggtggcacgcgcctgtagtcccagctacttgggaggctgaggcaggagaatcacttgaacccaggaggcagaggttgcagtgagcyaagatcatgccactgcagtccagcctggcaacagactgagactctgttaaaaaaaaaaaagagagagagagagaaagcaagcaagaaagaaagagaaaga

SEQ ID NO: 63496 - DNA, 201 bp, Homo sapiens
aaatagccaggctgggtggcacacatctctgatcccagctaattgggaggctgaggtggaaggatcccttgagccccataggtcagggctgcagtgagccrtgatcatgccactgcactccagcctggggaacaaagcaagaccctgtctcaaaaaaagaaagaaagagagaggggcatggggcagcgtggagaggaaact

SEQ ID NO: 63497 - DNA, 201 bp, Homo sapiens
tgcctgaggaatgagggagtcagctccgtgctcctgggggcctccaatgcggaccagctcatggagaacattggggcaatacaggtaagagtgagaggccytgctgggcagagggcccatcccagcccgagccccgtccagtgcatcctcccaggctcgtcctgcgtgccaggctctgttctaggcactcaggatgcgccc

SEQ ID NO: 63498 - DNA, 201 bp, Homo sapiens
cagggcttcctagaccccctcagacccccagaccaagatgctgggtctctcggcccagtcagaggcaaggcagacccatcaggggcccctgtggtgggtgyttctccctcaccttgggtctcgccgccacagcctggtgcctgaggaatgagggagtcagctccgtgctcctgggggcctccaatgcggaccagctcatgg

SEQ ID NO: 63499 - DNA, 201 bp, Homo sapiens
ccgtgcccagcactgcagggcttcctagaccccctcagacccccagaccaagatgctgggtctctcggcccagtcagaggcaaggcagacccatcaggggyccctgtggtgggtgtttctccctcaccttgggtctcgccgccacagcctggtgcctgaggaatgagggagtcagctccgtgctcctgggggcctccaatg

SEQ ID NO: 63500 - DNA, 201 bp, Homo sapiens
aggtcatagaccagcacatggcagagccagtgccaactccaaagcccagatccgaaccactgagtgggcctaacctccttcccaggaacccagactgatcrcctcaggtcacccaaaggggatggaatagtgtcatcaaccagctcccaaagaagatcagagcatgtgcagtcagcactggcaagatttcagcttagagag

SEQ ID NO: 63501 - DNA, 201 bp, Homo sapiens
ctgatcagaacctccagccctttgcttcattattggactcctactaagcatttataatttcttaccacagttactttctagccagcatgggggaaattacstaaacttctaaactgaccaggcttatgtggaatgtattagtggtacagttgggctgttctccccagcagccacagacacgagttattctgggttggaaca

SEQ ID NO: 63502 - DNA, 201 bp, Homo sapiens
caggccatcgccgagcgcctgggctgcaccctgccccagctggccataggtaacggtggggtcgccatggggccagtgcccctggggagaacctgccccarctggccgtaggtaacagggtggggttgccatggggccagtgtctccggggagagagggaagggatccctggacatcatcccccagccagcctcgggtaat

SEQ ID NO: 63503 - DNA, 201 bp, Homo sapiens
gaaagtggaaaagacagagaagcctcctgacagccaaggagaccagcagccagtagagcaggtgttgtaacaaggccgaggaccctcagacaccaattttkctggtaagaccgctgcccaggatgcaccgtacaagagcagcttcacctgccttcatgcagatggcacagatgtccaggaagcagctgtggtcagtgactc

SEQ ID NO: 63504 - DNA, 201 bp, Homo sapiens
gaagctatgagtgtgagcagtggggagcccgggctgcagctgctgggccagcctgctccggggacaccttggtgccctctccatggctgccccggcagccycccgcctgctcacaggcaagggccctcggggtccctttctgccttcacaggaggcctactccgtggcccggcagttcaacctgaccccgcccatctgcga

SEQ ID NO: 63505 - DNA, 201 bp, Homo sapiens
gaagagcagtcacagcggccctgcgcagccccccaggccatcacctccggctccacaagtgacaccagagagagccctcccttctccagtccaaggaaggygggtgtgctcatcacccgtcactcatcatcaggagtaactcacagcccagccctgcccaacacttttggagactgttgggctgaggacttgggcagccag

SEQ ID NO: 63506 - DNA, 201 bp, Homo sapiens
tctgaaatttgaaatttcgacgccaagttctgtttttaaaatcacaatatccccatgaggctgagagggagctataaccagcagattgctgtgtctcaaarccatgtttgaatattgggaagaatccactgtgtcgctggggcgagggtccctcctctcttctttaaaaggccagcgtgaagtctccgcgatttcatcctc

SEQ ID NO: 63507 - DNA, 201 bp, Homo sapiens
acgtgaattcccctgggcccctgatctacaggaatagatttgcaccaggcaggcccagcccaggaaagaacttgtgggttccacgtaattagcaatggctrttgaggaggggctcgtttttcttggtaccagggtggtgagggagtgtcagggctcagagaccctcactctggaaagcggccgggatttgggatattttga

SEQ ID NO: 63508 - DNA, 201 bp, Homo sapiens
atccggaattagaccctccgtgtttttgcaaagcagaagaccttaaaaaagagccagcctgaggtaaacttggaatgaccgtgatggatggggtggtgggsggcaggtttcagccgggcagcacctctcgcttgagtctgctcacagcccagacctgcccaaggctgactgttttcccatctgccggagacacgggcgtct

SEQ ID NO: 63509 - DNA, 201 bp, Homo sapiens
aaatcaaagccccccaccccctgctgctgcccccctcccctctgagccctgtgaccaggcctctccctgggcctctgggagttcagccctgtagcctcggstccctacccccaaagtggaatccgactccacacggcatttgctgaccctgtttttgcgtctaacattgcatcgtaaacgttttttgggaggggccagggt

SEQ ID NO: 63510 - DNA, 201 bp, Homo sapiens
gctcccgggaggatccggggacaggatgcctggggactgcctggcctgctgcaaccctgcaggctcctaggcaacctgtgccaggacatacgggcatgccrgtcctcagcagagggctgccaccctccttcacctcctaaggacagtcatgatggcccaaggcctgttcctgtggaccctgggatgcaccacagtgggcag

SEQ ID NO: 63511 - DNA, 201 bp, Homo sapiens
gcacaggccatgtggtccagtgaagtgggacgatctcctgccccagtcgctggagacaggaagaagagacacaaaatcacaaatgcagccttagagaggarggaagaaggggcttctctgcaaggggcgccgcatggatggtgccatgggggtgagaccagtccagtttcgccataaaacagacagcgtccctgtgcattt

SEQ ID NO: 63512 - DNA, 201 bp, Homo sapiens
cgcgagggcacctcctgccgcgtgggctcctcctgccgcgtagggctcctcctgccgcgtagggctcccgggaggatccggggacaggatgcctggggacygcctggcctgctgcaaccctgcaggctcctaggcaacctgtgccaggacatacgggcatgccggtcctcagcagagggctgccaccctccttcacctcct

SEQ ID NO: 63513 - DNA, 201 bp, Homo sapiens
tggtgtcggccggggagcagcagggacccctgagccccacagtcggggctcatggcgctgagaagcactgcagcaagggcgcagccagtaggagaggagcygcaagcgcaagcatccgcagacagtgtgagctcagcgtgctgggaaggcgggggcctgggtcaagggccaggcggcagagcataggggcctgagggggca

SEQ ID NO: 63514 - DNA, 201 bp, Homo sapiens
agggacttctgagtgagacgggagccgtggcaaaattgtgggcagaggagggcgagctgcagctcagcctggaaagggaggctgctctccggctgctccaycggggaggctttgggaagcaaaagtcgaagcagagagccctggtgggaagtggcagctgcgggtccgagacgggagtggtggttggatcctggatgtttg

SEQ ID NO: 63515 - DNA, 201 bp, Homo sapiens
ggcgccctgtcccttcgcatcccttctcccgaggcctggcagcggatggcagaaccaataccatcattttcacagggaaacaagttgagcagggtaattgyggcatcacgtggtgccctagttttgttaaattagtcctgtgggtggtgggtggaagagcggctgaacccagagcccactcggggaagtgggcccatttcc

SEQ ID NO: 63516 - DNA, 201 bp, Homo sapiens
agccatgcttacaaagcgttcagcctggaggcgccctgtcccttcgcatcccttctcccgaggcctggcagcggatggcagaaccaataccatcattttcrcagggaaacaagttgagcagggtaattgcggcatcacgtggtgccctagttttgttaaattagtcctgtgggtggtgggtggaagagcggctgaacccag

SEQ ID NO: 63517 - DNA, 201 bp, Homo sapiens
tccccagaaatcatcgtggaagcggcgaatgagtggcaggaggtgcatggagagtcctggctctgcaggcgagcagcctgccccagctctttcctccttaraattgtgtgactttagccacatcatttagaagacacagatgatagaggtggtagaaatggaaagtgcaactctctacctgctgttgcccaccaccaggac

SEQ ID NO: 63518 - DNA, 201 bp, Homo sapiens
ctggccctcgagtgttgaagatttaacttgaaagccatgagggcgctcttccccagaaatcatcgtggaagcggcgaatgagtggcaggaggtgcatggasagtcctggctctgcaggcgagcagcctgccccagctctttcctccttagaattgtgtgactttagccacatcatttagaagacacagatgatagaggtgg

SEQ ID NO: 63519 - DNA, 201 bp, Homo sapiens
cctgcgccacatggggagaggtcacctgggggacttgtttccgtgggaacctcaggccttgggcctgagtgaggagatgtctgaagcctctggcctgggcsgagagtgagaccccagagcagccctgcccattcctctgggagcagcctcagtgaaagctgtaaagcagggaaattggacacgtccaggccagaaagagca

SEQ ID NO: 63520 - DNA, 201 bp, Homo sapiens
cggctccatccgtggggagccgcgccacctctgcgcctcctccgcgcctcctctgcgccccgcgccgtgctgagtcaggctctgaaacgcagtcatcatcsggaagtggttcttgctgtggccccatccccctgtgtgattttcctaccttggctcacttaaaatttcaatctggctctgagaggagactcagcatttcct

SEQ ID NO: 63521 - DNA, 201 bp, Homo sapiens
caggagattggaggagagactgaggtttctctgtgacaaacacagggaatcctgactgggatctccaatctctagtaaggtttgcacagttcttctcctcrcatttctttggctgcatctgagccaaagtctggatggagctgtcggggaactgggttatgttgacctcccaacccctgcccaccctctggggtgtccttc

SEQ ID NO: 63522 - DNA, 201 bp, Homo sapiens
tacattcccaccaacagtgcacagggtccccatttctccacatcttgccaacccttattattctgggcttttttatagcggccatcctaatggctgcgagrtagtatctcactgtggttttgatttgcatttccctaatggttactgacgttgagcaccttttaatgtgtttattagccatttgtgtcttgtctttggaga

SEQ ID NO: 63523 - DNA, 201 bp, Homo sapiens
attttacattcccaccaacagtgcacagggtccccatttctccacatcttgccaacccttattattctgggcttttttatagcggccatcctaatggctgygaggtagtatctcactgtggttttgatttgcatttccctaatggttactgacgttgagcaccttttaatgtgtttattagccatttgtgtcttgtctttg

SEQ ID NO: 63524 - DNA, 201 bp, Homo sapiens
gagtgtatagttcagtggtattgagtgtacagttcagtggtactgagtgtatggctcagtggtattgagtgtacagttcattggtattgagtgtacagttyggtggtattaaggatacagctagttggtattgagggtacagctcagtggtattgagtgtataattcagtggtatcgagtgtgtaattcagtggcattgag

SEQ ID NO: 63525 - DNA, 201 bp, Homo sapiens
agctatgcctggtgcctgtccctgttaagggacgtcaaatccagaaaagaagctgtggccgagtttgccttttacaaaaacctcgcttaactttccttttwactcacatggattattttttcctggtcactatggtaacatcataaaaattatagagaaaacagaaaatttgtgaactgcccaaacccccaaagcactcca

SEQ ID NO: 63526 - DNA, 201 bp, Homo sapiens
agttcagtggtattgagtgtatagttcagtggtattgagtgtacagttcagtggtactgagtgtatggctcagtggtattgagtgtacagttcattggtaytgagtgtacagttcggtggtattaaggatacagctagttggtattgagggtacagctcagtggtattgagtgtataattcagtggtatcgagtgtgtaat

SEQ ID NO: 63527 - DNA, 201 bp, Homo sapiens
atctcctccggactccggtcacactaggccccccactgtccaactcccactgcctgactcacagttactgcctcggtggctgcctcctggctccatgaggmgcccacgcaccccggctgggcacgtggtacacatcatatgatggagaagtgcccatttcatgccccaggctcctgggtgggagggctttcaggacctctg

SEQ ID NO: 63528 - DNA, 201 bp, Homo sapiens
aggtaacggtggggtcgccatggggccagtgcccctggggagaacctgccccagctggccgtaggtaacagggtggggttgccatggggccagtgtctccrgggagagagggaagggatccctggacatcatcccccagccagcctcgggtaatcgggctctaaggggcatggttgggaccccatgcctctagggggatgt

SEQ ID NO: 63529 - DNA, 201 bp, Homo sapiens
gctgaagtacagtggcacaatcacagctcactgcagcctcgaccttccaggctcaagccatcctcctgcctcagcctcccaagtagcctggactgcaggtrcacatcaccatgcccagctaatttttttattttattttttgtagagacagggtttctccatgttgcccaggctggtcttaagttcctgggctcaagcgat

SEQ ID NO: 63530 - DNA, 201 bp, Homo sapiens
agtccctgagccaggcccccctcccacatcctgggcggaaggcatctcctccggactccggtcacactaggccccccactgtccaactcccactgcctgaytcacagttactgcctcggtggctgcctcctggctccatgaggagcccacgcaccccggctgggcacgtggtacacatcatatgatggagaagtgcccatt

SEQ ID NO: 63531 - DNA, 201 bp, Homo sapiens
gcaatagtgcgatctcggctcgctgcaacctctgcctcctggattcaagtgattctcttgcttcagcctcctgagtagctgggattacaagtgcccaccaycatgcctggctaatttttgtgtagagatggggtttcaccatgttggccaggctggtctcgaactcctgacctcaggtgatctgcccgcctcggcctccca

SEQ ID NO: 63532 - DNA, 201 bp, Homo sapiens
tggctcttgccacttcctctacctggatcaaatccatgcacccctcatagtccctgagccaggcccccctcccacatcctgggcggaaggcatctcctccrgactccggtcacactaggccccccactgtccaactcccactgcctgactcacagttactgcctcggtggctgcctcctggctccatgaggagcccacgca

SEQ ID NO: 63533 - DNA, 201 bp, Homo sapiens
aatttctatttttattatttatttatttttgagacggagtctcgctctgtcacccaggctggagtgcaatagtgcgatctcggctcgctgcaacctctgcytcctggattcaagtgattctcttgcttcagcctcctgagtagctgggattacaagtgcccaccaccatgcctggctaatttttgtgtagagatggggttt

SEQ ID NO: 63534 - DNA, 201 bp, Homo sapiens
cgttgcagagagcttccctgcctgcctcccacctacatctttccatcctcaactcctgccagatccccccagagcccgcccctgccccctggcccacaccsggcctcctccagccttggctcttgccacttcctctacctggatcaaatccatgcacccctcatagtccctgagccaggcccccctcccacatcctgggcg

SEQ ID NO: 63535 - DNA, 201 bp, Homo sapiens
cagtgagctgtgatcatgccactgtactccagcctgggcaacagagtaagttcccttctcctaaaaaaaattaaatgaaataaataaaactgtaaaaactrttcttagctcgagggctgcacaaacacaggtgacaggctggcgcagcagttttccaacccctgtcctacagcaaggagggaagccgtcacactgcactct

SEQ ID NO: 63536 - DNA, 201 bp, Homo sapiens
tgccaggcattttccctggtgaattttcagctgactaggaaatgggatgctcgacagcagctccttccttctgtgtgagagctggggccgccactgcttaracacgtgtctgcaggggaacatgccacagccatcctagtggggggcaataacacagctgctcccactccctcgggccaaccctgtctgtggaatgagcta

SEQ ID NO: 63537 - DNA, 201 bp, Homo sapiens
ggaggccacagtgggcggatcactcgagatgaggagttcgagaccagcctggccaacatagtgaaaccccgtctctactaaaaatacaaaaattagccggrcgtggtggcaggtgcctgtagtcccagctacttgggaggctgaggcaggagaactgcttgaacccaggaggcagaggttgcagagagccgagatctcgcc

SEQ ID NO: 63538 - DNA, 201 bp, Homo sapiens
gtcccggcgcggtggctcacgcctggaatcccagcactttgggaggccacagtgggcggatcactcgagatgaggagttcgagaccagcctggccaacatrgtgaaaccccgtctctactaaaaatacaaaaattagccgggcgtggtggcaggtgcctgtagtcccagctacttgggaggctgaggcaggagaactgctt

SEQ ID NO: 63539 - DNA, 201 bp, Homo sapiens
aaccgcctccagcccccatctgcagcccttttggccctccggatggcacagccccctcccactccctccatactggcagcagcttcccatcaaagtgaacygctttccagacagatgagcccagcggaggggtctgaggtcaaaaagcccagtgcagatgccaagccgagaggcacctcccgtcccgagccccccacctct

SEQ ID NO: 63540 - DNA, 201 bp, Homo sapiens
atgttaggctgcagctaccacccagtagtgaggcgcaggccccccgaccagggcgacatgtggggatctgacagagtgggcttgggcctttggggacaaaycatttcaattgccaaggccttcgcagctagtcacccgcagccaggcacctccagactctacgtgctctcccagcctcccacttcatttaccttccacact

SEQ ID NO: 63541 - DNA, 201 bp, Homo sapiens
ggcctatggttggggtcagagcgctgtcacctctgctcacgtgcttttggccaaagtaagtctcaggaaccagcccacagtcaaggggctggaaatatatygcccccaccagtgggaggagctataaagtcacatggcaaagggcatgggtacagagaggggtgaaggattgggagcaatacttccatgtaccccaggtct

SEQ ID NO: 63542 - DNA, 201 bp, Homo sapiens
gtggacctagatgctcagagtgatctgtgccacgccttcagtgcctcctcggaggtcctgctccttacagggagctctgaagacatggccaactcttagawcctactgaaattttggtagataagattttgcttaagatagttaaatctgaactccggcttgcaaatgctttccctggatgaaatgtttgtattgtgatgt

SEQ ID NO: 63543 - DNA, 201 bp, Homo sapiens
agaccagtccagtttcgccataaaacagacagcgtccctgtgcatttccatctgtccttgagaccactctgcagacccccactgggcaccagcagggcccrtgccagcagcatggtgtgggccgggggcagttggcactttacccccggggtgggtgagcagaggcacctctctgaaggtccccggtgcctttcggagcct

SEQ ID NO: 63544 - DNA, 201 bp, Homo sapiens
accattatttagttgactgcagagaagaaagtagaaaaaggagggcaggggggcgggggtcctgacgacagggtggtcaggaagcagaagcgagcaaggamgccacgtggtggtccagagaaagagccttcgggggccaaggggacaaccaaggcacagccctaaggccgagtgttggggagaaggggatgcaggggatag

SEQ ID NO: 63545 - DNA, 201 bp, Homo sapiens
agggtagagtgggggacatggaagctgagctgaggggtgagggtagagtggggggatgtgggagctgagctgaggggtgagggtgcagtggggggacgtgkgagctgagctgaggggtgagggtagagtggggggatgtgggagctgagctgaggggtgagggtggagtagggggacgtgtgagctgagctgaggggtggg

SEQ ID NO: 63546 - DNA, 201 bp, Homo sapiens
ttgtagggtgtggcacctgcccagccctcaggggtcctggtgcagcttagcaagctccttggccaccagtccctggtgactcagatcaggggttccaagarcatgctttgagaaacactccctagccctagccgtttcagtctgtcagtgaacctgcccacctctacttcttaaggaagcacacgaggaagctgtttgtga

SEQ ID NO: 63547 - DNA, 201 bp, Homo sapiens
ggaaggcggcgcaccgcgccgcacactcagtccaagaacccgcctcgcgtcactgtcgccgtcagggccgcggagccaatcagagcccaagtcgagggctrcgctttgcgagcgccagccaatcggtgcggcggcgggcccatcctgatttgcatgtccgacgacccctcaaccaatggtaatgtgactggcgtgaacaat

SEQ ID NO: 63548 - DNA, 201 bp, Homo sapiens
cactggtcacctctgtctccccgcccttgcccaggtggccccagctcacacctgcattgcctcggagactcctgacgacacccaccccctgctgctgcccrggcccccccagcagtcggttctcagtgatcttgagaagcaccactcagctcaccctacgaggaggcctttggctgttcccgtatttgtctctggacttct

SEQ ID NO: 63549 - DNA, 201 bp, Homo sapiens
gtctcagcctcttggattgccagccactggtcacctctgtctccccgcccttgcccaggtggccccagctcacacctgcattgcctcggagactcctgacracacccaccccctgctgctgcccgggcccccccagcagtcggttctcagtgatcttgagaagcaccactcagctcaccctacgaggaggcctttggctgt

SEQ ID NO: 63550 - DNA, 201 bp, Homo sapiens
ttgagcaggaaccccaaggaacagcatcccaggtagagggatctgagtctgcaaaggccctgggcacaaaagaaacaaccacccaatccagggctggggargagccctgtcagaggacagcaccagcctccccacgtggatgcccgaccagcatctgaggccagacacagccgccactggctccagggctcccccacacca

SEQ ID NO: 63551 - DNA, 201 bp, Homo sapiens
aactgcagcggggcccagagcacccggcggcagggaacccaactgggccctgctcaagttcccacccagagcctggggagcgcacagccctgggggctgcygctgggaccctcaaaccgcctccagcccccatctgcagcccttttggccctccggatggcacagccccctcccactccctccatactggcagcagcttcc

SEQ ID NO: 63552 - DNA, 201 bp, Homo sapiens
ccacgaagggcttttgagaaaagcatggcatgaaaagatctgctgttgagaaatagaaacggggctctggtggcaggttgacaaccatggtccaggcaggrgcttccaaggcaagtggtggaggtgggcgagagggagagttccagggatatccgcgtggatggagccaacacctggagcccagggcaggggggtgggctg

SEQ ID NO: 63553 - DNA, 201 bp, Homo sapiens
ggctgtaatcaaatcatccactctcctgcatcgggtttccagaagtcagcttttgtttgtgaaatcatttgttggccctctcttcatcctccttctgcccycctcctgcctggggccagccaagttcccgtcagccgggcaggctgcaggcctgggctgctgtgcaccatagctgcttggcccgcagctgcttcgtgggcc

SEQ ID NO: 63554 - DNA, 201 bp, Homo sapiens
tcctgggctctcctgatgtgcctgacattttgacatttcatgtctcacttgtgcaactagggctgcagggcctcagagctggggagggcaggctccggccragtgctgtggggagcacttcccatcttggcggtgaactttcctgctcaattatgtaaaagctcagccttcttcagccaggctgttggcttcaattttaaa

SEQ ID NO: 63555 - DNA, 201 bp, Homo sapiens
gagttgggggatgaggcagtggggccctgtgaggccctgcggtttctatcggagtgctctctgacccccggtgttccctctctgtctctctatgtctttascaggtgtttcccacactttagtcattggcctttcatctcatgatttgggtcatctgtgctatttcttttctttttttctttttttttttttttccgacag

SEQ ID NO: 63556 - DNA, 201 bp, Homo sapiens
gggccccacccccggctggcaggacagtgtcggttttctcgtttcagatggcagagcagctcatgaccttggcctatgataatggcatcaacctcttcgayacagcagaagtctacgcagccggcaagtacgtgtcttttcacacgggaaaaagtggttcagaatgcctgggcagagccggagctacagggattcctgccg

SEQ ID NO: 63557 - DNA, 201 bp, Homo sapiens
tgagccaagtccggttccgctgcgctgggtcccccatggcagaaaggacccgcccccccatcaccctgacagtggcttgcatgcccaagagcagccagcayccaggacaggcttccctcgttcctctgttcatcctctttaagaatcactcagagccaggcacggtggttcacgcctgtaatcccagcactttggtaggcc

SEQ ID NO: 63558 - DNA, 201 bp, Homo sapiens
ctgctgtaacaaagtaacataacctgggggcctgaaacaacagacaccgttctgtcaccttctggaggccagaggtctgataccaaggtgttggcagggcmaggttccctgtaaaggctcgggggagggtccgccccatgcctctttcagctcctgggggttgccaacagtccttggcttgtagacgtgtcactctggtct

SEQ ID NO: 63559 - DNA, 201 bp, Homo sapiens
ataacaattcagtcctcatgtgcaggtgctgggaaagattcaatgagatacaactgaatacaccgccctggctttaaggacatagactcatcccagcaacrtccacagagcccctgctggggactgccttggtttcctaggactgctgtaacaaagtaacataacctgggggcctgaaacaacagacaccgttctgtcacc

SEQ ID NO: 63560 - DNA, 201 bp, Homo sapiens
gatgtcacccaccatgcaccagctgtgggatgtcagttgctccatctacaaaaataacaattcagtcctcatgtgcaggtgctgggaaagattcaatgagrtacaactgaatacaccgccctggctttaaggacatagactcatcccagcaacatccacagagcccctgctggggactgccttggtttcctaggactgctg

SEQ ID NO: 63561 - DNA, 201 bp, Homo sapiens
ccacgaccagttctttgctcatggagcacaatcgcgtcctgacagcagccatggagcaaagtctgatgcacagcgcatttagctcgggcagtcattcatcsatcttgcccatgaggcagccaccaccacagcagtgccgctcagggccgggagtatgtgccgttggagaaacactggacaagaggccagaatggatgtcac

SEQ ID NO: 63562 - DNA, 201 bp, Homo sapiens
ctccgtcctcactctccatacctcctggccacaagggcttctgagttcagaaaggagagacgcagccctgtgaagccacccctggctggttttctgtcctrtggtttttgagggttattaagaattattcaccccacgctgggcttgttgctggtgaggcccagtgctctgagccgcacctggggaagcgtgacactcaga

SEQ ID NO: 63563 - DNA, 201 bp, Homo sapiens
ccccgggcttcctgactcaaatcacagccgctcactaaccggggctcagcttcagctgtgctgtatttcagtgtctgagatgtttggggatgagtgccagygtcgccaggctgccggccagatttccatacaccccccacccacaaacatgctgcctttctggcttctcttgagaggttggcagatctctagcaccaggtc

SEQ ID NO: 63564 - DNA, 201 bp, Homo sapiens
tgacctcgtgatccacccacctcagcctcccaaagttctgggattacaggtgtgatccaccatgcctggcccaaatgagggtctttaagaataaaactccrggggatcgtcaccaagccccaccacttcctctgaggttagcatagtgctggatcttctctgcatcttctgtccttgtttttggttttcattttggtttac

SEQ ID NO: 63565 - DNA, 201 bp, Homo sapiens
tcaaaacagagcgtgacttgatgaataatttacctttgaaaaaagatacttgtcccggcgcggtggctcacgcctggaatcccagcactttgggaggccamagtgggcggatcactcgagatgaggagttcgagaccagcctggccaacatagtgaaaccccgtctctactaaaaatacaaaaattagccgggcgtggtgg

SEQ ID NO: 63566 - DNA, 201 bp, Homo sapiens
ctcaaaacagagcgtgacttgatgaataatttacctttgaaaaaagatacttgtcccggcgcggtggctcacgcctggaatcccagcactttgggaggccrcagtgggcggatcactcgagatgaggagttcgagaccagcctggccaacatagtgaaaccccgtctctactaaaaatacaaaaattagccgggcgtggtg

SEQ ID NO: 63567 - DNA, 201 bp, Homo sapiens
gatcccaggtcccaaggagtgacaggggcttcctcccaccttctgtccttgtccagtcatgtaaataatgtgctttttctctccccgagtctttttttttwaacctaccgtggttcctcagctaactgcattccctacccaggcagagactgtcctatgcctcgagcttccaaacgagactcagaccgcgacacagccacc

SEQ ID NO: 63568 - DNA, 201 bp, Homo sapiens
gatgcacagcgcatttagctcgggcagtcattcatccatcttgcccatgaggcagccaccaccacagcagtgccgctcagggccgggagtatgtgccgttrgagaaacactggacaagaggccagaatggatgtcacccaccatgcaccagctgtgggatgtcagttgctccatctacaaaaataacaattcagtcctcat

SEQ ID NO: 63569 - DNA, 201 bp, Homo sapiens
attaagaattattcaccccacgctgggcttgttgctggtgaggcccagtgctctgagccgcacctggggaagcgtgacactcagagggaagcagccctgtycgagagccagaagctcaggggcacctttctctccggcctcttggagggagctgtcacttgcagaggggctcccctcgctccatgagtcccaccccacgac

SEQ ID NO: 63570 - DNA, 201 bp, Homo sapiens
actcctgccgccgcatagggctctgctgcgtaggactcctgcggcgagggctccctcctgccgcgtgggctcctcctgccgcgtgggctcctcctgccacrtagggcacctcctgccgcgagggcacctcctgccgcatagggcacctcctgccgcgagggcacctcctgccgcgtgggctcctcctgccgcgtagggctc

SEQ ID NO: 63571 - DNA, 201 bp, Homo sapiens
ctggaccccaagctctggacctctactacccaatttcaaaaaggtcgtagtatatagctcatgtcccagaaccagccacgtctcctcgtcgtcgtttcacygcaacctcgccagcaatgagtattttcatttaaaaatgtttttgtctgctggctatgtgattgcagaggcatggctggccccagcttgcagcggtcgctt

SEQ ID NO: 63572 - DNA, 201 bp, Homo sapiens
gacctcccggcctccccaactccccacctcctcactttcgagagcgcataaaatctgcaaatccccatttgtcagacttgggcagtttgtgctgagggccrggaggggctgtgcttagtgcttggtagatgatgagaaacagcgtggagaatccggtcagtgctaagtttctttcttcccagtttcagggggagatggtga

SEQ ID NO: 63573 - DNA, 201 bp, Homo sapiens
tggccacattataccctcccgtttgtctatagttcacttaaacattatttcctgggagatccggcagctcttcactcttccgaatcaggctgtgggaaacrtttgtgtgcatctcgctttatttcctctcttgaactattaggataaagtcacagaggtaggattcctggaccccaagctctggacctctactacccaatt

SEQ ID NO: 63574 - DNA, 201 bp, Homo sapiens
cagcagcaggtccctcgggcggcggatgcatttgatgcatggatgcatttgatacctcagggcagttgagctgcagcaggaagacaacaacagagccccgrcaggtggatcctgaaaaccgacggcctccacccccgggcttcctgactcaaatcacagccgctcactaaccggggctcagcttcagctgtgctgtatttc

SEQ ID NO: 63575 - DNA, 201 bp, Homo sapiens
tgatcaccggttgttggagtggcctggccacctgctgggctgtatgggtgctgagggcctggctgagccccgtgatacacccatgggggtgggtctctgargagcagtctgtgtgagcagcaggagaggtggcacctcaggtcaggggacgcttccccccaggctctggaggggacaggataacacctgtccccaggcttg

SEQ ID NO: 63576 - DNA, 201 bp, Homo sapiens
ggaggctgggggggcagcagcaggtccctcgggcggcggatgcatttgatgcatggatgcatttgatacctcagggcagttgagctgcagcaggaagacarcaacagagccccggcaggtggatcctgaaaaccgacggcctccacccccgggcttcctgactcaaatcacagccgctcactaaccggggctcagcttcag

SEQ ID NO: 63577 - DNA, 201 bp, Homo sapiens
gagcgtgagtgccctaaccacagacttagccccttcggggcccagcgcaccgtgccctcctgggctctctcctcctgggcctggatgtgggaggcatctgrgaaaagtcaggaggaagacgaggaggaagcagtgagcaggtgaacaagccacccgtctgtccgtgctggagccctggtgctgggaaggaaagtgctagag

SEQ ID NO: 63578 - DNA, 201 bp, Homo sapiens
tgttggttgccctgcataggttggctgcgtagtgctttacgttctgtgtaagaattgtggagtcttggggcctgggtgggccgagggtcctgagatatcgrtgtgcccagcaggcttgtagggtgtggcacctgcccagccctcaggggtcctggtgcagcttagcaagctccttggccaccagtccctggtgactcagat

SEQ ID NO: 63579 - DNA, 201 bp, Homo sapiens
ctgtttcccactcagctttgtgctcagatcccaggtcccaaggagtgacaggggcttcctcccaccttctgtccttgtccagtcatgtaaataatgtgctwtttctctccccgagtctttttttttaaacctaccgtggttcctcagctaactgcattccctacccaggcagagactgtcctatgcctcgagcttccaaac

SEQ ID NO: 63580 - DNA, 201 bp, Homo sapiens
tagagacgatttcaacggcgcattcttccatttcctgccttaatggggggcatttctggggacacccgtgaactgcgggctggggcttagccttgttggtkgccctgcataggttggctgcgtagtgctttacgttctgtgtaagaattgtggagtcttggggcctgggtgggccgagggtcctgagatatcggtgtgccc

SEQ ID NO: 63581 - DNA, 201 bp, Homo sapiens
atattttaccacaacttaaagtctctttgataaatgcagtaatgttttaattaaacaaaaagaatgaaagggatcttcatgagcaggtgtggattggtttytaggatgtattgtgagtgaaaaaatcaaagtgcagaaacatatgggtagtgtgccacccctcctggaagaaagatgggggataagaaaatacatgtgtct

SEQ ID NO: 63582 - DNA, 201 bp, Homo sapiens
gagggcacagggtggctccggggctggcgggcgtagacgaagccgctttgctgcttaaccgcaactgccagcagcaccctctttcgtccgcccctttagaracgatttcaacggcgcattcttccatttcctgccttaatggggggcatttctggggacacccgtgaactgcgggctggggcttagccttgttggttgccc

SEQ ID NO: 63583 - DNA, 201 bp, Homo sapiens
gaaccttgaggacattacactcactgaaacaagccacaaaaaggacacacggtgtgactgcatttgtctaaggtgcctagagtagttaaattcataaataycagagaatgatgggtgctggggctggaggcagggagcggggaaggggagttactgttcaatgggtacagtttcagtttaggaatatgacagggagatgga

SEQ ID NO: 63584 - DNA, 201 bp, Homo sapiens
gggaagatgaaggtcaagacagacagtagggaaccctggattcttccagagcccggggaggagaggaaaatagaggatgaggcaggtatctgctgcatccrgtgggccagctgctgccaaggaggcagcctctgttgagaggggaagcagagctgggctcccaggagcagcgagggggcgcaggaccccagattcagcacc

SEQ ID NO: 63585 - DNA, 201 bp, Homo sapiens
agcacaggtgagcgagacctcccgggagctgatgctgccgcaggctgccctccctggcccacaccagccccagggcctagagtgcccctcccccacccacyctctccttgcctgcctgacaaactcctaaacacccttcaaaacccagtctttgtcggccgcactttgggaggctgaggcgggcagatcacttgaggtcag

SEQ ID NO: 63586 - DNA, 201 bp, Homo sapiens
cagattctggactaatttgcaggggaagccgcggcaggggctgaacttcaggctccagtgatgggaggattagtcaaggagggctccccagggtttgacckgagcacaggtgagcgagacctcccgggagctgatgctgccgcaggctgccctccctggcccacaccagccccagggcctagagtgcccctcccccaccca

SEQ ID NO: 63587 - DNA, 201 bp, Homo sapiens
tgtcacctgctctccagcccctcctgagcccgtggacctgcctgcctgccgtgtgtctgtctgtcgtctgtctgtctgtctctctgctgaggggctccccratgccctgaacccagacagcctcctcagcctttgtgatcccagagtctcccggccaaacctggttgatcttttttaaccaccaccctcttcccctccctt

SEQ ID NO: 63588 - DNA, 201 bp, Homo sapiens
cagcccacactccaggacaggggctgcccaagggcaggaatcccaggagctgcggacatcagtggcatctgagaagctgcctgacttaggagctcaatggmagcaccaggaagctgcactgggctggagtcagggcaagggacagtgtcagcgatgaccctgggggacagcagtgcagtcaggagctcagaaagtacacag

SEQ ID NO: 63589 - DNA, 201 bp, Homo sapiens
gaggacagaaggaggaagagaaagagaggtgctcgcttggggctggagagttgcatgggaaacagcagcaactcagagcagagccggccatctcacagccrcgggcctctctcccctttctgggctcctagagttggaagtgagtggggccatgaggtcctggtgagcaagaggaaggaggaggaactggctttgcagacc

SEQ ID NO: 63590 - DNA, 201 bp, Homo sapiens
gcacccggaacacccccagcctctgtgagtttaggtcggaaggcgctgcgtggtcttggtcttaatctactttccaaagcacatgtctcgttcgggctgcrtcctagatggtgggaagacaggactgactggaagctggtctgaggctctctctgcagtccagatgtggatggcagggagcctctgcggtccttgggcact

SEQ ID NO: 63591 - DNA, 201 bp, Homo sapiens
tcctctgtacacgaggggcactcccatgggcactgagcagggggcagtggcagtggcaggaggcagaagggtccctgccctcctggactcaaccttcaggrgagtgaattcagcacacaggacagctagaaaggaatcagcaaggtggatgatggcgagcgccatggagacagatcacagcaggaaagaggcacatggtgt

SEQ ID NO: 63592 - DNA, 201 bp, Homo sapiens
ggggctacagcctgcccagctggccttctttctaaacacagacctcagggaagtgagggttggcccccatttgccccacaccggactggcagctagccacrtggccacctcagaagcagctgcctgccacgcgcatggagggaagggagtggccggccagtaggcagggaagggaagctggtgctgctgtctgtgggtgcc

SEQ ID NO: 63593 - DNA, 201 bp, Homo sapiens
aatcagcatctcttccttgctcccgtgtctgcgggttgaccaggcagctcgtctaagctggcttggctgggtttgtctccaagctgcaagttggatccccrtgtcctccatcttcccatgcttaactggggcctaccccaggcatgtccttcccatggcaaaagtaccagaggaaaagcagaaacatgcagggtctcttac

SEQ ID NO: 63594 - DNA, 201 bp, Homo sapiens
gtcccccctctcgggagggggtattgggtaggaccatccaagaaagggcagaagaccaagggcagtcggggtctagaaaggagggcgctggccctgctggrcgcttcggagcccccactgtttcccactcagctttgtgctcagatcccaggtcccaaggagtgacaggggcttcctcccaccttctgtccttgtccagtc

SEQ ID NO: 63595 - DNA, 201 bp, Homo sapiens
gatttcatcagtgaaacaaaacatgtacctgaactgcatcctcagagagccgggagcagcctcagtcctcagaagggaaggggtgaggtctgatgagcagrcaggaaaatcccaggtgcagacctgccagctcaaaagggctgcccacaggtacagaccatccagctccaagggcctgcccctaggaggggccaagtaaat

SEQ ID NO: 63596 - DNA, 201 bp, Homo sapiens
cacgacctggttcctggatgtcctgcttgctccacacccatctacagggaggatgtgagggggctctgcctcctagggccaggtcccccctctcgggaggrggtattgggtaggaccatccaagaaagggcagaagaccaagggcagtcggggtctagaaaggagggcgctggccctgctgggcgcttcggagcccccact

SEQ ID NO: 63597 - DNA, 201 bp, Homo sapiens
gggttgcagagccatgctctgagcatgctccccctccttcaccatgaatgtgttttcattttccacccccgggcagcttcatgatctttcattgcaatctyaggccctggtatccacaggctctcaatgcagcctaggacagaagactctagaattctgcctcggagccctgtgatcccaaacactcagccgtggcagggg

SEQ ID NO: 63598 - DNA, 201 bp, Homo sapiens
tccccaggagagagcacactgggggagatggggtggcacacctgggcttcgtcctgtcactgcccactggctcgaggctttcctgcctgcctgggcttggsagatgcgtgagactccctgtctcatgggcctgagcagatgctgggccctcttgtcctctgccacatcctggggaactcagatgaaggccagcctccctct

SEQ ID NO: 63599 - DNA, 201 bp, Homo sapiens
cgtgggaagccccacactgctctttccttggtgacgggtgacccgccatgttcaggcccctcctggtctatcttcgggtgagtctattaagggatacaccrtctccgctcagccagtcccgaggaggcaaagggaacaggaccctcttccccaggagagagcacactgggggagatggggtggcacacctgggcttcgtcc

SEQ ID NO: 63600 - DNA, 201 bp, Homo sapiens
atcccatgtactcggaaggcacatcctgatgtggcagggctgtcgtggagcctgggaggccgcatttctgatctcatgctgatgctggcccatggaccacsctttgcctggggaaggtgcagggagagaggatggaagcagagagctaggaggctattgtgagaaaccacccaagagccgctggaggctcagagcagggtg

SEQ ID NO: 63601 - DNA, 201 bp, Homo sapiens
aggccacagctgtcccactgtctgtcgtttcaggattttttctttctctgcaacttctcctccccgacaaaaaccccagcctcacccctcccctttccccmagtgccaagagtaagctcctgctctgctaaggaagccgcattcaggccccgcgttgcaggttgcagggtttggggacctacgtgtggagagtcacatctg

SEQ ID NO: 63602 - DNA, 201 bp, Homo sapiens
cttccttctgacttcagtgtctgggacccagatactggaaggaaccaaaaagtcacaacataaaggctgcgtaaactgaaccaggatgcagccacagagcrgagggctttagaagtcatgttttaggtctaggggcggtggctcatgcccgtaatcccagcactttgggagattgaggcgggtggatcacaaggataggag

SEQ ID NO: 63603 - DNA, 201 bp, Homo sapiens
agcacttccgcacctccctacctgctgctgctcccaggatgcaaagaccccactgctgcaccgcgtcctgcggcattagcagcagccggggtacctgcccrccttcccaccccgccaaccagccgcatcctggtgtccctcctcctggcatttgtcctgggggctcttacagggactgtgctttgcccgcagcatcccggg

SEQ ID NO: 63604 - DNA, 201 bp, Homo sapiens
tccctcctgccaggccttggcacaaagcacttccgcacctccctacctgctgctgctcccaggatgcaaagaccccactgctgcaccgcgtcctgcggcaktagcagcagccggggtacctgcccaccttcccaccccgccaaccagccgcatcctggtgtccctcctcctggcatttgtcctgggggctcttacagggac

SEQ ID NO: 63605 - DNA, 201 bp, Homo sapiens
tgtaatcccagctactcaggaggctgaggcaggagaattgcttgaacccagaagggggaggttgcagtgagccgagatcatatcactgcactccagcctasgccgtagagtaagactctgtctcgaaaaaaaaaaaaaaagacaatagctggttatagaatgatttgccccttgctttgaagttgctggataggcgctatc

SEQ ID NO: 63606 - DNA, 201 bp, Homo sapiens
ctgcaccagttcctcgggctgtttacagcacacacaccgccacttctgaccctgagcccctactcctatcttaagcttctccctcctgccaggccttggcrcaaagcacttccgcacctccctacctgctgctgctcccaggatgcaaagaccccactgctgcaccgcgtcctgcggcattagcagcagccggggtacctg

SEQ ID NO: 63607 - DNA, 201 bp, Homo sapiens
aggcgcctgctgcgtagggcacctgccgcttaggactcctgccaccgcgtagggctctgctgcgtaggactcctgccgccgcatagggctctgctgcgtargactcctgcggcgagggctccctcctgccgcgtgggctcctcctgccgcgtgggctcctcctgccacatagggcacctcctgccgcgagggcacctcctg

SEQ ID NO: 63608 - DNA, 201 bp, Homo sapiens
cttccgaaactgtcgtcttccattatccacgagattgatagtattttgggcaataaaccctacagcaaaaaggactacagatcctaagccgcccccgcccrcctgctcggacagtttccgttccctcctagtctctgttcgctcgcttaagctgttttgaagccaagtgaagagtgtggtttgcatccaagagaaaacacc

SEQ ID NO: 63609 - DNA, 201 bp, Homo sapiens
gggggcagggggcagggggcagggggcaaagggcaagggcagaaaggaacccacgtagccaaacggcacccagcggccccgaccccaagtgtcccgacgasgggggacgcctgcgactaacgcggggacagcccccgccgcgcgccaccgccgcaccccaggcaccgggcccccacgcagggacggcgtggaccaccctac

SEQ ID NO: 63610 - DNA, 201 bp, Homo sapiens
ctgtggccttctatcctcatggatcttcttctgtcctcgtggcagccaccgtgagaaaggcagcctcgtgagcccattctgcagatgagaacactgaggcwtcgggccactccataaaatgcccggtgtcctccagccaggaaagttgtaccaggatttgggctctggcttcagagcctcagcccatagccgccacccggt

SEQ ID NO: 63611 - DNA, 201 bp, Homo sapiens
gagctggagccggggggcggggaggaggggcggaggggcgcggccaggcggggtccgcggactccggcctgggaaggatgcgcgcggactagggcgcgggsagccaaggcccagaacatcggtaccgcgctcccttcagccgaggggctgcagagaggccagggggcagggggcagggggcagggggcagggggcaaaggg

SEQ ID NO: 63612 - DNA, 201 bp, Homo sapiens
ctggagtttcccgatggtcagcccaggcaccttgcttccctccacccgggctcagcccccatctggctcccggtgctgtgacttgtatgtggggaggatgscgaccactcatgtcaggagcagggcctccctcctcttccctgccggggcctttctccaaggctgggtgaatgtgcccaggatggaaaagggagggtccca

SEQ ID NO: 63613 - DNA, 201 bp, Homo sapiens
ttctccatgtgccaatcccccagcggataccccactctccggagggagaaccccaagcaggtgccgctgggcatgcgccagggaggctgtgaccggagcargcactgccttgcttggagctggctgcctacaagctcagacatccagcccgcagagtccaccctggctgcagcgcctgcccaggcctcaggccagtcctgg

SEQ ID NO: 63614 - DNA, 201 bp, Homo sapiens
ctcagcctcccacagtgctgggattacaggcatgagccaccacactggacacttccttctttttatggctgaataacacttcattttctggagagggctayatcctgtttctccatttgtcggttgatgggtgtttgggttgtttccagtttggggctattgtgaataaggctgctgtggacatttgtgttgaagtttttg

SEQ ID NO: 63615 - DNA, 201 bp, Homo sapiens
ccgccccgcgccctccaggcccggcccgccctccaacctctgcgtgcgcacagcctagagcccgcctccgtgaaagactgccgggcgcatgcggtcggggktgttcactggctgtccggggctccgcgcgcgtcgccggcccagctctgtcgctgacgggaggatctgaagccggccgcaggtaggctgactccagggatc

SEQ ID NO: 63616 - DNA, 201 bp, Homo sapiens
gagctttaaaaatactgatgcctgcctcctaccccacaagatcctaattcaagtggtctggggtgcagcatgggcttttgaccttttataagctctgaatrattccaatatgcagctgagtttgagaaccactgttcctagttaagccattcataggttcgtggacatgatttttttaaagctacatttgtgatttggatc

SEQ ID NO: 63617 - DNA, 201 bp, Homo sapiens
gaggctgcttcacagtgacctggcggtgtggcttagtttggtagacagcatgcccttgagtgctggcttctgagtcctgagaggcactgtcttatcacccrccaccccagagctggctttctggtctccctggatccttcacagccccagacctctgcctctcacttaggttcccaaatgggtaggtgctttggtgatgag

SEQ ID NO: 63618 - DNA, 201 bp, Homo sapiens
gtgagctcggcccagccgggacgtcaagatgctgtctccacctagtggctcatcattcattaatccagcccaagcttcctcacacagggtgggcagctggmctccaaaatgacaggcctgttatgcaggcacttatcaggcctgctgatgtcccgttggccaaaacaagtcacgtggccaagccccgagccggcaggggag

SEQ ID NO: 63619 - DNA, 201 bp, Homo sapiens
ttatgggtgattttaagcaatttacttagcctttatgggcctccgttttttctgtaaaatgggagtaataaaggtacgtacttcacatgattaagggagayaatgtatgtaaatagtctctagtagtgcctggaaaatagggaaatgctcagataatatcagctcttcgcctagctgtgtattactatgtgacagacctcc

SEQ ID NO: 63620 - DNA, 201 bp, Homo sapiens
aagggcaggcctgggttcctagcacctcatggtgtgccgtaagggagctgccttgcctcttgaggaacagcacggctcctccatgcaggaaggagggagcrcagccagactccctcctttgccttctgcctctgtgttcctgttcttgagattctgtcactttgatcaccgtggccaccatcctgaagctggtgcctggtg

SEQ ID NO: 63621 - DNA, 201 bp, Homo sapiens
agattcaaatgagaaagtcattttcaaattattttagggcctatggaaacaaacatttaagcagattttgttcttttacactttgtgcataaccttcacartgaagctgtttcttttgaatctctatttcagatcatcccttttttgttggggttcagtaccaccctgagttcctgtccaggcctatcaagccctccccac

SEQ ID NO: 63622 - DNA, 201 bp, Homo sapiens
ataaaggtacgtacttcacatgattaagggagataatgtatgtaaatagtctctagtagtgcctggaaaatagggaaatgctcagataatatcagctcttygcctagctgtgtattactatgtgacagacctccctaaagctcagtggctcccaacagcagtgacttctcatctcagtattctgtggtttggctcagtgcc

SEQ ID NO: 63623 - DNA, 201 bp, Homo sapiens
ttttatctgccaggaatgaaagtggtgaggtcttgaatataatccagaggttgagagagaaaagaaagtagtgaggtcattgtgggtatcaaatgggcagyccttcctccaagttgcagtgcacctcccagtcctgccctggggatgacagcttggggagcatggtcactgggcagttgtctcaatactgattactacatt

SEQ ID NO: 63624 - DNA, 201 bp, Homo sapiens
tcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagtt

SEQ ID NO: 63625 - DNA, 201 bp, Homo sapiens
gtgttctggtctgtgccatggcgggcagcagctgagctggtggaatggtggggcatggccctgcttgtctgtgggtggcagtagagtgtcatggttaagakcatggatgccgtggctaggcgcgttggctcatgcctgtaatcccagcactttgggaggccgaggtgggcagatcacgaggtcaggagattgagaccgttc

SEQ ID NO: 63626 - DNA, 201 bp, Homo sapiens
tataaaaatgttatcttgttgctcctgacctaacagaattaggaagcagcactgtctcatgagggaaggggtcttgataaacatggggtctggactctagraacttctttctggtacatggccttcctcggggagccatttaacttctggccgcagtttctccttctccaaaatgcttggagttggtactaaagccacttc

SEQ ID NO: 63627 - DNA, 201 bp, Homo sapiens
tgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaact

SEQ ID NO: 63628 - DNA, 201 bp, Homo sapiens
ttcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagt

SEQ ID NO: 63629 - DNA, 201 bp, Homo sapiens
atgtaaacccaaaagaggactgcaggcacaggaaagtgtctaatgggggcaggatcctcatttaacagggaaatcaatagaaaatgcctccaagtaaatgkggagaagtagcacaccagcaagatcagttaagagttgaagagcggttgtttctagggattggaaaggggagagtgggtgagggccgatactgcttacaag

SEQ ID NO: 63630 - DNA, 201 bp, Homo sapiens
gtaatcccaaagtgctgggttttataggtgtgagccaccatgcccgactgccttttacttctttgttgttattgagaacctgtcaatggtgtgacatacarctgtggctgttacttcaaagattaattgcttaaaactgggagagatgttaaaacatacctcttaagttttaaaattctgcattcgtactcctactctcta

SEQ ID NO: 63631 - DNA, 201 bp, Homo sapiens
cagaaagttgagatatgggcccaaatctgattaatgtttgcagtccccaagcacagtagctgtcatgtaagtcagtagcccataaggatgaatgaatgagyctcccgcctgatctttatgtacactggcatatgtattgccaggcactgagactgcaagaatctaaagagagaaactaaagaacgtaaagagagatgttaa

SEQ ID NO: 63632 - DNA, 201 bp, Homo sapiens
ttctttacatacagcccgtttgttttgccagggaaactctatggagacgcagactacttggaagagaggcaccgccaccgatttgaggtgaggattccagsttgctggtactctggaaagatagtgagctgagagaccagcagaattatttttcatgcctcaacaggtgaatccagtctggaaaaagtgtttggaagaaca

SEQ ID NO: 63633 - DNA, 201 bp, Homo sapiens
cttcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagag

SEQ ID NO: 63634 - DNA, 201 bp, Homo sapiens
ttcctggcccatcagctgaagcttttcaggaagagatgaaggtcagaggtaaagttggggctcagtgctgaggttgttaaacaggccccatgtagctgtcmccacattggggtttgctttctacttcccaggtgtttctcagcgtgagagtttagtttgctttgtgctgctggacaggttcctgcagaatggcctgttgta

SEQ ID NO: 63635 - DNA, 201 bp, Homo sapiens
tttagtgcctaacctctgaaacaactttgttcttctagcttggtggaaccgtgggggacatagaaagcatgccctttattgaggccttccgtcagttccarttcaaggtcaaaagagagaacttttgtaacatccacgtcagtctagttccccaggtaagtaagacattgaaagttttactttgggggagatggagaggag

SEQ ID NO: 63636 - DNA, 201 bp, Homo sapiens
gttttaaaattctgcattcgtactcctactctctagcgttgaggtgaaaatatgcaagcattaaatgtcactagtgcagaaatcctcgtaacaaatggcawcaggaaaagatccatatacctgagtgatatttaatacagaattcttgagcagaggatgagttacctctctgagggagaaaatgagactttttttcctttc

SEQ ID NO: 63637 - DNA, 201 bp, Homo sapiens
gcttttggaaatgctgcagcagaggatgcaaagagcctttggagcggggaagacttctgagcattcttccttccctgccaagtgtgttctttcttgctctrgggagggggtggggcgggggaatgcttcgagcacaactccttagttttcttgttccttagtttatttttatcataatttggcttcacatggaacgttcct

SEQ ID NO: 63638 - DNA, 201 bp, Homo sapiens
ggctagaagtatgaggttaccttttagagaatagctggtaatttttctttttgtgtgtcatatttagtcttctagaagtgaatttctgtgcttcctattaygtaattgcacaccttgttaatgagtgttttatttcaggattgcagttgtgccatggtataggtatttttcacttaacgtaaatggtttctctgttcactg

SEQ ID NO: 63639 - DNA, 201 bp, Homo sapiens
gagatgcggtttccccatattggccaggctggtctcgaactcctgacctcaagtgatcctcctggctctgcctcccaaagtgctgggattacaggcatgarccaccatgcccagccagagaactacttttaattaaaggaattttggtttagctgcaaccacttttaaatgttgatgttctttccttttagtctatctttt

SEQ ID NO: 63640 - DNA, 201 bp, Homo sapiens
tatgggaaaatataaaaatgttatcttgttgctcctgacctaacagaattaggaagcagcactgtctcatgagggaaggggtcttgataaacatggggtcyggactctagaaacttctttctggtacatggccttcctcggggagccatttaacttctggccgcagtttctccttctccaaaatgcttggagttggtacta

SEQ ID NO: 63641 - DNA, 201 bp, Homo sapiens
tttagtttttgttctaatcactgatcttaaactgaggagggaagttgtgtttagagcttagcaatgaaactattaatcactttcgtttgtaactattttcrtaacaagtattttggtatttcagatgccaattctacagagtttgaccctacgaccagtcatcccgtggtgagtcaagtgtttgaacctccacagggctta

SEQ ID NO: 63642 - DNA, 201 bp, Homo sapiens
caccatgtttgccaggctagtctcgaactcctgacctcaagtgatccacccgcctcggccttccaaagtgctgggattataggtgtgagccaccacgcccrgctcattctatatcttggtgtgtatgtttgacaaaactcttcaaagtatgcacttaaaatgcttgtattttattgtatgtgaattatgcttcaatatggt

SEQ ID NO: 63643 - DNA, 201 bp, Homo sapiens
ttgtggataggagctcaagtagaagccttcatgttttctctttagagacaaattcagtcttggaaagcttatttatgcttatgagctacatgtagatgtcrtggaattttgagagaatgaattgtgaattcctgtccatttaatgaacccagctgtttgtagcacacgtgaggttgagttttatatctgctcacttggcac

SEQ ID NO: 63644 - DNA, 201 bp, Homo sapiens
agcttggagacaccgcatactgtatagcagtgatcacagtgcgagtttacttgctaaacactcccaggattcttgcgttaaatgacttggtttaatcagcrtttctctgatttatatccataacaccctttttgagaatcccatgtgcattttgttgaaaccagggagcatgcttttggaaatgctgcagcagaggatgca

SEQ ID NO: 63645 - DNA, 201 bp, Homo sapiens
tagccacagccaggttctacccagtcgctgggccgcagcaagaagctaggagtgtactcggaggagtgggaagccaccgaaaagttgaagtgtgggagtgrtgaattctgacttgaattttaaaagatcactttgacgccatgtgtggagtagataatgaatattcttctgcgtgaggcaaatgaatatccttgtgcatga

SEQ ID NO: 63646 - DNA, 201 bp, Homo sapiens
actgaaatatgccttcagttgaaaaatcagaattatattgttgtttgctaaaaaaaataatttgaagaactacttcttcgttgaagcttgtcaattctgcyaaggcagcatgatacgagtccagagagctgttgtttttacacagtaatgagtgtgaaagtggtaaaggcaactcgattagggcattaagccagatggcat

SEQ ID NO: 63647 - DNA, 201 bp, Homo sapiens
catagattctgcggacttggagcccatcacctcgcaagaagagcccgtgcgctaccacgaagcttggcagaagctctgtagtgctcagtgagtagagttcrctgccttgggtttccagagttcttttggtttgttttaatgaaaaagtcctcttgttttcatgtgccagtagtaggtaattgacttgttaaaatatttttt

SEQ ID NO: 63648 - DNA, 201 bp, Homo sapiens
aggtcttgctgtgtcaccctgactagagtgcagtggtgctgtcacagctcactgcagcctgggcttaaacagccctcctgcctcagcctcctgagtagctrgtaccttaggcggacgctaccatgttcagctgttttattttttgtagagatgaggtcttgctatggttgcccaggctggtcttgaactctttgggctcag

SEQ ID NO: 63649 - DNA, 201 bp, Homo sapiens
ctctgaatgattccaatatgcagctgagtttgagaaccactgttcctagttaagccattcataggttcgtggacatgatttttttaaagctacatttgtgrtttggatcatgaattattattattattatttttaagacaggttctggctctgttgcccaggctggagtacagtgatgcgatcttggctcactgcaacctc

SEQ ID NO: 63650 - DNA, 201 bp, Homo sapiens
tcagcagtttgggaggcagaggtgggaggactgcttgagcctatgagtttgagaccagcctgggcaatgtgacaagagcctgtctcgatttaaaaaaaaaraaaaagtccaacagaaaatgatttccatcctacaagtccatgtgtaacgtgtatctgttaagtgtgagagaagaataaagatgatttagtacagaaagga

SEQ ID NO: 63651 - DNA, 201 bp, Homo sapiens
catttatggtacaatcacttagtactgattgtccccatgagtagtgtgacacattttcatctgtctcttgagcaagtcagcagatcttttgctttcgtctkgcaagagcattcgtctccgaatgagcttcatttggtttcagtatctgtactcctgctgtgctgatcctagctgttggatctcagtgttcctcagataaca

SEQ ID NO: 63652 - DNA, 201 bp, Homo sapiens
cagatctgcttttggctttagactttactggcctgaaagctgagggtcacactgacagctggctctggtctggggctgccctggcaagattctgggctaaytgggtcatgtttggatcttagcttcccctctcaccagctttgtgaacatgggcaaattaacctcttcaaaatgtggattccttttctgtaaaatggagac

SEQ ID NO: 63653 - DNA, 201 bp, Homo sapiens
tctgccaggaatgaaagtggtgaggtcttgaatataatccagaggttgagagagaaaagaaagtagtgaggtcattgtgggtatcaaatgggcagcccttyctccaagttgcagtgcacctcccagtcctgccctggggatgacagcttggggagcatggtcactgggcagttgtctcaatactgattactacattctggt

SEQ ID NO: 63654 - DNA, 201 bp, Homo sapiens
gtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggat

SEQ ID NO: 63655 - DNA, 201 bp, Homo sapiens
tccaactcctgggctcaagatccccccgcctcagcctttcaaagtgctgggattataggattatgggcgtgagctcatcctggccagacgtggtttttttycccttgaaatagctattttggtctcatgatagcgtgtaccttctgagtaattgggtttttcttgacgtttatttgatagatatgatcgcttgctggagac

SEQ ID NO: 63656 - DNA, 201 bp, Homo sapiens
ctgatagggccaggccaggtgccgggcctccagacaatgagttcgggttatgtcttaacacgcttgtctcttaccaactagatcagtgcagatgggcgtcytggtggcagcgggtgagtgtgcatatccaaagcccacacgaatggctgacagtggctggagcactcctgggtaccactccagagttctgagctgtgtttg

SEQ ID NO: 63657 - DNA, 201 bp, Homo sapiens
gcaggcagatcacctgaggtcaggagttcgagaccagcctgaccaacatggagaaaccccgtctctactaaaaatacaaagttagctgggcatggtggtgyatacctgtaatcccagctactcgggaggctgagacaggagaatcgcttgagacctggaggtggaggttttggtgccgagatcacgccattgcactccagc

SEQ ID NO: 63658 - DNA, 201 bp, Homo sapiens
cagtatttacagtctctcttcattgcatgcctgggagagatttctgacaaggagcaagttgttgttaaattatagaagagaactactttttttttttttttgaggtagtcttattctgtcgcgcacgctggagtgcagtggcatgatcccagctcactgcaacctctgtctcctgggttcaagcgattctcctgcctcagt

SEQ ID NO: 63659 - DNA, 201 bp, Homo sapiens
gcagaaagagagagatttgggagtttaatgattttgaaggaaactgttgtattttaaaacctcatatttaaaaaatgtttaagttattaaatatattaagwtgatcactttaaagccagtattaagatgatcactttaaagccagaatcaagaaagacaactttgataaaatgataatattatttaaaaattaagaacgca

SEQ ID NO: 63660 - DNA, 201 bp, Homo sapiens
aggctgtcattgaacagaaagccctctagagtctgctgcagaggcttagctgagacccgatcctgaacacagtagagtgcagaaagagagagatttgggartttaatgattttgaaggaaactgttgtattttaaaacctcatatttaaaaaatgtttaagttattaaatatattaagatgatcactttaaagccagtatt

SEQ ID NO: 63661 - DNA, 201 bp, Homo sapiens
actgcttcagaagactcagaccctgacatctttttcctacagtgcacagttgggcgttagcctcctcccaccttggcagaagactggaggcttgttctctrgggagggttcctggatgagcagacagtagggacagttgagggcagtaacactggactacaaacatggggttatgtgtaatgttaacgctgttgacagtcc

SEQ ID NO: 63662 - DNA, 201 bp, Homo sapiens
taaaaagtgggcacgagatttgaacagacacttccaaaaaaagatgtaggtgataaacacgaaaaggtgctcaacacctctagttagggaaatcagtgcasatgaagtcacaatgagatagtgacacaaaccccctagagcggctgagtgttagagaggctgtggagctcttaccttgctgccgggagtgtaaaatggcac

SEQ ID NO: 63663 - DNA, 201 bp, Homo sapiens
gaacaattcaaggaaatttctagacatcagtttctgggttgaaagggcccccttggtgcctatcatattggatgacagatgacctacaccaaggcatattrttgtgaaggttcagactaatggggcagaagttctaaaaggctctgaagagaaaaatcaagaatcattgtgccactggaccccttagcaacaatactggaa

SEQ ID NO: 63664 - DNA, 201 bp, Homo sapiens
tcccctttattccttttcttcctggcccatcagctgaagcttttcaggaagagatgaaggtcagaggtaaagttggggctcagtgctgaggttgttaaacrggccccatgtagctgtccccacattggggtttgctttctacttcccaggtgtttctcagcgtgagagtttagtttgctttgtgctgctggacaggttcct

SEQ ID NO: 63665 - DNA, 201 bp, Homo sapiens
aaagatagtgagctgagagaccagcagaattatttttcatgcctcaacaggtgaatccagtctggaaaaagtgtttggaagaacaaggcttgaagtttgtyggccaagatgttgaaggagagagaatggaaattgtggagttagaaggtgattattcgggcagttttatttaatggaaaacttagtaaagttttcttggca

SEQ ID NO: 63666 - DNA, 201 bp, Homo sapiens
aggtgaccttagcagattcatagaaatagccctcaaaagacctggctgtgtggatgatgaaaagtaaagcaggaaggaggatgtctttgtgaacgcatcaycctgtgagataaagttctttacatacagcccgtttgttttgccagggaaactctatggagacgcagactacttggaagagaggcaccgccaccgatttga

SEQ ID NO: 63667 - DNA, 201 bp, Homo sapiens
tgaagagcggttgtttctagggattggaaaggggagagtgggtgagggccgatactgcttacaagctcggttagaaccatttgattctaaaatgcatgcaygtgtaactttgacaaacataaaagctaaattacacaagtgaccaaatgatctatttccttattaaaagaggttcaaggaaaagtcatacttgaaaattcc

SEQ ID NO: 63668 - DNA, 201 bp, Homo sapiens
gagaaccctgttccagaccaagaactcagtcatgagtaagagctgcctcacgctggcccagcctttggctctgcgtgcccaggacgcgtgtcttagggtgrtgctgtggcttcgaggagcaggctggctttttttggtttcgttcttgcttttgaagttcattctttcctctcttattcatacccttttaggatgcactgt

SEQ ID NO: 63669 - DNA, 201 bp, Homo sapiens
gattggccactaattttctattctattcttgagtctgttttagtagtttatctagaaaattgtccttttttctgttttcaaatacataatatttttacaasgtcacgtagctagtaggaggctgtaagcctggtgagtttttgcttttatttaataacttgcttttttctaaacaggtgatctgtgtccacgatgtctcat

SEQ ID NO: 63670 - DNA, 201 bp, Homo sapiens
aggcttgttattttctaattagagatagtgggctgttccagaagaacccattgccatcggccattccctgcctctcctggttccccaaacaacacctgtgwccctcctgcctcttctccgtgcctcgttgtactttgtgcttcagccgggtggagtatctttcggttcccctagtaccctccactctccctatgattgtac

SEQ ID NO: 63671 - DNA, 201 bp, Homo sapiens
ccaattcaaggtcaaaagagagaacttttgtaacatccacgtcagtctagttccccaggtaagtaagacattgaaagttttactttgggggagatggagargagggaggaaaggtaaaccggaatgattttcactcattgtctagtagttttcacttgaggtgcaggaagcagagaataaagaactttgtaagtttaaatt

SEQ ID NO: 63672 - DNA, 201 bp, Homo sapiens
tcccagaacacagtatagatactaatatgagaccctggcatgtgtacttactgtgtgccagccgctgctctcactgctttcatatgtatattttatattarttcatgggatccccagccatagtcctgggagaactgctgggttggagcactggttggcttaaccgtatccaaagattttccaggctggcgtaccttgcgt

SEQ ID NO: 63673 - DNA, 201 bp, Homo sapiens
ttgtacaggtggggttccactgtgttgtccaggctggtcttgggtcctcccacctgtaatcccaaagtgctgggttttataggtgtgagccaccatgcccractgccttttacttctttgttgttattgagaacctgtcaatggtgtgacatacaactgtggctgttacttcaaagattaattgcttaaaactgggagaga

SEQ ID NO: 63674 - DNA, 201 bp, Homo sapiens
aaagatgcgctcgctaccaccgtgcggcggtcctttctctcgcaatagtctcaatgctcccgggccctgcctccggacgccaggacagaggtaccaaaatytcacctcctgcaaagaaacctaattgctacgggggccggaagaggaagaggtgcggctccgacagccagaggggcgggcatacgcagcctccctcggctc

SEQ ID NO: 63675 - DNA, 201 bp, Homo sapiens
gtggcatgtgcccataatcccagctactcgggaggctgaggcaggagaatcgcttgaacccggcagatggaagttccagtgagccaagatcgtgccactgygctccagcctgggtgacagaacaagacttcatctaggggggttaaaaaaaaaaaaagaaaaccgcaagacatactggaaataggacaagcaaagaagcaa

SEQ ID NO: 63676 - DNA, 201 bp, Homo sapiens
tctttgggaagatatagtttattgcatatcaagtatttgaacagtgcagtcatgaactggaatgaaattttagtttcaaagcaattttaaaggtttatatraaaagggctttcattagatttgattgtattaaatcttaaatcactgaatgatttaaaatggatagttatagaaactgatattaatacaatttactgacag

SEQ ID NO: 63677 - DNA, 201 bp, Homo sapiens
ataatcacatgttgctacctagtaaataaaatcttaagaagatccgtggctttccttcaccagttcatagcatcgtgattcattgcccggattggactcgrctctactcactggacatctaaccactccacttaattaacaatacccaccctacaggggtgttgtaaggattaaaatttaaaatacccgtgttttctacag

SEQ ID NO: 63678 - DNA, 201 bp, Homo sapiens
gtaatggaacataatttcagccattcaaatttaatacgtcaattgttgctttttctgctttttgatttgcagtgttggtagccttatatgaagaaccagakaaacctaacagtgctttggagtatcctttcaagtcagaaaaaggctttattttgaaactcttatttttttagatagataataacctttaaaatacttctg

SEQ ID NO: 63679 - DNA, 201 bp, Homo sapiens
ctgctcatcctccagaggcccacatcaagtcagccacgactcaaggagactccaaagataaaagctgaagccaaaatatatgattctaaacaccctcctcrgctactgcaaagcactgtgagcactttctcaggacgagagccaagaagcccagcacctatgggtcaccacagtttccgaggtcccagatgaaaaagatgc

SEQ ID NO: 63680 - DNA, 201 bp, Homo sapiens
taactgtgtgtgtgtgtgccagtttgaactctgacaccacattttccttctatgcaatcatgcctgtctgataatcttgcattgctttcctctgagctttrgtgggtcctagttgcacactggcctttctgtgctgtttttcaatttgcctaataatagcagttaccctgattgtaatttatgtaactttaaacaggatca

SEQ ID NO: 63681 - DNA, 201 bp, Homo sapiens
ttaatacaatttactgacagtaactaagttgaatataacagttaccttgttttactattttttactcaatttagaataaaattcacctaaattcctctgtytttgccccatagcttgctcagtatgaaccacctcaggaggagaagcgtgctgaataggattcttctcagtttgaaagacaatgaaaaatggttttgtatg

SEQ ID NO: 63682 - DNA, 201 bp, Homo sapiens
acccaggctggagtgcagtggtgcgatctctgctcactgcaagctccgcctcccgggttcacaccattctcctgcctcagcctcccaagtagctgggactrcaggtgcctgccaccatgcccggctaattttttttgtatttttagtagagacggggtttcaccatgttagccaggatggtctcaatctcttgacctcatg

SEQ ID NO: 63683 - DNA, 201 bp, Homo sapiens
gtataaggggaagaggggtgctgaatttttaggccaaagactgatattaatacaaatcactcactaactgtagagccttgggcattatcagtgaactactytgagatttactgtcttcatctgtttaatgagtagaatgtccgtgatgcctacctcacagggttgttgtgagggtcaaatgagaatgtatgtgaaagattt

SEQ ID NO: 63684 - DNA, 201 bp, Homo sapiens
tgctgggattataggcgtgagccatcatgcctggccaattttttttttttttgtagagttggggtgttgcccaggttgatctcaaactcctgggctcaagmaatcctcctgtcttggcctctcaaagtgctggaatttcaggaatgagccactttggcctaaatttttacagcttatttccaagatgatttgaaatagttt

SEQ ID NO: 63685 - DNA, 201 bp, Homo sapiens
gccatctaactcattaccttaaaagacattctgtttattagtctgattaggaatgatggcactggttgtattttagccaagacagtttagcatggagctaktccttggtgcagttcaggatatgaacacaggtacagtcattctttgaaggtgacactgttctgtatattccctataggcagctggagagatctgtgtgac

SEQ ID NO: 63686 - DNA, 201 bp, Homo sapiens
cagtttgaactctgacaccacattttccttctatgcaatcatgcctgtctgataatcttgcattgctttcctctgagctttagtgggtcctagttgcacamtggcctttctgtgctgtttttcaatttgcctaataatagcagttaccctgattgtaatttatgtaactttaaacaggatcacactgtaccccctgcctgc

SEQ ID NO: 63687 - DNA, 201 bp, Homo sapiens
gccttatttgcttactgagcacaggacagaggcaatatacaactctgggttcacacacaagctgagatgagaagaggaatgagccatatattggggaaaaycatagtttgtaggtataattatatagtgcttttctccctcaaagtatttttctagccttgaattcattttatcttcattatccctgtgaagtaggtggga

SEQ ID NO: 63688 - DNA, 201 bp, Homo sapiens; identical to SEQ ID NO: 19134

SEQ ID NO: 63689 - DNA, 201 bp, Homo sapiens
tgttctgtatattccctataggcagctggagagatctgtgtgacacaagatgcttttgtacgggttcccatgaatcttctgctcttgtttgtgtgacatgraacaaataacttctttgccaccactttgccttagataactgtgtgtgtgtgtgccagtttgaactctgacaccacattttccttctatgcaatcatgcct

SEQ ID NO: 63690 - DNA, 201 bp, Homo sapiens; identical to SEQ ID NO: 19135

SEQ ID NO: 63691 - DNA, 201 bp, Homo sapiens
attttatcttcattatccctgtgaagtaggtgggacaagtataaggggaagaggggtgctgaatttttaggccaaagactgatattaatacaaatcactcmctaactgtagagccttgggcattatcagtgaactactctgagatttactgtcttcatctgtttaatgagtagaatgtccgtgatgcctacctcacagggt

SEQ ID NO: 63692 - DNA, 201 bp, Homo sapiens
agtgcagtcatgaactggaatgaaattttagtttcaaagcaattttaaaggtttatatgaaaagggctttcattagatttgattgtattaaatcttaaatyactgaatgatttaaaatggatagttatagaaactgatattaatacaatttactgacagtaactaagttgaatataacagttaccttgttttactattttt

SEQ ID NO: 63693 - DNA, 201 bp, Homo sapiens
caagtataaggggaagaggggtgctgaatttttaggccaaagactgatattaatacaaatcactcactaactgtagagccttgggcattatcagtgaactrctctgagatttactgtcttcatctgtttaatgagtagaatgtccgtgatgcctacctcacagggttgttgtgagggtcaaatgagaatgtatgtgaaaga

SEQ ID NO: 63694 - DNA, 201 bp, Homo sapiens
ttactattttttactcaatttagaataaaattcacctaaattcctctgtctttgccccatagcttgctcagtatgaaccacctcaggaggagaagcgtgckgaataggattcttctcagtttgaaagacaatgaaaaatggttttgtatgacttgaatagtttgtatagtatataatcttttctgaacagatgctatagaa

SEQ ID NO: 63695 - DNA, 201 bp, Homo sapiens
acacacaagctgagatgagaagaggaatgagccatatattggggaaaatcatagtttgtaggtataattatatagtgcttttctccctcaaagtatttttstagccttgaattcattttatcttcattatccctgtgaagtaggtgggacaagtataaggggaagaggggtgctgaatttttaggccaaagactgatatta

SEQ ID NO: 63696 - DNA, 201 bp, Homo sapiens
tttagaataaaattcacctaaattcctctgtctttgccccatagcttgctcagtatgaaccacctcaggaggagaagcgtgctgaataggattcttctcaktttgaaagacaatgaaaaatggttttgtatgacttgaatagtttgtatagtatataatcttttctgaacagatgctatagaactcttttaatatgtttaa

SEQ ID NO: 63697 - DNA, 201 bp, Homo sapiens
atcagccttttaactgttcttcctgtctttatccttgtcccactccagctggtccacatagcagttaagagtggatcctgtcactcccttcctttaaactktttaattatgtgccaaccaaatttgcatgactctccctaatctggccatgaccacctttccagcttcctttcctgccaaattacatctccagccatactt

SEQ ID NO: 63698 - DNA, 201 bp, Homo sapiens
gccaaagttatgccctgtcaagaaaaccacaagacgggcctggcacggtggcttacgcctgtaatcccagcactttgggaggccgaggtgggtagatcacraggtcaagagttcgagaccagcctggtcaacatggtgaaaccctgtctctactaagaatacaaaaattagccgggcatggtggcatgtgcccataatccc

SEQ ID NO: 63699 - DNA, 201 bp, Homo sapiens
tatgttcacatttctttattgccataattaaaatactggaatgggaacaggttgcagttagattgaaacaaaccagttcccagcttggccagttcatacasagctgggcagagcgcactgtgattcaggccagacccaggcagggctggtctcatgtcatcttacgaccagtccctgctgaaaagcagcccagtccatcta

SEQ ID NO: 63700 - DNA, 201 bp, Homo sapiens
tcgctaagctgcttttaagctaattttctggctcttcacctactgtgtatgtgccatgggactgttttccttagtaggttttcagatatcttctaggatgyttggattctcagggacacctgctccacagctgggcaccatggccttgactaactgcctggccttgagggttcagacagtgaacatacacccttaagtaac

SEQ ID NO: 63701 - DNA, 201 bp, Homo sapiens
tcctcttctgcttccctatgccccggagggtgctgggccagggtggggtagaaagcagaggagacccaagcgggcctcctgcccagccctgccactccctratggctggcagagggagccatcaacaaatgaagtcccgggaagaacattttctccagcagcattgtaacctatgtgctagggagtcctgtggatccaaat

SEQ ID NO: 63702 - DNA, 201 bp, Homo sapiens
aatagccaataattgtgatataataatagccatagggttattatgatgcatttaaactcatataaaaagtgcatggaaaagcattgttgttgctgttgacrttgcaacaagcatgggtggatgtgaatggtgctgagtctacccgaaagtaagttagctggttccttaagaggctgagcaataggctggaataaaggctca

SEQ ID NO: 63703 - DNA, 201 bp, Homo sapiens
cttctgggctccacaggtacctccccacagcagaggaccgtttgtcacagctcagggagaacagtgcttaagaccatcctgttctctgggctctgactccrtagccaccactcgtgagataatgtcccaagtagaagcacagtttgttcctggcacaggtccattttatgtagatttggcctgcaactgccttttctggta

SEQ ID NO: 63704 - DNA, 201 bp, Homo sapiens
ggcaaattaagccaacatggttcaagtttttgttttctggtggtttacattaaggaataaagattagaggcttgaactgaaacatcccatagctatggatkgggtctctgaagtgtcagttgtctcttgtcccatggtcacataagcttatgatggggaaaagtggctgaaaggtacacaggaaccttgtactatttttgc

SEQ ID NO: 63705 - DNA, 201 bp, Homo sapiens
atactgaaattaagtaatatactggaagtctaaaggtgtagatctgtgctttagatgaagcatttctggaggaaaagaatcattgcggtgtctctagcccracccctgctcccttctgggctccacaggtacctccccacagcagaggaccgtttgtcacagctcagggagaacagtgcttaagaccatcctgttctctgg

SEQ ID NO: 63706 - DNA, 201 bp, Homo sapiens
aaagttggggctggctgtggcagggccagagagagacggaaattcacctccagccaaaattaggtgggcagctgcttaggagggcttctgagactcccagmccacagcaaccgagctgccatgagcaagacattcccggtcaaggaaacaaaatatattgctgaaacaccaggagtttggtcaaggtcctggtgcttgcag

SEQ ID NO: 63707 - DNA, 201 bp, Homo sapiens
tctgagaccacctgtcttcagggctccccaggtgtctgggggcccagtagctccccctaaagtcttattttggctcctctcctctgagctcgtcttggctstgactgtggctgagagctcacctaggaggttttctaggcacttccatgctgcaccctggcctccaccccacccaatgcccacctcccttctccacatacc

SEQ ID NO: 63708 - DNA, 201 bp, Homo sapiens
cacaaggagaaagactggcagttcagaagccaacataggtcaggagaagagtgccatcctgctaggatgtggagaatgggagaaggggcagcctccatggktgggggcctctgtgcaggcggatctgggggctcaggagaggggctgggctggggtggttctcagtattcacctcatcactctgaagtatgctgcttcact

SEQ ID NO: 63709 - DNA, 201 bp, Homo sapiens
gtggcacgatctcggctcactgcaagctccgcctcctgggttcatgccattctcctgcctcagcctcccaagtagctgggagtacaggcacccgccaccaygcccggctaactgtttgtatttttagcgtagacggggtttcaccatgttagccaggatggtcttgatctcctgacctcatgatccacctgcctcggcctc

SEQ ID NO: 63710 - DNA, 201 bp, Homo sapiens
ttctcctgcctcagcctcccgagtagctgggactacaggcacacgccaccacacccagctaactttttttttttttttttttttttttagtagaaatgggrtttcaccgtgtttgcccagactggtctcgaactcctgagctcagccaatccgcccacctcggcctcccaaagtgtggggattacaggtgtgagccactgc

SEQ ID NO: 63711 - DNA, 201 bp, Homo sapiens
tattaaaaaagaactgccaaaccgccaatgcatttgtttaaaatatttcttattttgccttcatcaagactaagaattttaactatgaaagtgttaattayccaaatttctccaattctttataaggttttaaagaatattttattatctaaactttctaatttctctgtatgtgcaaagaaacaaacaaacgaaaactac

SEQ ID NO: 63712 - DNA, 201 bp, Homo sapiens
tcaggtgatgtatttgtatggtcatacacgaggaactgctgtagacaagctgactactgtggctgtgggctctaagagcaaagtggccagtctctttgggmccttggggatggggctcctccttggggtacttgtgctgggtgtgaaatggaaggcagagatttgaggtgtgggaaaagaggaaagagactgtttggtccc

SEQ ID NO: 63713 - DNA, 201 bp, Homo sapiens
aaagaaaaaacttcagacaaggtctctgcatgacaatttctaaccaaaagtccctactcagacaagttttagtctagaatttgcattcaatttgtggcttraggcgatcttggctgaaaatttaccttaaaaggaccccacagtagtagtgtccctaggccccaagcagaagcaaatgcaaattttctctggaggagtacc

SEQ ID NO: 63714 - DNA, 201 bp, Homo sapiens
ggtggcgcgggcctgtagtcccagctactcgggaggctgaggcaggagaatcacttgaacctgggaggcagaggttgcagtgagctcagattgcactaccrcactccagcctggacaacagagtgagactccatctcaaaaaacaaaaaacaaaaaaacaaaaaaacctgacatgcttgacttctcagaggtgaaaccatc

SEQ ID NO: 63715 - DNA, 201 bp, Homo sapiens
aaaattgtgattataataacaatttataattgtttttgtgattataatagccatataattatatatatataatataatagccatataatagccaataattktgatataataatagccatagggttattatgatgcatttaaactcatataaaaagtgcatggaaaagcattgttgttgctgttgacgttgcaacaagcatg

SEQ ID NO: 63716 - DNA, 201 bp, Homo sapiens
taaaaaaaaaaaaaaaaaaaaaaaaaaaggcaatttccagccgggcgcagtggctcacgcctgtaatcccagcactttgggaggccgaggcgggtggatcrtgaggtcaggagatcgagatcatcctggctaacacggtgaaaccccatatctactaaaaatacaaaaaaattagccgggcgtgtggtgggcacctgtagt

SEQ ID NO: 63717 - DNA, 201 bp, Homo sapiens
ataggcttcaaagaattcccataaatagtgttctgaggaacatgagctcacaatcaaaagtcattaaatacttgaaaaaataaaccaccagaagtgaaaaycaacaacaacaaaaaaatcaaactacagaataaaaccaacaaagactcatagctagtatgattattaaaataagaaaatttcatgtctgaaaaaataaaa

SEQ ID NO: 63718 - DNA, 201 bp, Homo sapiens
caaccacataaggcactaggcactggcctggtacagaataagtgctaaaaaaaaaaaaaaaaaaaaaaaaaaaggcaatttccagccgggcgcagtggctsacgcctgtaatcccagcactttgggaggccgaggcgggtggatcgtgaggtcaggagatcgagatcatcctggctaacacggtgaaaccccatatctact

SEQ ID NO: 63719 - DNA, 201 bp, Homo sapiens
caggagaatggcatgaacgtgggaggcagagcttgcagtgagccaagatcgggccactgcactccagcctgggcgacagagcgagactccatccccccccmaaaaaaaaaaggcaatttccatcctcttcatccaagcaaaggacctatccaagaaccaaggtagaaatccagtgggaaagcctagaagcccatcacagga

SEQ ID NO: 63720 - DNA, 201 bp, Homo sapiens
tctaccctttgccctactccttggccatgaaagccatcggaggcccagagatagaagtgcctccagctggtggagccctgagacaccagcagccgcacackgagccactgcttagggcctggagtacctagagcatggagagccccctggggctctggagtgcagtgagcagggaagggaaaccaggatgacagcaggagc

SEQ ID NO: 63721 - DNA, 201 bp, Homo sapiens
actggaagtctaaaggtgtagatctgtgctttagatgaagcatttctggaggaaaagaatcattgcggtgtctctagcccgacccctgctcccttctgggytccacaggtacctccccacagcagaggaccgtttgtcacagctcagggagaacagtgcttaagaccatcctgttctctgggctctgactccatagccacc

SEQ ID NO: 63722 - DNA, 201 bp, Homo sapiens
atcccatcaagggtccctctgagaccacctgtcttcagggctccccaggtgtctgggggcccagtagctccccctaaagtcttattttggctcctctcctytgagctcgtcttggctgtgactgtggctgagagctcacctaggaggttttctaggcacttccatgctgcaccctggcctccaccccacccaatgcccacc

SEQ ID NO: 63723 - DNA, 201 bp, Homo sapiens
cctgaacctcagaggttcaaggctgctgtgagccatgatcacgccactacactccagtctaggtgacagagcaagaccctgtctcaaaaaaaaaaaaaaaagttttaaatatatccaagtatcctaacaaatattcatttgagacctcctcaggatgccatgtgatatagccagggtcttcatattactatcttggagatt

SEQ ID NO: 63724 - DNA, 201 bp, Homo sapiens
caaggttggtgtaaggatgaactgagggactgtatgcatgctgtttgatacatttgcagtgatccaatcaacccttgcaattgtggttactcttattatcrttatcatcaagctcttcctgccttaggttctgcttgccgcctcctggctctgggcctggaacactcttctcctctgtctcccctggggttgcacactgtc

SEQ ID NO: 63725 - DNA, 201 bp, Homo sapiens
cacagttcttcttcattaaaggaaaagatctaaaaccaacacaaactattgattcaagtgactcacactagaaacaaacaccactcaaacagttccacttycatccacctctccaaacaacaatatataatgtactatttctgttcagaacttataaaagccttccactagaaactaaagaacatggatgattttatacat

SEQ ID NO: 63726 - DNA, 201 bp, Homo sapiens; identical to SEQ ID NO: 37376

SEQ ID NO: 63727 - DNA, 201 bp, Homo sapiens; identical to SEQ ID NO: 37377

SEQ ID NO: 63728 - DNA, 201 bp, Homo sapiens; identical to SEQ ID NO: 37379

SEQ ID NO: 63729 - DNA, 201 bp, Homo sapiens; identical to SEQ ID NO: 37753

SEQ ID NO: 63730 - DNA, 201 bp, Homo sapiens; identical to SEQ ID NO: 37315

SEQ ID NO: 63731 - DNA, 201 bp, Homo sapiens; identical to SEQ ID NO: 37381

SEQ ID NO: 63732 - DNA, 201 bp, Homo sapiens; identical to SEQ ID NO: 37686

SEQ ID NO: 63733 - DNA, 201 bp, Homo sapiens; identical to SEQ ID NO: 37754

SEQ ID NO: 63734 - DNA, 201 bp, Homo sapiens; identical to SEQ ID NO: 37382

SEQ ID NO: 63735 - DNA, 201 bp, Homo sapiens; identical to SEQ ID NO: 37383

SEQ ID NO: 63736 - DNA, 201 bp, Homo sapiens; identical to SEQ ID NO: 37384

SEQ ID NO: 63737 - DNA, 201 bp, Homo sapiens; identical to SEQ ID NO: 37387

SEQ ID NO: 63738 - DNA, 201 bp, Homo sapiens; identical to SEQ ID NO: 37562

SEQ ID NO: 63739 - DNA, 201 bp, Homo sapiens; identical to SEQ ID NO: 37537

SEQ ID NO: 63740 - DNA, 201 bp, Homo sapiens; identical to SEQ ID NO: 37563

SEQ ID NO: 63741 - DNA, 201 bp, Homo sapiens; identical to SEQ ID NO: 37401

SEQ ID NO: 63742 - DNA, 201 bp, Homo sapiens; identical to SEQ ID NO: 37782

SEQ ID NO: 63743 - DNA, 201 bp, Homo sapiens; identical to SEQ ID NO: 37283

SEQ ID NO: 63744 - DNA, 201 bp, Homo sapiens; identical to SEQ ID NO: 37285

SEQ ID NO: 63745 - DNA, 201 bp, Homo sapiens; identical to SEQ ID NO: 37331

SEQ ID NO: 63746 - DNA, 201 bp, Homo sapiens; identical to SEQ ID NO: 37286

SEQ ID NO: 63747 - DNA, 201 bp, Homo sapiens; identical to SEQ ID NO: 37405

SEQ ID NO: 63748 - DNA, 201 bp, Homo sapiens; identical to SEQ ID NO: 37406

SEQ ID NO: 63749 - DNA, 201 bp, Homo sapiens; identical to SEQ ID NO: 37335

SEQ ID NO: 63750 - DNA, 201 bp, Homo sapiens; identical to SEQ ID NO: 37337

SEQ ID NO: 63751 - DNA, 201 bp, Homo sapiens; identical to SEQ ID NO: 37338

SEQ ID NO: 63752 - DNA, 201 bp, Homo sapiens; identical to SEQ ID NO: 37339

SEQ ID NO: 63753 - DNA, 201 bp, Homo sapiens; identical to SEQ ID NO: 37713

SEQ ID NO: 63754 - DNA, 201 bp, Homo sapiens; identical to SEQ ID NO: 37714

SEQ ID NO: 63755 - DNA, 201 bp, Homo sapiens; identical to SEQ ID NO: 37715

SEQ ID NO: 63756 - DNA, 201 bp, Homo sapiens; identical to SEQ ID NO: 37365

SEQ ID NO: 63757 - DNA, 201 bp, Homo sapiens; identical to SEQ ID NO: 37368

SEQ ID NO: 63758 - DNA, 201 bp, Homo sapiens; identical to SEQ ID NO: 37302

SEQ ID NO: 63759 - DNA, 201 bp, Homo sapiens; identical to SEQ ID NO: 37706

SEQ ID NO: 63760 - DNA, 201 bp, Homo sapiens; identical to SEQ ID NO: 37527

SEQ ID NO: 63761 - DNA, 201 bp, Homo sapiens; identical to SEQ ID NO: 37530

SEQ ID NO: 63762 - DNA, 201 bp, Homo sapiens; identical to SEQ ID NO: 37532

SEQ ID NO: 63763 - DNA, 201 bp, Homo sapiens; identical to SEQ ID NO: 37630

SEQ ID NO: 63764 - DNA, 201 bp, Homo sapiens; identical to SEQ ID NO: 37533

SEQ ID NO: 63765 - DNA, 201 bp, Homo sapiens; identical to SEQ ID NO: 37554

SEQ ID NO: 63766 - DNA, 201 bp, Homo sapiens; identical to SEQ ID NO: 37632

SEQ ID NO: 63767 - DNA, 201 bp, Homo sapiens; identical to SEQ ID NO: 37707

SEQ ID NO: 63768 - DNA, 201 bp, Homo sapiens
tcttctagcatgaaggaaccacatactgggggccaaagaagctgcccatcaaactggtgctagagagagagatgaggccaggagtgggctcgtggctcccytcactcactaggacccagcttctactggcataacagggtctcctattgggcaaatcacttcccccatcctgcttagagctgctgtgaccactgtaaccct

SEQ ID NO: 63769 - DNA, 201 bp, Homo sapiens
agaggcgctcctcacttcctagacggggtggcggccaggcagaggtgctcctcacttcccagatggggcggccaggcagaagggctcctaacctcccagayggggcggctgggcagaggtgctcctcacctcccagatggggcggccgggcagaggggctcctcacctcccagacggggcggccgggcagaagggctcctc

SEQ ID NO: 63770 - DNA, 201 bp, Homo sapiens
agggacagaagggaagggacccacaggaagtcacagtggtgcccagggatgtgtcagcccccagccacggggacgcgggattcaagaatgaagtaaatacrgtcacagccccaagtggtgttagaggtgttttttgtcttttctccctttcgtgctgaggtgtagcacacacggtgcgccctacagcatggtgagttgctg

SEQ ID NO: 63771 - DNA, 201 bp, Homo sapiens
cccgcgctgggaatttgcggcggcctccgccggggcagccgagctgaaccggtctcttcctcggaaaggcagggccgaggggcctgcggggcagccatggrggcgacgcggaggcggcagcacctgggagcgacgggcggcccaggcgcgcagctgggcgcctccttcctgcaggccaggtgggcgcgcgccggggtgaga

SEQ ID NO: 63772 - DNA, 201 bp, Homo sapiens
agtgtgaaatggtgcacagggctctgaccagcactgaggacacttagtgtggcttgaatttgccgagtgaccttagacaagtcacttctcctttatctccyagtaaactgagagaataggcctggatgccttcatatccttagctctatgacttggcccgtcaggcaactgccagcaagtggggggcctgaagagtcatac

SEQ ID NO: 63773 - DNA, 201 bp, Homo sapiens
ctgtgtatgtaaagtatataggaaatataaatgaatttttccaggcatggtggctcacacctgtaatctcaatactttgggaggctgatacaggaggatcrcttgaggccagtagtttgagaccagcctgggcaacatagtaagaccctatctctacaaaaaatttaaaaattagctgggcataatggtgcacacctgtag

SEQ ID NO: 63774 - DNA, 201 bp, Homo sapiens
tgtggactgctgagaagaggattaccagcagcccaacctgacctcctcacagtgctggaatcaagcgagcaggaggccctatccatttcagtctctctaargcacatttcattggagggctctgattggccaagctctggtcacatgcccatcccatagaccaatcctgatggacccaactatgggatggaggttaaaagt

SEQ ID NO: 63775 - DNA, 201 bp, Homo sapiens
gggaggtgggtgagttgggagaaccttaaaggtcacccctgttctcgagggtctagatgggagagtacagctccagccccattatgccagactgggttggygttgaaatgctccctgcagtgggctggtggggctttgggaaaagcttcatcagggaagccttcccagaggaggcagcactggtcctggaacttcagtgca

SEQ ID NO: 63776 - DNA, 201 bp, Homo sapiens
tcaagcaattctcatgcctcagcctccccagtagctgagattacaggtgtgcaccaccatgctgggctaatttttgtatttttagtagagacggagtttcrtcatgttggtcaggctggtcttgaatgcctggcctcatgtgatctgcccagctcaccctcccaaactgctgggattacaggcatgagccactgtgcccag

SEQ ID NO: 63777 - DNA, 201 bp, Homo sapiens
attacaggcctgagccaccgcgcccagccaagtccacactcttaaaaactacactcaactgctatttcttggtttattttattttattctttttttgagayggagtttcactcttgtcccctaggctagagtgcagtggtgccatcttggctcactgcaacctccacctccagagttcaagcaattctgcctcagcctccc

SEQ ID NO: 63778 - DNA, 201 bp, Homo sapiens
cggtccaagtaggccctctgggccacctctcttgtgttatagatggggaaaccaaggcccagagaagggaagtattagcccagggtcacccagcaagttgrtgccacaacggagtccctgagaagcctaccaactcccaagctggcatcagggtcatttatttggtatctgctgggtgaggggcacagggtcaggccttgc

SEQ ID NO: 63779 - DNA, 201 bp, Homo sapiens
atatgaacccaaacagtctccaaagtccagactcttttttttttttttttttgagatggagtctcacactgttacccaggctggagtgcagtggcatgatmtcagctcactgcaatctccgcctcccgggttcaagcgattctcctgcctcagcctcccaagtagctgggattacaggtgctcggcaccacgcccagctaa

SEQ ID NO: 63780 - DNA, 201 bp, Homo sapiens
tgtgagctccccaccagccagggtattcccaggggggtggtgtgagggtgggagctctctgtctcccagggtgtctctgccccccacaatgtggcttcagyccattcccagtatcattgctgctcaagagagtaggcagaatcatcctgtccagttcctaggatgcttggatttcctctgctgcatccgtgctttgctcac

SEQ ID NO: 63781 - DNA, 201 bp, Homo sapiens
tgtccctcttcccctgtgtgagctccccaccagccagggtattcccaggggggtggtgtgagggtgggagctctctgtctcccagggtgtctctgcccccyacaatgtggcttcagcccattcccagtatcattgctgctcaagagagtaggcagaatcatcctgtccagttcctaggatgcttggatttcctctgctgca

SEQ ID NO: 63782 - DNA, 201 bp, Homo sapiens
atcaaagcctttacaaggtgctgggcccagaggctttgccttgacagagtggcccagggtttcaagggaggaggaacctccccctacctaggacccttccygtggggggtctacagagtcagggacagaagggaagggacccacaggaagtcacagtggtgcccagggatgtgtcagcccccagccacggggacgcgggat

SEQ ID NO: 63783 - DNA, 201 bp, Homo sapiens
tctcaaagaaaaatgaaagaaatgaatttcatgtttagacttgcatatgcattcccaagatatctcattgtgtatatgcaaatattccaaaatctgaaatytgaaacatttcagataagggatgctcagcctgtatcaccatttactatcaccatcattttgtattgaagaaagatacttcaaatctccagaagtaggagg

SEQ ID NO: 63784 - DNA, 201 bp, Homo sapiens
agctttgggacagatgagtggctctgtcctgtcactgccctctccctgcctgggggctatgtgcactccagacccctgcccaggctcaggcccatgaggtrtggagacaccctggcccccaggagctggaggcaccgcccactcccctggcattccagctttgcaggtgaccctcctctacccaaagctctgtccccctgc

SEQ ID NO: 63785 - DNA, 201 bp, Homo sapiens
agtgagccgagattccaccaccgcactccagcctgggcgatggagcaacactctgtctcaaaaaagaaaattctacacatatgtacttaacacaaactttktttcatgtacaaaattatttaaaatgttatataaaattaacttcaggctgtgtatgtaaagtatataggaaatataaatgaatttttccaggcatggtgg

SEQ ID NO: 63786 - DNA, 201 bp, Homo sapiens
ctggataaacctttgtcccaaggctgccgagaaggtccagcgatcacaggaagaattaagtgtacatgatggggtggggggtgaaaggagttggggtgggyggcattaggggcagactcccttgaggcccgagggccgcgtggggctgtgcccaggtgagcccattcttccatttgctccgcagctggtattccctctcga

SEQ ID NO: 63787 - DNA, 201 bp, Homo sapiens
gtgccacaacggagtccctgagaagcctaccaactcccaagctggcatcagggtcatttatttggtatctgctgggtgaggggcacagggtcaggccttgmctggaattgcatctgctctgtgtctggggacaagtccgttacctcctctgggactcagctttcctgtctggataaacctttgtcccaaggctgccgagaa

SEQ ID NO: 63788 - DNA, 201 bp, Homo sapiens
ccagggctcagaagagagagcattgcagaaggaggaactgcccctggcctgccttcctctctctgggaaggaagagttgcagctactttgtagagcattcytgttttctcctttgtctcctaacgtgtactttgaacctggtttggaagcagtccctccacatcagggcctagcactcaggagactgatctggcactcagg

SEQ ID NO: 63789 - DNA, 201 bp, Homo sapiens
ggcacctgtagtcccagctactcgggaggctgaggccagagaatcacttgaacccgggaggtagaggttgcagtgagccaagatcacgccattgcactccrgcccgggcaagacagtgagacttcatctcaaaaaaaagaaaaagaaaaaaatacaaaaaacttagggccggcatggtggcttacgcctgtaagcccagca

SEQ ID NO: 63790 - DNA, 201 bp, Homo sapiens
atgcctcagcctccccagtagctgagattacaggtgtgcaccaccatgctgggctaatttttgtatttttagtagagacggagtttcgtcatgttggtcargctggtcttgaatgcctggcctcatgtgatctgcccagctcaccctcccaaactgctgggattacaggcatgagccactgtgcccagtctaatcttgatt

SEQ ID NO: 63791 - DNA, 201 bp, Homo sapiens
ccctctggcctgtgtctggaagcaggtgaaccaggttgaaccaaatcaccaagacagacaaaggggtataggaaaggaagtggagcaccgcacccccaccyccgtctcccctgtccttccccattaccttgggatagtattattttttctggagttgaagggcgtaggctgattttgcatattatatatgactgtgagcca

SEQ ID NO: 63792 - DNA, 201 bp, Homo sapiens
ggaattgagccaagagttggggcatctggttgggtttgtgggtgacctagggcaagtcactgtcctgggcttcatttctctctccaagaagactggctggwctggctgctctgaaccttcttctagcatgaaggaaccacatactgggggccaaagaagctgcccatcaaactggtgctagagagagagatgaggccagga

SEQ ID NO: 63793 - DNA, 201 bp, Homo sapiens
attcactgcattcagcaggcattctttaagcgcctgtggtatgcccagcgctgtgccaggcagtaagggggtaggcagggtgaaggtgggagaggcttacsgtcctgtagggatcaggagagacagagcccaagtgggagtgagcggtcatcttggagggcttcatggaggaagtggcacttgagctgagtctcagaggac

SEQ ID NO: 63794 - DNA, 201 bp, Homo sapiens
atcctcaagcccctctcactctgtgccccatctcaagaaccccagtgttgccctggggccggtacaatccacctccgacaccaagccctgtagtgggctgyggtttccacctctgtgaagtggggatgatggtacctgcctgtctgcctctcagatgatgaggatgctgaggacagagaggggctttgtcaaatgtaaagc

SEQ ID NO: 63795 - DNA, 201 bp, Homo sapiens
gcggcattaggggcagactcccttgaggcccgagggccgcgtggggctgtgcccaggtgagcccattcttccatttgctccgcagctggtattccctctckagtggtttccactcaacaagcccagtgttggggactacttccacatggcctacaacgtcatcacgccctttctcttgctcaaggtactgtcccagggccc

SEQ ID NO: 63796 - DNA, 201 bp, Homo sapiens; identical to SEQ ID NO: 39634

SEQ ID NO: 63797 - DNA, 201 bp, Homo sapiens
gcagcgagtggctttggtccttcctcgccaagcctgagccctgagggtgggggaggaggacgcgtccctgataaacaacccccagatggtgatggcagggrgtgggggcacagccagggacccccacccgtgtcgggcctgctctttgggagtggaggaagctgcggggagccagctggatcaggctggggaggggcgtgc

SEQ ID NO: 63798 - DNA, 201 bp, Homo sapiens
ggggctaggaacagagagctggagccccagcaggaagggggtgtgggtgagaagaggcaggcgggtatactggtgaaagcacaggtgggagaaagggagcyggtgtgtggagaggggagagggtagtattttggggtgaggtgtctgaggtgggggtggggctgtgtgctgagagtgggtgcagtgcttcaccaagaggcc

SEQ ID NO: 63799 - DNA, 201 bp, Homo sapiens
tggcaggaaggtgatgctaagccctgtgtcctgactcaagcacgctcctgcctgctgctggggggtgaaggctgtgacagagcagcatgtccagggcctgsggcccggggaaggcggagctgccggtggcctggagggatggaaaatatgccccaagaaagggcttttgatttgagcctcagcctggcgtgccagtggggg

SEQ ID NO: 63800 - DNA, 201 bp, Homo sapiens
tgcagaaggaggaactgcccctggcctgccttcctctctctgggaaggaagagttgcagctactttgtagagcattcctgttttctcctttgtctcctaaygtgtactttgaacctggtttggaagcagtccctccacatcagggcctagcactcaggagactgatctggcactcaggagcgccagaacccgaacggtcca

SEQ ID NO: 63801 - DNA, 201 bp, Homo sapiens
atctggttgggtttgtgggtgacctagggcaagtcactgtcctgggcttcatttctctctccaagaagactggctggactggctgctctgaaccttcttctagcatgaaggaaccacatactgggggccaaagaagctgcccatcaaactggtgctagagagagagatgaggccaggagtgggctcgtggctcccctcact

SEQ ID NO: 63802 - DNA, 201 bp, Homo sapiens; identical to SEQ ID NO: 39643

SEQ ID NO: 63803 - DNA, 201 bp, Homo sapiens
catctggttgggtttgtgggtgacctagggcaagtcactgtcctgggcttcatttctctctccaagaagactggctggactggctgctctgaaccttcttctagcatgaaggaaccacatactgggggccaaagaagctgcccatcaaactggtgctagagagagagatgaggccaggagtgggctcgtggctcccctcac

SEQ ID NO: 63804 - DNA, 201 bp, Homo sapiens
acatggtggctcacagctgtaatcccagcactatggatggctgatgtgggttgattattgagcccaggaatttgaggccagcctgggcaacatagtgagayctcatctctacaaaaaataataataataataataataataaaataaaattagctgggcatagtggcatgcacctgtggtcccagttactcaggagactga

SEQ ID NO: 63805 - DNA, 201 bp, Homo sapiens
gcatctggttgggtttgtgggtgacctagggcaagtcactgtcctgggcttcatttctctctccaagaagactggctggactggctgctctgaaccttcttctagcatgaaggaaccacatactgggggccaaagaagctgcccatcaaactggtgctagagagagagatgaggccaggagtgggctcgtggctcccctca

SEQ ID NO: 63806 - DNA, 201 bp, Homo sapiens
cgagtagaggggacaggaagacttagctgacctagggaaggcctacccaacctgtcttgcctgccactagaaaatgagatttctcccaagagcttgcctcsctgtcctggggtactctaccagccagtatggatcatccttggaactggcaggaagggatctcagaaaattagggaagcaacagcagtatcgacagaagac

SEQ ID NO: 63807 - DNA, 201 bp, Homo sapiens
ccagtagctgagattacaggtgtgcaccaccatgctgggctaatttttgtatttttagtagagacggagtttcgtcatgttggtcaggctggtcttgaatkcctggcctcatgtgatctgcccagctcaccctcccaaactgctgggattacaggcatgagccactgtgcccagtctaatcttgatttgcaagctggttgc

SEQ ID NO: 63808 - DNA, 201 bp, Homo sapiens
cacctcccagacagacgatgggcagccaggcagaggcgctcctcacttcctagacggggtggcggccaggcagaggtgctcctcacttcccagatggggcrgccaggcagaagggctcctaacctcccagacggggcggctgggcagaggtgctcctcacctcccagatggggcggccgggcagaggggctcctcacctcc

SEQ ID NO: 63809 - DNA, 201 bp, Homo sapiens
cccagacggggcggctgggcagaggcgctcctcacttcccagacggggcggccaggcagaggtgctccacacctcccagacggggcggccgggcagaggcrctcctcacctcccagacggggcggccgggcagaggcgctcctcacatcccagacgatgggcagccgggcagagacgctcctcacctcccagacggggcgg

SEQ ID NO: 63810 - DNA, 201 bp, Homo sapiens
tgacaaaaggaattgttgccacagctccttactacacgggtggctttggctaagcacctaatccctctaagcctcagtatcctcatctgtaaagcagatgygtggattagatgagatagtgcaggtaaagacctagcattgcacatagttggtgttcagtgagggggtggaagataccgagtagaggggacaggaagactt

SEQ ID NO: 63811 - DNA, 201 bp, Homo sapiens
taggtgagggcactgtcgcctgccccaagctaggatgctcaagtgttcttaggaagtggtgcacagactgcctcccacctgggcccctgtaacagaaggcraggccccgggtagggaataaggcagtgggggaggcctgggactgggagaagggtggtcagaggggatgcttggggccccagcacctccctggactgacat

SEQ ID NO: 63812 - DNA, 201 bp, Homo sapiens
tgttttctttttgagacagtttcactcttactgcccaggctggagtgcaatggcgtgatcctggctcactgcaacctccgcctcccaggtttaagtgattstcctgcctcagcctcccaagtagctgggattacaggcgcacaccaccaagcctggctaatttagtatttttatatagagacagggtttcactgtgttggc

SEQ ID NO: 63813 - DNA, 201 bp, Homo sapiens
ggctcccttccctcatgcaagctttgtgtattgccctaggccacgctgatccttttctttttttttttcagtatttattgatcattcttgggtgtttctcrgagagggggatgtggcagggtcataggataatagtggagagaaggtcagcagataaacacgtgaacaaaggtctctggttttcctaggcagaggaccctg

SEQ ID NO: 63814 - DNA, 201 bp, Homo sapiens
gcagtgggtgggaaataggctgacaaaaggaattgttgccacagctccttactacacgggtggctttggctaagcacctaatccctctaagcctcagtatmctcatctgtaaagcagatgcgtggattagatgagatagtgcaggtaaagacctagcattgcacatagttggtgttcagtgagggggtggaagataccgag

SEQ ID NO: 63815 - DNA, 201 bp, Homo sapiens
tgtatggcatgcactcctcaactgtcgtggtgtcattgtccccatatggtagacttggaaagctgggaaggagagaagagtctaaccttgtttcaggttayctgccattgtgccatcaccattgttttcagcagcatttgctagtgattgagacctagctggcacaggctgggggctcagtgtgctaagtctgtggagcca

SEQ ID NO: 63816 - DNA, 201 bp, Homo sapiens
ggtccctccagccctgagtaggacttgattctgtcatttatcaggaggctgtctgcttgacctggggcacccaagaatgtgcgaatgtaatggaagagacmgcggggaagggcggaagctgccgtccagagaatgaatgaggagcccttctcagtttttggtttatctcgttgggcgagcagagctccattctaccttcgt

SEQ ID NO: 63817 - DNA, 201 bp, Homo sapiens
cactgggaagagaggaagaagccaggtggcaggagaggcagcagcagcagctgaactccatcctctgccctggagagccctgagatgtcactgggagcackagcaggaactgctggctttgcactttgccaagtaaggcctttaaaactactataggttgagcatccctaatccaaaaatctgaaatctgaaatgctccaa

SEQ ID NO: 63818 - DNA, 201 bp, Homo sapiens; identical to SEQ ID NO: 39652

SEQ ID NO: 63819 - DNA, 201 bp, Homo sapiens
ggaaggtgatgctaagccctgtgtcctgactcaagcacgctcctgcctgctgctggggggtgaaggctgtgacagagcagcatgtccagggcctggggccyggggaaggcggagctgccggtggcctggagggatggaaaatatgccccaagaaagggcttttgatttgagcctcagcctggcgtgccagtgggggaagca

SEQ ID NO: 63820 - DNA, 201 bp, Homo sapiens
gtggcctctttgtttccatgaagcccaggcctgggtgtggcagggaggtgggaggagagggcgaggttgcacagtctgtctccatcctcaagcccctctcrctctgtgccccatctcaagaaccccagtgttgccctggggccggtacaatccacctccgacaccaagccctgtagtgggctgcggtttccacctctgtga

SEQ ID NO: 63821 - DNA, 201 bp, Homo sapiens
cgtatattgagaatagaagccaatgaaaggttttaagcaatggaattatttcttcagatttgtattttgaaagggtcgtcggttacagtgtggaggatggrttggagacagtaagagttgtcagtatcattgttcaaaggagggtgtgggaaacttagaatcagggtaagtgcctggcctaggattacctggtaggactgc

SEQ ID NO: 63822 - DNA, 201 bp, Homo sapiens
tcgatggttcgctgcgccgcgccggccgctctagcaacccctggctgtcacgctttggtttccgggtcggttctggcaggtctgagcgctccgacttccakaggagcgctgtgcacgtggagaagagcggggactcggcgaccctgccctcccgaccctcatgttcgaagagcctgagtgggccgaggcggccccagtagc

SEQ ID NO: 63823 - DNA, 201 bp, Homo sapiens
actcggcgaccctgccctcccgaccctcatgttcgaagagcctgagtgggccgaggcggccccagtagccgcgggccttgggcccgtaatctcacgacctycgcctgcggcctcctcgcaaaacaaggtgagtgactcgcgggagcaatgggagctgtttcaggccgcgaagcggacattggtggatcccagcgctgtgtg

SEQ ID NO: 63824 - DNA, 201 bp, Homo sapiens
aactgtgaagactgtttccagcctggctgtgagccaagacctggttcctggtggaccctgaggacaaagtgtgataaaacctctggctcagacttgctctrctgaaggcttcttggttataagatgcataaagtcactggggctagctaaacaataaagagtttattgtgagaacatggggatatctgtctcatgacactt

SEQ ID NO: 63825 - DNA, 201 bp, Homo sapiens
cctgcttcctcaggcttttcttacccttcagtctgcctccaacatggaatcggcctgctttgtttcctcctttttcatcccctagccccattaccattgtycaagccgctggcctctctgtctgcaatttctccccttcagtttgttttctacactgcagctagagacatgttaaatatttaatatacgtgtgtgatcatg

SEQ ID NO: 63826 - DNA, 201 bp, Homo sapiens
cagcccgccgccggccccgccccgcccgtggcgctcttgggcagcgcgggcctccgtccctcccctcccaccgcctccctgcccttctagccgcgcctggytaaactcgatggttcgctgcgccgcgccggccgctctagcaacccctggctgtcacgctttggtttccgggtcggttctggcaggtctgagcgctccgac

SEQ ID NO: 63827 - DNA, 201 bp, Homo sapiens
ttgctccccaacggaagtgggagccctgggaagctttgtgagcagaggcagtacatagagggaggtgttttaaggagttgggatgaggatttggttctcaytgggtcttttctgcccctaggacctgaccaacagccatttcttcttgtttgatttccaaaagactgggccccctctggtagggcccaaggctcagctttc

SEQ ID NO: 63828 - DNA, 201 bp, Homo sapiens
actctccacaggttcctctggaggatgagtctgtggatgtggctgtgttttgcctttcactgatgggaaccaacatcagggacttcctagaggaggcaaayagagtactgaagccagggtaagagcccccaggacacagatgcatgtatgtatgtgtgcatgcatgagtctgtgcacttacacagaactttctgtctttct

SEQ ID NO: 63829 - DNA, 201 bp, Homo sapiens
gtttgatttccaaaagactgggccccctctggtagggcccaaggctcagctttcaggcctgcagcttcagccatgtctctacaagcgcaggtgacctctgratcttccttgaaaggggaggcagatctcaaactccaggctcagaactgtgaagactgtttccagcctggctgtgagccaagacctggttcctggtggacc

SEQ ID NO: 63830 - DNA, 201 bp, Homo sapiens
cagaccaggccccagctgaggcccccacagagaagacagaggtgtctcctgttcccaggacagacagccatgaggctcgggcaggggctttgcgagcccgyatggcacagcggctggatggggcccgatttcgctacctcaatgaacagttgtactcagggcccagcagtgctgcacagcgtctcttccaggaagaccctg

SEQ ID NO: 63831 - DNA, 201 bp, Homo sapiens
gtagtactacaaatgatccaccaaagcaaagccctgggtccacttcccctaaaccccctcatacattaagccgcaagcagtggcggaaccggcaaaagaayaagagaagatgtaagaacaagtttcagccacctcaggtgccagaccaggccccagctgaggcccccacagagaagacagaggtgtctcctgttcccagga

SEQ ID NO: 63832 - DNA, 201 bp, Homo sapiens
gttgaccaaacaggtaccattggatgtgtatatgtgtgtgtgttggtgtgtgtgtgtcggggggtcagctggttctacatacaagagtgattatccactgycattaggattggggctaatggtgtactcaggcaataagaagtacttctctgcaggccacagtcacgatctcaaagacagaggtatggctgggatgacttg

SEQ ID NO: 63833 - DNA, 201 bp, Homo sapiens
agaagtacttctctgcaggccacagtcacgatctcaaagacagaggtatggctgggatgacttgccgtgactccgaatgtaagagatcttgcctcatgtgyaccttcccatctccctccctgtaggtcccaaagcctggaagggtagtactacaaatgatccaccaaagcaaagccctgggtccacttcccctaaaccccc

SEQ ID NO: 63834 - DNA, 201 bp, Homo sapiens
tctgaatcaggtccacatctctcccttcttgttctccaggcctcatccattctctttaggcccactgtcatcccctgttttcctccagggctccaagcgcygccagctcttggccacattacgggccctagaggcagcatctctttcccagcatccccccagcctatgtataagtgactctgaggaggaggaggaggaaag

SEQ ID NO: 63835 - DNA, 201 bp, Homo sapiens
aaggaagaagaaatgccacaaacaggctcttgttggcagtgactctgctgaagatgagaaaagaaagaggaaatgccagaaacatgcccctataaattcascccagcacctggacaatgttgaccaaacaggtaccattggatgtgtatatgtgtgtgtgttggtgtgtgtgtgtcggggggtcagctggttctacataca

SEQ ID NO: 63836 - DNA, 201 bp, Homo sapiens
gaggcccccacagagaagacagaggtgtctcctgttcccaggacagacagccatgaggctcgggcaggggctttgcgagcccgcatggcacagcggctggwtggggcccgatttcgctacctcaatgaacagttgtactcagggcccagcagtgctgcacagcgtctcttccaggaagaccctgaggcttttcttctctac

SEQ ID NO: 63837 - DNA, 201 bp, Homo sapiens
ggtgtgtgtgtgtcggggggtcagctggttctacatacaagagtgattatccactgccattaggattggggctaatggtgtactcaggcaataagaagtayttctctgcaggccacagtcacgatctcaaagacagaggtatggctgggatgacttgccgtgactccgaatgtaagagatcttgcctcatgtgcaccttcc

SEQ ID NO: 63838 - DNA, 201 bp, Homo sapiens
ctggcaggcttgactgggaagaattcagatgcttctgccagtctgaatcaggtccacatctctcccttcttgttctccaggcctcatccattctctttagrcccactgtcatcccctgttttcctccagggctccaagcgccgccagctcttggccacattacgggccctagaggcagcatctctttcccagcatcccccc

SEQ ID NO: 63839 - DNA, 201 bp, Homo sapiens
caacctccgtatgctaatctctaacccttccttcccctttcccatcctggtatctcagtgctggctttcttcttctgcactgtgtgccttatacaacactstcactctccacaggttcctctggaggatgagtctgtggatgtggctgtgttttgcctttcactgatgggaaccaacatcagggacttcctagaggaggca

SEQ ID NO: 63840 - DNA, 201 bp, Homo sapiens
gtcagagagagttgttgagtagaagttggtgaagcgaagagggttcttcagacaggaaaaagtacgtacaagggccctgggacaagagagcatgttctgtyagagtcacaaacacaagtggtccttgtggttgaaatacatagtaaatgaaaggggcatatatgctgttcaagttcaagaggtagaagttttgcgtatatt

SEQ ID NO: 63841 - DNA, 201 bp, Homo sapiens
aatatcttcagctttgcaagccagacagtctctgttacaagcgctcgactcccccttgtagcatgaacacagctgtagataatacgtccaggaatgggtgyggctctgtgccaataaaactttattgtccaaaaacaggtgacaggttggtttggctcataggctgtagtctgccacttcctgttttattctaccttctgt

SEQ ID NO: 63842 - DNA, 201 bp, Homo sapiens
ctccccgtcctggggatgggggcggtgtccactgacctaatcaggttcgagctaaagtccctgcgtagctggtcgtctctggcttcctgggcagggtgcarcctcacccccgtgctggtttcctaaggctgctataattaattatcacaaagtgagtggcttaaaacgatgcaagttattatcttacagttctggagatca

SEQ ID NO: 63843 - DNA, 201 bp, Homo sapiens
gtcagcttcctttgctgttcccgggcttccctcagctctatctcaagccatgacctctgcttccatgtctgcagccccatgaggctggggctgctctgtcytgcatatctccagtgcctggcaaggggctggcaagaggtagaggctcattaaatgcctgttaaaaccctaatagtaataataataatggtacagttgtta

SEQ ID NO: 63844 - DNA, 201 bp, Homo sapiens
accatcccttaaaccagaggtcagcaaacttttccccctcaggaacagatggtaaatatcttcagctttgcaagccagacagtctctgttacaagcgctcractcccccttgtagcatgaacacagctgtagataatacgtccaggaatgggtgtggctctgtgccaataaaactttattgtccaaaaacaggtgacaggt

SEQ ID NO: 63845 - DNA, 201 bp, Homo sapiens
tgcttttgggaggacttcattgacctgggcctgcaattggccaacttctttgccttcactaacagctccctgaatccagtaatttatgtctttgtgggccrgctcttcaggaccaaggtctgggaactttataaacaatgcacccctaaaagtcttgctccaatatcttcatcccataggaaagaaatcttccaacttttc

SEQ ID NO: 63846 - DNA, 201 bp, Homo sapiens
gcgatcgtcttcttcaactaccacatcctggcctccctgcgaacgcgggaggaggtcagcaggacaaggtgcgggggccgcaaggatagcaagaccacagygctgatcctcacgctcgtggttgccttcctggtctgctgggccccttaccacttctttgccttcctggaattcttattccaggtgcaagcagtccgaggc

SEQ ID NO: 63847 - DNA, 201 bp, Homo sapiens
acacagaccattaataccatctaacagatgttagttgttatccttatttattactcatgctttcctttctattttttcttttctctctctctctctccttytttttttttttttttttgttgttgttgttgttgagacagggtctcagtccgtcggcccagactgaagtgcagtggcacaatcatagctcgctgcagcctc

SEQ ID NO: 63848 - DNA, 201 bp, Homo sapiens
aacacagaccattaataccatctaacagatgttagttgttatccttatttattactcatgctttcctttctattttttcttttctctctctctctctcctyttttttttttttttttttgttgttgttgttgttgagacagggtctcagtccgtcggcccagactgaagtgcagtggcacaatcatagctcgctgcagcct

SEQ ID NO: 63849 - DNA, 201 bp, Homo sapiens
caggaacagatggtaaatatcttcagctttgcaagccagacagtctctgttacaagcgctcgactcccccttgtagcatgaacacagctgtagataatacrtccaggaatgggtgtggctctgtgccaataaaactttattgtccaaaaacaggtgacaggttggtttggctcataggctgtagtctgccacttcctgttt

SEQ ID NO: 63850 - DNA, 201 bp, Homo sapiens
ggaacacagaccattaataccatctaacagatgttagttgttatccttatttattactcatgctttcctttctattttttcttttctctctctctctctccttttttttttttttttttttgttgttgttgttgttgagacagggtctcagtccgtcggcccagactgaagtgcagtggcacaatcatagctcgctgcagc

SEQ ID NO: 63851 - DNA, 201 bp, Homo sapiens
gagaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatg

SEQ ID NO: 63852 - DNA, 201 bp, Homo sapiens
agaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatgg

SEQ ID NO: 63853 - DNA, 201 bp, Homo sapiens
ttatttattactcatgctttcctttctattttttcttttctctctctctctctccttttttttttttttttttttgttgttgttgttgttgagacagggtytcagtccgtcggcccagactgaagtgcagtggcacaatcatagctcgctgcagcctcgaccttccaggcttaaacgattctcccacctcagcctctcgag

SEQ ID NO: 63854 - DNA, 201 bp, Homo sapiens
ctgccaggaagattaaatgagaaaatacttaaatgtgaaacacttagaatggcgcctggaacacagaccattaataccatctaacagatgttagttgttawccttatttattactcatgctttcctttctattttttcttttctctctctctctctccttttttttttttttttttttgttgttgttgttgttgagacagg

SEQ ID NO: 63855 - DNA, 201 bp, Homo sapiens
aaatgtgaaacacttagaatggcgcctggaacacagaccattaataccatctaacagatgttagttgttatccttatttattactcatgctttcctttctmttttttcttttctctctctctctctccttttttttttttttttttttgttgttgttgttgttgagacagggtctcagtccgtcggcccagactgaagtgc

SEQ ID NO: 63856 - DNA, 201 bp, Homo sapiens
gtccccaccccggccaccacactggtcccagccccaacaggtcagcttcctttgctgttcccgggcttccctcagctctatctcaagccatgacctctgcytccatgtctgcagccccatgaggctggggctgctctgtcctgcatatctccagtgcctggcaaggggctggcaagaggtagaggctcattaaatgcctgt

SEQ ID NO: 63857 - DNA, 201 bp, Homo sapiens
ggaggaaggaaggaaggaaggagggaaggagggtagggagggaaggagagaaggagggaatgaagggaaggaaggaaggaaggggaaaaaatccaacaaartggttatattatattgatggtgttataaagtagttctagataaaaactattttcaaaaaagtctttaaatatatatgcatacacctatgaatattaaagc

SEQ ID NO: 63858 - DNA, 201 bp, Homo sapiens
gaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatggt

SEQ ID NO: 63859 - DNA, 201 bp, Homo sapiens
aggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatggtt

SEQ ID NO: 63860 - DNA, 201 bp, Homo sapiens
cagctgcgtggctatgaacatgagctatggggtgcatgcagaccaaggttcatagtgtacactgtacccaccagctgtagctcctccagcaagcgtgggargccagtcagctgcatggctgtgagcacggcctctggggtccatgcagaccaaggttcctggcgtagcactgtaaccaccacctaggtcttctccgacaag

SEQ ID NO: 63861 - DNA, 201 bp, Homo sapiens
taatgtttgccacgtgcttacaataagtcaggaaccctgccaagcaccgggcgtatattaacctatccaagctggggaagaatgtttaggctctgaagatwgtctggagccgcataaatcccgcagtgtaggcagctgctcattctgcagatagtattctgtggatccctgagttggctgtggccggttttgccagcagga

SEQ ID NO: 63862 - DNA, 201 bp, Homo sapiens
tagagctccaatcctccaaccagagccagctcttccctcaaaatgctacggcctgtgacaatgctccagaagcctgggacctgctgcacagagtgctgccracatttatcatctccatctgtttcttcggcctcctagggaacctttttgtcctgttggtcttcctcctgccccggcggcaactgaacgtggcagaaatct

SEQ ID NO: 63863 - DNA, 201 bp, Homo sapiens
caaggttaattctctgctacacaatagcttttgttggtatctgtgaggctttgcggggttgaaggaatctcaggtgtcacccattaataacaatcatgacrgtgacaactaatgtttgccacgtgcttacaataagtcaggaaccctgccaagcaccgggcgtatattaacctatccaagctggggaagaatgtttaggct

SEQ ID NO: 63864 - DNA, 201 bp, Homo sapiens
gatctgaacatcaccgcctgcatcctgctcctcccccatgaggcctggcactttgcaaggattgtggagttaaatattctgggtttcctcctaccactggytgcgatcgtcttcttcaactaccacatcctggcctccctgcgaacgcgggaggaggtcagcaggacaaggtgcgggggccgcaaggatagcaagaccaca

SEQ ID NO: 63865 - DNA, 201 bp, Homo sapiens
atataatttaaagcaaccacatctccacagcacttcccagaagagaaaactcctccaaaagcagctctcactatcagaaaacccaactacagttgtgaacrccttcattttctgcctgagtaagtaaatgaccaccttttttttttcttttatgagagtacaatatgagaggaaatctgtgtctcttagaaaaacaaaaaa

SEQ ID NO: 63866 - DNA, 201 bp, Homo sapiens
gagtgacatgacagaatgtcagagctagaagggcctcttgaggacatcatgtcttccttagatgaggaaagtcaggctcagagacatgaactgactctccygaggttacacagccaaatatgctcttccaaggttaattctctgctacacaatagcttttgttggtatctgtgaggctttgcggggttgaaggaatctcag

SEQ ID NO: 63867 - DNA, 201 bp, Homo sapiens
gccctcccgtgatcccacaagagagacacgattctctccaatgtttaaaaaggaaagtaaaagtcaatggttctaagtagctcacactgagtgattgtacygggatttggactcaggcaccatcccttaaaccagaggtcagcaaacttttccccctcaggaacagatggtaaatatcttcagctttgcaagccagacagt

SEQ ID NO: 63868 - DNA, 201 bp, Homo sapiens
ctgaaaatcacggtgttactacctccaaaacacctctagagtttgatcacttgatcacttctcaccacctgccctgctactctccccagctgtcacccgcyagcatgtttatttagtgtgtgtattgtttatcaacttcttcctcctgctaggcttatacgcacactgagagcagggatttttgcctgctgtattcactgc

SEQ ID NO: 63869 - DNA, 201 bp, Homo sapiens
tgaatcagactgcctgggtttgaatccaggccctactgaccagctgtgtgacctcagacaggcgactccgggtctcagcactcaattttctaattggccarctggagatgacaatggcccctaccttgaatggctgccaggaagattaaatgagaaaatacttaaatgtgaaacacttagaatggcgcctggaacacagac

SEQ ID NO: 63870 - DNA, 201 bp, Homo sapiens
tttttgtgttttcagtagagacaaagtttcaccatgttggccaggttggtcttgaactcctgacctcatgtgatccacctgcctcagcctcccaaagtgcwgggattacaggcatgagccacaccgtgcccagcccacacgtatttttttttaaccagattaaacctttcaaataagttgtacctacttataagttttgaa

SEQ ID NO: 63871 - DNA, 201 bp, Homo sapiens
ttgcaaggattgtggagttaaatattctgggtttcctcctaccactggctgcgatcgtcttcttcaactaccacatcctggcctccctgcgaacgcgggargaggtcagcaggacaaggtgcgggggccgcaaggatagcaagaccacagcgctgatcctcacgctcgtggttgccttcctggtctgctgggccccttacc

SEQ ID NO: 63872 - DNA, 201 bp, Homo sapiens; identical to SEQ ID NO: 19047

SEQ ID NO: 63873 - DNA, 201 bp, Homo sapiens
tggaccatatcttttaccatcatggcctttttaaaaaaactttacttctcttatttttacgttttttcaagatggttaaaaacattttctttaattgacawattataattgtacatattcatgacatatatcaagttgtttttttttttttgagacaaagtctagtactgttacccaggctggtgtgcagtggctcaatca

SEQ ID NO: 63874 - DNA, 201 bp, Homo sapiens
tacgcattatcccgtgagctgtggaaagacgtgtgagcgaaagaaacctacacagtgtagaattccacttatatgaagtttaagaataggcagaactaatyggtaatagaagttgaaatgtgggctactgggggaaggactggttgtgaaagggttcgtcaggactgctggcaaggactggtgtgtttgctgccttctgca

SEQ ID NO: 63875 - DNA, 201 bp, Homo sapiens
tgagattttatgaccgaagacttaacagctaaacatggtattctttctgatggtgcgggaaataatagactcactgtcttagttttgctaatgttgcctgyctttaaacttcataatgccttttataatacctctatggtgaattttaaatgagaacagtatttaccaagcatttttctggaatttcaccaagcaaaaata

SEQ ID NO: 63876 - DNA, 201 bp, Homo sapiens
tttctatatttatttgtaatggacttagaaactctcacattgtatttctcagcagaaagagagggcataaaaaacagcagttattttattttgcctttgcrtgcttgaaagttttaatttctttaattcagagcatatatccataattcagaaatagagcttttcttttccctgattctttatccaatggaacacccactt

SEQ ID NO: 63877 - DNA, 201 bp, Homo sapiens
gaagggatcctcccacctgagcctcctgagtatctggggactacaggcttgcgccacggtgcccagctaatttttatattgttttgtagagacaaggtttygccatgttttccaggctggtctcgaactcctgggatcaagcaatccacctgccttggcctcccaaagtgctaggattataggcatgagccactacgccca

SEQ ID NO: 63878 - DNA, 201 bp, Homo sapiens
tacacctccctgctgtaggtgagaacagtaatttggctgtatctagaacaacccagggacagtgttgcggattttctctttgattggtaccttttgaacamtctttgagcgtggggaatagagaaaaggagggaatatgaataactggaaactgcttccctcaagtaactgagcttcctgaggtggaggagcagagccagt

SEQ ID NO: 63879 - DNA, 201 bp, Homo sapiens
gaaagagatttattgagacgaatcaatctttctgtgtgtcacacacacacacacgtatacacgtacaggcacgcacacacatcatatcacacagtcacacrgtcacacacaagtctcactgatctagtgccttttcttttttggtagttacctgttatcaagcaccactgacgtgtgaagaacgtcgttaggtgctgggat

SEQ ID NO: 63880 - DNA, 201 bp, Homo sapiens
gtctgttccaaggggatggaaacctgggtagaagcttcagaaatgaggattgtaacctgacctaagacctgtgcagatgctcttccctgggagctcagggyggcatcctctgtgtagcacctgccatgtgttgaggcctaggctgtatgtcctcaaggagcctgttacctgaagggatgctggtatgtgagcacgtctttt

SEQ ID NO: 63881 - DNA, 201 bp, Homo sapiens
ttgattctaataaattataatcctataattcagttcgttgccgttttaatgggacattttactagtaatgttaaaatattcattttatttgtcaaatttcrgggtaatatgtttgagggttcccttctcagaggatacaaaaaagggttacttagattttgagagctatagctctttctcagtgactgtatattataaaca

SEQ ID NO: 63882 - DNA, 201 bp, Homo sapiens
gatgcacatgacctttatttattattattattatttttgagatagggtctcgctttgtcacctaggctggagtacactggcaccatcatagctcactacarccttgatctcccaggctcaaatgattctcccacaggtgtgcaccactacatctggctaatttttttttttttttttttttttgtagtgatggggttttgc

SEQ ID NO: 63883 - DNA, 201 bp, Homo sapiens
ttgcagaggtgcagagaagagaagattgtgactagggggaccaggtagactttaaggggattcctggacagcatttttagagagaaccaagagttagtgartaagtgactaaaatattacagtcaaggggtgaacgggggaggcagagataggaggtacatgatgacgtctgtagagggactgggagcccttggtgttgct

SEQ ID NO: 63884 - DNA, 201 bp, Homo sapiens
acgcaggtgtttgcatgggagtagaggcacccataggggcatggaatacagacttaaagggcaaacagttaccatggagtcccaagtgatataacttgggsctggcatcctaaccaaggaaggttaggcaatgcccgctgtgggctgagcacggtaagacttttcttactttctattatataaggaggtgtctgaaactat

SEQ ID NO: 63885 - DNA, 201 bp, Homo sapiens
taattttacattttttgttttgtttttcttcagagttattttaaattgacggtaagcttgaaatttaagaaatcttcaaatagcttttaatatctgactgyagtgtttttcttcttctttttttgaatgagatcatttgttcccaaactcaattgattattagagttctttttaataaaattaaagcaataatgcttggct

SEQ ID NO: 63886 - DNA, 201 bp, Homo sapiens
atgaagagctctgtcttagtccagcacctggcagagggtaaatactgagctccagggaacagctgctgttacatcaatgagcaactggagttgggtggatmgctgagagaagactttggaggaggtgaggggctgcaggcagagcgaatagagcctgttttgtagctgttggtgggcaccctgtgagggccggtgcagaac

SEQ ID NO: 63887 - DNA, 201 bp, Homo sapiens
ttcgcaatttttatctgtgatttcccatttaaaatagttttcttgggggcctgtaccaaactctgcatgtgaactgaaacctattttgttttctccccccscgatctgcctgctggctcggaggtctacaggccatggcttgcagcccctgtctctgggtactttgggagtgacagcaagcacaattcagttctgtgcatc

SEQ ID NO: 63888 - DNA, 201 bp, Homo sapiens
gaacaaacaaaaccgaaccggccactcctccccaccgcccacagatagaagctggtatttttcttttactgcattgactaatactgaaaactgggagcttsaatcttataccattttcaaaagccacagtgaactacatgtgtttgctaagccataattccagcctcaacattcattttcttatcttattgtaccacagac

SEQ ID NO: 63889 - DNA, 201 bp, Homo sapiens
cctcattcgcaatttttatctgtgatttcccatttaaaatagttttcttgggggcctgtaccaaactctgcatgtgaactgaaacctattttgttttctcmccccccgatctgcctgctggctcggaggtctacaggccatggcttgcagcccctgtctctgggtactttgggagtgacagcaagcacaattcagttctgt

SEQ ID NO: 63890 - DNA, 201 bp, Homo sapiens
agttgaagacgccaaaggatcttcttcagacagcactgctggagttaaggagtagctcgaggtgaagctggatgggggatccagtggagcaggagttgacrgacagtccgttcacatcgctgtgtttccttgttaacatttttctttctgcagagaggaagatatgtttttgctgctttatataaaaatggtttttttaag

SEQ ID NO: 63891 - DNA, 201 bp, Homo sapiens
aggaacaaacaaaaccgaaccggccactcctccccaccgcccacagatagaagctggtatttttcttttactgcattgactaatactgaaaactgggagcktgaatcttataccattttcaaaagccacagtgaactacatgtgtttgctaagccataattccagcctcaacattcattttcttatcttattgtaccacag

SEQ ID NO: 63892 - DNA, 201 bp, Homo sapiens
ctgcctcgctaggcttccctagagaccccctctccagccgggttcccttcctcactgtgcttccctcacgcttctagtcctgtccctgtctttgaatgccscccccccccgccattcttcacacatccatgtcccttactttctttgagacctattgttaaaagcacttgcaagcaagcattatctcatagggtctttacc

SEQ ID NO: 63893 - DNA, 201 bp, Homo sapiens
ctcagcctcccgggttcaagcaattctcctgcctcagcctcctgagtagctgggataacaggtgcccaccaccacgcccagctaattttttgtatttttartagagacggggcttcaccatgttggccaggctagtctcgaactcctgatctctggtgatccacccacctcggcctcccaaagtgctgggattacaggcat

SEQ ID NO: 63894 - DNA, 201 bp, Homo sapiens
aatctatgtaattaaaaaaaaatctagagtaaaatttgctctactatagtttttgtaggtgaaaaagaacgaacttttcttccagagactacaaagcagakttttttttttcccatttgagaacctctagatactaatactacacatttctttttctggaagaaaacttcatgtaaggtaagatcttagcctctgaagact

SEQ ID NO: 63895 - DNA, 201 bp, Homo sapiens
cgacttggcgtgaatgagctttggctgtttctttgtattaactggtccatttacttcagtattaactaagtagtgcagctttgcttcaaaatttgatgagwttttcaatggctgtgagtcactaaaatactctgttcatatagatggaaccattttttgtcaatttgtttaagagccaggtgtcttcataaccccctgaaa

SEQ ID NO: 63896 - DNA, 201 bp, Homo sapiens
gccttgacctcctgggctcaagtgatcttcccacttcattctcctgagtagctgggactacaggcctgtgtcaccacgcccagctaatttttttgtagagrtgaggttttgccatgttgcccaggctggtcttgaactcttgggctcgagagatcctcccacctctgcctaccaaagtgctgggattataggcgtgagcca

SEQ ID NO: 63897 - DNA, 201 bp, Homo sapiens
taggtgggcagtctcttctgttatgacgaggcaaaaccaaattcccacagaggatggttcccgcgtgaccctggctctgattcctttatgggatatgtgtraccacaccaacggcctggtaacgacctcttcccctgtgttgtgttgaatctgggaggctgttgttgctaagctttgggagggggctgttattccacctac

SEQ ID NO: 63898 - DNA, 201 bp, Homo sapiens
agactatgttagtgtaaaatggggactttttttgaacggagagatttaattcactgcacagtgtaataaaaaagtcacattttacatttcttacaattcayagaggatttctgatcagaaaggagttttatggtttgcttttcaatgaggcttaaaataggtgcagagtcagcatttgggcaaaagagggttgggttgggg

SEQ ID NO: 63899 - DNA, 201 bp, Homo sapiens
gtgaccgttaaagcatccaaacagagctcatctttcagaagttatcaggagcagcttggataagtatcagcattttcatagccatgtagaaattgccattracctgtcatggcaggggattagctgaggtagccaaatgctacttgagattaacattagtgttgggtggtcctatggatttttcttttcttatttaaaaaa

SEQ ID NO: 63900 - DNA, 201 bp, Homo sapiens
catcatcatacctgggaagcctggggaggaggaagttgtattattatggtcccccacagctgggaagaggtggaggcaggctctgtttctccacattcttyggattccgggcagcagcataggtgaagcgctctgtgctctgtgagagggttgtctgataaagatttcctgatattagtaggcagaaataagatacatttc

SEQ ID NO: 63901 - DNA, 201 bp, Homo sapiens
ttagcatctgtaataaccttgagtttgaccctttcttactgactttgttgggcgtgagggttgcatggaagagtctagagtttcccttaatgccacagggsacatttcggtagagcctcaaagtatgtgaaaaatcttgccaggagaagacaaggggacaggcagtgggatagctgcattccagaaaaagggaggaacatg

SEQ ID NO: 63902 - DNA, 201 bp, Homo sapiens
caccctccgtgcacacaggtctgactcacctctggttccctgctattcttcagacaccagaagattccttcgctcttgctgtcgcctctgcctaagacccyccattccttaggcacttacgggactcactcatagacctcctccagcgtggctgccctgagcaccctatgtggaatgactacgcctccagctcatccgccc

SEQ ID NO: 63903 - DNA, 201 bp, Homo sapiens
gagcaggaggggaggggtatgactgaagacctttagcatagggaggagcttgagcaggagctagggagagagggtggagggcactgggctctgtaccctcyggggtgagcacacactgtggtggccagaatgaggtgcagggataatttgcaggccctgtttgctggaggaaagctcaggagggcacctgctgcaggagct

SEQ ID NO: 63904 - DNA, 201 bp, Homo sapiens
ttggggctgattgagatctgatgcggagccggtgtgctcagtcagtgtgctgtgtcctccacagccgcttcatagtcagaattcatgccgtgggcgtctgygcaccagaggtcatgagttttggtctggagagattgggactgtttaaaatgcctgggggctttcttaccatgatttctctcactttagatacattttcct

SEQ ID NO: 63905 - DNA, 201 bp, Homo sapiens
gtcctccacagccgcttcatagtcagaattcatgccgtgggcgtctgcgcaccagaggtcatgagttttggtctggagagattgggactgtttaaaatgcytgggggctttcttaccatgatttctctcactttagatacattttccttagccacgactccatcacccagtcctggccactcttctttcttccaaagggtc

SEQ ID NO: 63906 - DNA, 201 bp, Homo sapiens
ggacatttcctggcgttgacgcctgtacctttcctagcttgttgatgtataccaggaggaagcatgtgattgccacctctcgtatcagctttacacctgarataccttaccaaaaatattaaatagtctgtaaagcttagtgttaatttctaaaaggcaatagcattgtagtacttgagtttccgactctagaagccccag

SEQ ID NO: 63907 - DNA, 201 bp, Homo sapiens
gcacaagctcccattgccacgttccactcctgagtcctccagccagggctcactgaccgcagtgagacttagattcgctctctgagctgttccagtgaatygccctcccctgcgcatgatgtagacaccggaggctgtgtgtattgctcctgaccctgtcccctactggctctactggaaattactgggtatttccacttc

SEQ ID NO: 63908 - DNA, 201 bp, Homo sapiens
ccacctctcgtatcagctttacacctgagataccttaccaaaaatattaaatagtctgtaaagcttagtgttaatttctaaaaggcaatagcattgtagtrcttgagtttccgactctagaagccccagagccttctagaactttgatgaccaatttgtccatagaattatcttcttataggattaaaagtttccaagcct

SEQ ID NO: 63909 - DNA, 201 bp, Homo sapiens
tttcagttcagacaggtttattttattctttggaatatatatttgaaaccttttgtatgcagaagtcaagcctagagcaaatttttattcttaaattatargcttgtgaaagtgaaggttttaatggaagtgctcacccaaccttaaccgtagtgacacacacatggtagcatgtctgaacgaaaagctgtcagaaagagc

SEQ ID NO: 63910 - DNA, 201 bp, Homo sapiens
tcatttacttgtgaaaagaatggtactaaattgtccaaagtccctgcttaaaaatttagcagctgttttttctgtcatttctccattgacagacttggtcrttaaggttattggatcaaaaagagatgaagtatgcttccagttgagaacagcctctgcatgacataaaaatggcgcccacaagaacggaactgttttgat

SEQ ID NO: 63911 - DNA, 201 bp, Homo sapiens
tggcttctcatgaatgggcatgtgggctgacctgagggactgcttatgtacagttagctggtatctaaatgcaggtactgcctcaagtgaatgtaggtgaygtagtgacaaaggaagaatttcagttaatgtagatgtgaaatggagtttctttgagtgactgaagtgttgagccaagttacattgaggcttttgaaatag

SEQ ID NO: 63912 - DNA, 201 bp, Homo sapiens
ttgtgggatggcagttgctttgctgtgtgagaatgaccctggcaaggggatcagttgctctaggtttagacgctagggtcttgttttaaaatccctactaytgtaatcccagcactttgggaggctgaggtgggcagatcacctgaggtcgggagttcaagaccagcctggccaacaatggagaaaccccgtctctactaa

SEQ ID NO: 63913 - DNA, 201 bp, Homo sapiens
ggcagattccagcccatcttgactaatagtcatatgtttgtgtgaatttttttgagaagtacacccagaagttcataattaaaatttttttttctttgctkcttagaggcttaaaacacacatttattatctcacagtttgtgtgggtcagaaaggcaggcatggcttagttgggctgtctgctgcagggtctctctcaaa

SEQ ID NO: 63914 - DNA, 201 bp, Homo sapiens
ataggcgtgagccactgcacctggctgtgtatctgatttttacatgctgtagtttgagagttcttggtttaaggaagtgaaatatctattaagtgcctctmcttgttttagcaagttagtgtaatttggtaactttttaaaattatgaatttgaattggtgcaattagtgccttggctgtagctgtggtcactgcgttgcc

SEQ ID NO: 63915 - DNA, 201 bp, Homo sapiens
tgggggggcggattattccaataattggattattattccagtctggaaagttgtgaaaatgtgtatgtttgggggaggagggtttgaactgttttccacaycaagttttttttagggattaataatctaagattacctctaggttaatacaacagcttgttttttttagaaattaaaaggtaaataggaaaaataatggtc

SEQ ID NO: 63916 - DNA, 201 bp, Homo sapiens
tcttcccacctaatgattggaagcctgaggcctaccaacactggttgtgagtgactttcaccattttctcatgaatgtcttctcgttagctgattccagaycccttcctggctgtaagtgcatcctgtggtgaggagaaggtattttagagcacttttttggtcactggcatttaacacataccccttctttttaagaacc

SEQ ID NO: 63917 - DNA, 201 bp, Homo sapiens
cccatgtcccaaatttaacctgcagctcctcctatgtatttggacaaagccagcaaaataactatacttttaaaaggccaaaaaataaaacctttacatgygtatgttttatcagtgcaagggaatagtattttgaatattagcgataacagtgaacctttggagctctcataaatgggttggttttgagccgaactcatg

SEQ ID NO: 63918 - DNA, 201 bp, Homo sapiens
tgctgttacatcaatgagcaactggagttgggtggatcgctgagagaagactttggaggaggtgaggggctgcaggcagagcgaatagagcctgttttgtrgctgttggtgggcaccctgtgagggccggtgcagaacagccctgtcccaggctcacttactgttaagagaagggaaagggtcttggagctcctcatcaaa

SEQ ID NO: 63919 - DNA, 201 bp, Homo sapiens
catgcctcacaggattttgagatttacctaaagataaggaggtggactcatggtttggattttgtaacttactggaggtgagtgggtggaggactggcggygtgggtatgcctactagtgtctgaaatggatgactatgaggctgaaggtactaggagctcactgaaatggcaataccagtggcaatagggagaggagaga

SEQ ID NO: 63920 - DNA, 201 bp, Homo sapiens
gttttcaaacaggttccttcataatgggtttatttgcactaaataggagtctgtgctaatcctttgtcaccaagtgggtagcgccttagtttctcttctgygtagatactgtttactatacctgacactgagggtaaagcatttgccagttctcaaggagtgaataggaagttccgtctttgaatattcctcattctggtc

SEQ ID NO: 63921 - DNA, 201 bp, Homo sapiens
gtttgtcagaactcagaaccggacactgaaaagtgtgaattttatcttatgtaaaatatacctctccctctcccgtttttcttcttgaaatgaccttgccrgtatttcaaaactgaactaaccagtaataatctcggagaagtgtttattattttaagcgaatacatttaacccaagaatatagcaaaataaagcagtctt

SEQ ID NO: 63922 - DNA, 201 bp, Homo sapiens
gtgaacatgagaggtggcatgtttgacttttaaggagaaaactgctctgtaaatcatagtagtggtaatagaagctctctgccctttgccatcgtattacytaatagtacctaatagtcaatatttatattacctagtgtcagtatatatttcactgtaactgacagggagtttaggattttaattcttcttccctgtcac

SEQ ID NO: 63923 - DNA, 201 bp, Homo sapiens
tgctgtggtaagatggccacaggcgcctgagctatgtgccacacccagcttcctcatagtaaagttcctgttcccctccttttattcatccaaacagaatrgttttttctatgcatgtcttttcatctttttgactacataggacatgctgaaaagttcagaaattaatataacagatgtccaagaatctgctaccccagc

SEQ ID NO: 63924 - DNA, 201 bp, Homo sapiens
ctgagggtaaagcatttgccagttctcaaggagtgaataggaagttccgtctttgaatattcctcattctggtcattttcgccatttagcaggtatcttcrcatatccagcatgccctcttcacatatcaggttgactgttaattatgctgtggtaagatggccacaggcgcctgagctatgtgccacacccagcttcctc

SEQ ID NO: 63925 - DNA, 201 bp, Homo sapiens
ataagtgactaaaatattacagtcaaggggtgaacgggggaggcagagataggaggtacatgatgacgtctgtagagggactgggagcccttggtgttgcygggagggtgttttacatatttttgctggtttccttttattccagggtgactgaccctgtatattttacactgatttttaggagacttattagattaacat

SEQ ID NO: 63926 - DNA, 201 bp, Homo sapiens
tcagtctgaatatttgaaaaaagtaccatgatttagaaatcaaactggttacttttatgtcaaaagtatgaaactgagaagagcaaaatgtgtctggtcasacatataagttcttttattttatatcagacttttttttccttttgtgagacagggtcttgctgtgtcacccaggctagagtgtagtggcatgatgatggc

SEQ ID NO: 63927 - DNA, 201 bp, Homo sapiens
cctgagtatctggggactacaggcttgcgccacggtgcccagctaatttttatattgttttgtagagacaaggttttgccatgttttccaggctggtctcraactcctgggatcaagcaatccacctgccttggcctcccaaagtgctaggattataggcatgagccactacgcccagcctatgcagtttgtattttatac

SEQ ID NO: 63928 - DNA, 201 bp, Homo sapiens
tttttttccttttgtgagacagggtcttgctgtgtcacccaggctagagtgtagtggcatgatgatggctcactgcagcctcgacctccgggctcaagcartcctcccacctcagcctccccagtagctgggactacaggcatgtgccaccacgcctggctaatttttcgtattttttgtagagatggagtttcgccacgt

SEQ ID NO: 63929 - DNA, 201 bp, Homo sapiens
tttgtgtatttaattctgaatgtagtaatctgatcctgatggccggcaaagtattttagtaagagtgagaaaagagtatttcctattcttcctacatgaasattaggccctcacactctctcgagtgtgctttacagctgagagcctgaggtggaggaagccatccttaggaccattccctcccttagtcaacccagctgt

SEQ ID NO: 63930 - DNA, 201 bp, Homo sapiens
aattaaaatacgtaaaaataacaaaaacaacactttcccacttcctagagtatgaaaacaggcaggatgtgcaaagttcccagttgatcgggtaatgcgargtttcattttattgcaagtgaaggaactttagcaaaactaacacttaattggcagccttttgtaatacataatttgcctaaaattgcgcactgagcacaa

SEQ ID NO: 63931 - DNA, 201 bp, Homo sapiens
cttatgttagtatttcttagagtgttttctactaaaacaaaactcctggtggccaaaaataacattcctgcaagtctaggggctaaacccatagtgactcrtcacaagctcaaagttgctgtcaagcctgggcaacccatctctacaaaaaattagccaggtgtggtggcatacacctgtcgtcccagctactcgggaggc

SEQ ID NO: 63932 - DNA, 201 bp, Homo sapiens
gagggttcatgacaaagcaaaacacacttaagcaaaaattatctttttaaaaaattgtcttttgagtctagctgtttttctagttttagaatgttctcatyggttctaaaagtcttaagtaataaattggagtgaacacaaatgtaaacattgcattgctgttgttttataaaagtgtcgtattttctcatctcagtacca

SEQ ID NO: 63933 - DNA, 201 bp, Homo sapiens
atagaaatctctataaggctccaagtatttgaattacctgtgatgacacctttctgtattttggtggtgtggccaccgttatctttcatttgcagttgaayagcagtcagaaggaacagggccagtaccacagtccccaccaggactgagaggcagtgtggctccttctcctgattctgcacaatctgaatcactcaagag

SEQ ID NO: 63934 - DNA, 201 bp, Homo sapiens
agttgttgaatatagcacatttatcttgctgaagatcacgaaaggctttagttgattactgtcttgtcctaaaggctatgggaccatgttgcatcatcttygtgtttgagattagattctcaggaaatgtgcaggaatgagggaatgaattcactgggctcatagaaaagctagggcagtcttaggaatattagtcaaatt

SEQ ID NO: 63935 - DNA, 201 bp, Homo sapiens
tttttctctctttggtggtggttgcctaaaaactagaaaaataatttcctgtgctctgtcctcccagcagatttccttgatccaggaccttttagtgtggrcacttagttcagatcaccttctgtctttaacttgcttttatagtttgtttaaaacaaaagtcttgggctgggtgcagtggctcacgcctgtaatcccaac

SEQ ID NO: 63936 - DNA, 201 bp, Homo sapiens
agccttaaagcatatctaatgcaataagttactctgtgtataaatttttcaagaaaatgagggttaatttttttctatatatgttagtgtaaaatattgayagttaatttagcaaattataacatttatgtttttcaacgtgtactgtgtattaattttaatttgttctcagtgaaagtttctcatagaaatctctataag

SEQ ID NO: 63937 - DNA, 201 bp, Homo sapiens
caaataccaaagttaagactttgcaattttttttttcttctatcaagtactttccaagtagaagtgaactagtgagtccaaacagtcttggttgacaatgraagacacatctatctttgaagttaagattttgaaagggatctactgattactaagccaaagtgaatcattagccttttgcaagcctaacctcagtactgg

SEQ ID NO: 63938 - DNA, 201 bp, Homo sapiens
aaacagaggccagggaagaagagagggctcatggtggaaggccgaacttggcatttaaaactgttgcaactttaaccctagaaaaatactagcagatcagracataccaaagttcagctgtaagttgagacttttgcttggaaatggatgaccagttttgtgatagaaataagtggaaaagtagggtttggcttaaaccct

SEQ ID NO: 63939 - DNA, 201 bp, Homo sapiens
ctctcttgggtaagttaagtgggggatgtttttatgatgccccagggtttgtctgctttgagaagtgtacctgccttgtacttctcacattcattatcatrgctgtcatatgtctgtcttttaaaaataaaccaaccccagaacagcaacaacaaagtccaaatcctctttcttgtgcagactagtaggttaagttgaaag

SEQ ID NO: 63940 - DNA, 201 bp, Homo sapiens
gttgaatctgggaggctgttgttgctaagctttgggagggggctgttattccacctacccatcgtactccccccgttgcctccctccaaaaggaacaaacraaaccgaaccggccactcctccccaccgcccacagatagaagctggtatttttcttttactgcattgactaatactgaaaactgggagcttgaatcttat

SEQ ID NO: 63941 - DNA, 201 bp, Homo sapiens
aggtatgattacttttattttactgaggaactgagactccctgaagtttcacagccaggaagtggctaggttggggctgattgagatctgatgcggagcckgtgtgctcagtcagtgtgctgtgtcctccacagccgcttcatagtcagaattcatgccgtgggcgtctgcgcaccagaggtcatgagttttggtctggag

SEQ ID NO: 63942 - DNA, 201 bp, Homo sapiens
cctaattttaaatgttggctctgattttaaagtggtgcatttgattccagccttggtaatggagagtttgcaaacacacagcggcccacagcttcacgtgktggtgtgcagtgtgaggcagctccttggctttcctggttttcacaacaagctagagattttcaaagctacacttttgagtaaaaacccttattaaaagaa

SEQ ID NO: 63943 - DNA, 201 bp, Homo sapiens
taggcatctgccagtgccttgcttagagcgagataatcccttctgcacctgccgtgtacaaagcgattatggcagaaactaaagactaataacagctgacrcctactgactgcttactgtttgctgagaatgttccactgagcacagaaaccttaggcacttgctccaggtcttccaggttcagagctggcgctgggcttt

SEQ ID NO: 63944 - DNA, 201 bp, Homo sapiens
gtgggtgcttggtctcagacagtttggaaagttgggaaaattgcacagcttcacccttgcaacctataccaaacaggtgtatcaatactttcagctatttmgtgtctaaatgtaaagtagcactaagcctctgccctgccctgtgttaagaatacatgccaagtttgtctaatgcccttttcttttttctttactgcatct

SEQ ID NO: 63945 - DNA, 201 bp, Homo sapiens
atcctcccacctctgcctaccaaagtgctgggattataggcgtgagccactgcacctggctgtgtatctgatttttacatgctgtagtttgagagttcttrgtttaaggaagtgaaatatctattaagtgcctctccttgttttagcaagttagtgtaatttggtaactttttaaaattatgaatttgaattggtgcaatt

SEQ ID NO: 63946 - DNA, 201 bp, Homo sapiens
agtcccgggtctgccatcagcttcctgtgaaatcccaggcaaggtgcttgggatttcccatggagcaaaatgcaggagttagactagctcgccagagtttyttccagctctaaaacgtcttcagcatttgtccagagagtgtgatcagttgcttatgatacagttatggttaatgggaaatgattattttaaggcaaagtg

SEQ ID NO: 63947 - DNA, 201 bp, Homo sapiens
tcatgatcttagccccttgtctctggagaatcaaagccagactcctctggcagtgactatcaccctgtcttgagtggctgcctcgctaggcttccctagakaccccctctccagccgggttcccttcctcactgtgcttccctcacgcttctagtcctgtccctgtctttgaatgccgcccccccccgccattcttcacac

SEQ ID NO: 63948 - DNA, 201 bp, Homo sapiens
tagtctgcacagtgaaatctatgtaattaaaaaaaaatctagagtaaaatttgctctactatagtttttgtaggtgaaaaagaacgaacttttcttccagrgactacaaagcagatttttttttttcccatttgagaacctctagatactaatactacacatttctttttctggaagaaaacttcatgtaaggtaagatct

SEQ ID NO: 63949 - DNA, 201 bp, Homo sapiens
gctaacatctcagtgcttttttttcctggaattggagtggtgttggatttgaagattagaacgtcttatgtctgtatgtacggttatagcgaaagcttctygtaagagcacagtgactgtcagtaagaaagtgatggctgctgcgctgctcttccgtgccgtggacatttaggccacattttaaatgataattaagctttt

SEQ ID NO: 63950 - DNA, 201 bp, Homo sapiens
tacaaggcggtcagtttcataggccggaggtgttgaggttgatgagccgtgaatctagatttaatccttgcattctatggtcatgggaactgggtagataytatggggcatagaagggaaagaatgatgtctgttttcaggttgttcatctaggttggctggaggacttttccagtgaggtaagcagcattcttcacagtg

SEQ ID NO: 63951 - DNA, 201 bp, Homo sapiens
tgtagtctgaaggagtaaaatggttgcttctccagtgtgctaacatctcagtgcttttttttcctggaattggagtggtgttggatttgaagattagaacrtcttatgtctgtatgtacggttatagcgaaagcttctcgtaagagcacagtgactgtcagtaagaaagtgatggctgctgcgctgctcttccgtgccgtg

SEQ ID NO: 63952 - DNA, 201 bp, Homo sapiens
atgacgcttctgccactgccactgccactgtgacagtggattcagtaagagtgactctccctggtgcagtgtcggctctcttctcaggctttgatccttaycctgtgagggagtttcagtcctcatttttcaaatggggaatgggagaagttgagcagcctgccagaggcttatggtacctgcacttggaactggactcca

SEQ ID NO: 63953 - DNA, 201 bp, Homo sapiens
gggtcgcgctcccatttccttccttcctcccgtcaccccgctgctcggggaaggctgtgcggttttatgttcctctctgcgagttctcggtgcccaccagsgtgcccggggaccagcccccgcctcctcccgcgccgtccagttaggaagacggacgtaggaaataggtcgtctttcttcccacgcgcccctggccgtgct

SEQ ID NO: 63954 - DNA, 201 bp, Homo sapiens
ctcgcgcctgctctcgggtggggcccgggcccctcgcgctagtcggctcggctctgcgcgcggccgggtcgcgctcccatttccttccttcctcccgtcamcccgctgctcggggaaggctgtgcggttttatgttcctctctgcgagttctcggtgcccaccagggtgcccggggaccagcccccgcctcctcccgcgcc

SEQ ID NO: 63955 - DNA, 201 bp, Homo sapiens
tttcttcgaatttgagagcctgagtattggtgaggcttggctgccagtattcatttgggatatttgccaaggaggattagataactttctgcatttgcatsgcatattacctctacctggaattgatatggcctgaacactgtttttgaatattttttgcttcatttgagtccttacgagcttgcagtccactccaggtgg

SEQ ID NO: 63956 - DNA, 201 bp, Homo sapiens
ccgctgccctgtcccctctggcgcccacgctcccgggccccgcgccacccggtctcgaggtggtgccaggtgcaggcagcgctctccccgagcttgccccsctgtccccggccctcgcgcctgctctcgggtggggcccgggcccctcgcgctagtcggctcggctctgcgcgcggccgggtcgcgctcccatttccttcc

SEQ ID NO: 63957 - DNA, 201 bp, Homo sapiens
gtgctcaagcagttctttgccccattttccaaagcattcagatgccaccttttgagtaccttgggatcccctttttcctctgattgccagaaacaagcttrtagattaagtgagatgtgcgtgtgtttgcctcaccatcatttccttcctcctccccgggctagatcactactggttacaacctggaagatgaccgctgtg

SEQ ID NO: 63958 - DNA, 201 bp, Homo sapiens
gagagacgtgtgaatgatatgtgtcctaaaagtagctcttgttttctaaaacgtggattaatataggtctgtccgttacttttgatggaaaaagagaagaytactttcctgatctaatgaaatgggcctctgaaaatggggcttctgtcgagggttttgaaatggttaacttcaaagaagagggctttggtttgagagcaa

SEQ ID NO: 63959 - DNA, 201 bp, Homo sapiens
tttatggcactcgatccaacgcagagtttgtgatccacagtggttttttctttgacaataactcacacgacagagtgaaaataaagcttggagtgagtaaragtgacagactctacgccatgaaggccgaggtcttggctcgtgccggcatccccacgtacgtagaaaaacatcggttggccctttcttgcagtacttgaa

SEQ ID NO: 63960 - DNA, 201 bp, Homo sapiens
tgatcttgctttctgcttttatcagttccagtgtttttgcattgcattttaccgagccgcccatctctgctcagcttttggcttttctccgagtattctgyatgactgaaggtaagtcatttcaggaaaaaagagatgttgacttttttctttttaaatcatgaaagtgtaaagcatagggattcagattaaaggtaaagt

SEQ ID NO: 63961 - DNA, 201 bp, Homo sapiens
agtttgttttgggtcatatttaaccagtcgagagtattagaataaagagtcttgctttttcagttttctatagttttcacttctgttgcctttacaatggwtttctgtcattggatttccttttatcatctcatttttctattcataaattggagaggttaactaatttgatatgcaaatagaattaatttacataatatt

SEQ ID NO: 63962 - DNA, 201 bp, Homo sapiens
acctacccttatttttgggccctttttttatcagtgaaaaatcttttgattagccgtgcatcttttctctcctgctatagtcatagaagtgtttatctggstaacagtttgttttgggtcatatttaaccagtcgagagtattagaataaagagtcttgctttttcagttttctatagttttcacttctgttgcctttaca

SEQ ID NO: 63963 - DNA, 201 bp, Homo sapiens
gctagcaaaaggggtattgtcaaaataagggggtacatggctgtagattgtctttaaaaagtatcttgtgaaactgtctaaaggctctcagtgtccctcayagaaacagtgaaaaatggagtgctaccaaggcttgatcaggattccacatggagaggcctgacctggtgttgctccccaaaacttagctctgctctactt

SEQ ID NO: 63964 - DNA, 201 bp, Homo sapiens
taggcttccctagagaccccctctccagccgggttcccttcctcactgtgcttccctcacgcttctagtcctgtccctgtctttgaatgccgcccccccccgccattcttcacacatccatgtcccttactttctttgagacctattgttaaaagcacttgcaagcaagcattatctcatagggtctttacccaggacacc

SEQ ID NO: 63965 - DNA, 201 bp, Homo sapiens
attgtcaaaataagggggtacatggctgtagattgtctttaaaaagtatcttgtgaaactgtctaaaggctctcagtgtccctcatagaaacagtgaaaamtggagtgctaccaaggcttgatcaggattccacatggagaggcctgacctggtgttgctccccaaaacttagctctgctctactttggagagtctaggag

SEQ ID NO: 63966 - DNA, 201 bp, Homo sapiens
cttagttgggtaaagctgaagtagtagctgtttttgataagcccagtttttggtttacagtaagttgctttaaaggccttgccctgggaaatatcaagaaytctgcgactgtaatctactctcccaagttgccagaaggtggcagtagtgtcacagtaatgagagctctgtggagagagttatttcctttctccgttagtg

SEQ ID NO: 63967 - DNA, 201 bp, Homo sapiens
gtgtttttatttttcatcctaaaatgtatcttacaaatttcctggccctgaggtttcatttttaagagagagaaagagagagagagagagagagagagagwgtgtgtgtgtgtgtgtgtgtgtgtatgttttgctgttgttaactaccttaaatcctgtacagaacagtctgagtaggaatgagtaaatgagtgtttgagt

SEQ ID NO: 63968 - DNA, 201 bp, Homo sapiens
ttttctttctcttctctgtagtcagaaaaatgggtaagaagagtcgagtaaaaactcagaaatctggcactggtgctacagcaactgtgtcaccaaaggaratcttgaacctgaccagtgagctgctgcagagtaagtcctcctctgggctctccctgccttgatgtggtggctgtgcctttttcttctttgtcaccagaa

SEQ ID NO: 63969 - DNA, 201 bp, Homo sapiens
ttgacttttttctttttaaatcatgaaagtgtaaagcatagggattcagattaaaggtaaagtggattaaaactacagtacttttgggaagagagaagatrcaatactggagaaagaagaaatagatttgttttaccctagaaatgttttattaaatcctcgatgtgttgtcagtattaatttgtaatacgcaaataattc

SEQ ID NO: 63970 - DNA, 201 bp, Homo sapiens
gcgcctggcccaggaaaagagtgggaagagtatgtgcagatccggactctggttgagaaaatacggaaaaagcaaaaaggtaaaattgctagaatgataaytgtattttaataatgtcatgtagaaacttgattaggtcaaagggttgacgagtagtaaaggtctcagcatcattggtgtcactctgaaaggtcttgtact

SEQ ID NO: 63971 - DNA, 201 bp, Homo sapiens
tacagttcaaacataaaataacatcatgagacagctgggttttcaaactattccccggcaaagttcgagttcccgtggagctgggatagcgccagactggrgtcgggatcccaagctcctgttccggcgccacctttaatgggtgttgtgatgtcggttcctgggacccagtttcttcatttacttgtgaaaagaatggta

SEQ ID NO: 63972 - DNA, 201 bp, Homo sapiens
ctcagcaggttagtttacctgctgcactgggcgctggaggcaagcttcatgtctgcgtgaggctgggacatttcctggcgttgacgcctgtacctttcctrgcttgttgatgtataccaggaggaagcatgtgattgccacctctcgtatcagctttacacctgagataccttaccaaaaatattaaatagtctgtaaagc

SEQ ID NO: 63973 - DNA, 201 bp, Homo sapiens
taaaacaactattgaggtaattacactaaataaatgaggttttgaacttgttgtgttgttaagatgtttaatgaggcttggtgcggtggctcacgcctgtwatcccagcactttgggaggtcgaggcggggcggatcacgaggtcagaaattcaagaccagcctggccaacatggtgaaaccccgtctctactaaaaatac

SEQ ID NO: 63974 - DNA, 201 bp, Homo sapiens
ttatttttcatcctaaaatgtatcttacaaatttcctggccctgaggtttcatttttaagagagagaaagagagagagagagagagagagagagtgtgtgwgtgtgtgtgtgtgtgtgtatgttttgctgttgttaactaccttaaatcctgtacagaacagtctgagtaggaatgagtaaatgagtgtttgagtgagtga

SEQ ID NO: 63975 - DNA, 201 bp, Homo sapiens
gaggaaccattcttaatgaaaatggattatgcagaccttttttttattgaacttgtcaatatttgattaatgattaaagtgtgaactcaacataaattatkaacactttttaaaaaccatgtgtatgtttaatttttgaatgtattatgtgcaacctgagattacagctgttaggctctaggaaaagcttgtgaggatggt

SEQ ID NO: 63976 - DNA, 201 bp, Homo sapiens
aatcagctgggtgtggtggcacatgcctgtagtctcagctacttggaaggctgaggcaggagaatcgcttaaacctgggaggcagcagttgcagtgagccragatcgcaccactacactccagcctggacaacagagtgagactccatctcaaaaaaaaaagaacttttaaaatatatattttttaactcaagatacctga

SEQ ID NO: 63977 - DNA, 201 bp, Homo sapiens
accaggtagactttaaggggattcctggacagcatttttagagagaaccaagagttagtgaataagtgactaaaatattacagtcaaggggtgaacgggggaggcagagataggaggtacatgatgacgtctgtagagggactgggagcccttggtgttgctgggagggtgttttacatatttttgctggtttccttttat

SEQ ID NO: 63978 - DNA, 201 bp, Homo sapiens
acgttttgatgtgagtgtctggtcatgcgaccacctgcccagtcaagtgttagaacctcccgtcaccccaaaaagttccctcatgtccccatccccagccrttgtgccctctgtctctatagttttgctggtttagacttcttgtaattaattttgctcttgttttccaggaagataaatccgtcttgaaaaaccacgatc

SEQ ID NO: 63979 - DNA, 201 bp, Homo sapiens
cagaagccaggtctgtcttgctccctgcttttccacttcactcagagtgggtgctgtgaatatttgttgaatgagtgaatgaatgaatgaaatccatgaarcaactcaggagcaatttcacgtggcataaaccagagtgctacgtggtattttgtagactgcatgggttagacatttagaggtcactggaggtcatatgta

SEQ ID NO: 63980 - DNA, 201 bp, Homo sapiens
gctttttttttttaagtgctttctgtattttccaaaaaatggggtgatgtgaaatatactcccacaacactgtcaagccccttttgttcttttttttttttcacccagtgttccctacaaggcctcttacctccccacagatgccgagagctctcttcaggtgcaccctatgccctctttctgcaccttcttactggctct

SEQ ID NO: 63981 - DNA, 201 bp, Homo sapiens
tttggctcagtctctggaattcacccatgttgctgtgtgtagctgtagtttattctttttgaaaatttctgtatagtttctcactgtatgaatgtaccacagttttttatctgttctgtcgatggacatttgggtggtttccagtttttggctattacaagtgaagctgctagaagtaatcttgtgtttatcttcttgtgg

SEQ ID NO: 63982 - DNA, 201 bp, Homo sapiens
ctttggctcagtctctggaattcacccatgttgctgtgtgtagctgtagtttattctttttgaaaatttctgtatagtttctcactgtatgaatgtaccacagttttttatctgttctgtcgatggacatttgggtggtttccagtttttggctattacaagtgaagctgctagaagtaatcttgtgtttatcttcttgtg

SEQ ID NO: 63983 - DNA, 201 bp, Homo sapiens
taggctggagtacactggcaccatcatagctcactacaaccttgatctcccaggctcaaatgattctcccacaggtgtgcaccactacatctggctaattkttttttttttttttttttttgtagtgatggggttttgctatattgcccaggctggtctcaaagtcctgagctcaagcaatcctcccaccttgacctccca

SEQ ID NO: 63984 - DNA, 201 bp, Homo sapiens
cttatattgaggcaaaataggcctccctgtaaccttcatcttacagttttgtttctggtttttagagcaagagagtcaatctcataatctgcagcatgagwattctttttactcaccagtgaagcattcataacctctgtcaggcacctgcttggaattacaggtttacacagttaatcggaataaatcctgtcttccaaa

SEQ ID NO: 63985 - DNA, 201 bp, Homo sapiens
atagacaggatgatttttaaatcagtgaagttccctggcagatggggtagcactgtttgatttaggctgttctttcttgttttgtaacatttccattgagrtataatttacatacaatgaaaggcatacttctgaagcgtacgttttgatgtgagtgtctggtcatgcgaccacctgcccagtcaagtgttagaacctccc

SEQ ID NO: 63986 - DNA, 201 bp, Homo sapiens
ttggaagtgtgattaacgtccttattaccagactccttggtggttttagttattttcaggtcaagttcgatggtcctccagagatgccctccgcagatatrggaagcctgaaatgcccagaagggtggaggtgctgtgtccaggctgtgcccttgctcttggctgtgagccagaaccatggggagatttttttctcttcta

SEQ ID NO: 63987 - DNA, 201 bp, Homo sapiens
accaaggcttgatcaggattccacatggagaggcctgacctggtgttgctccccaaaacttagctctgctctactttggagagtctaggagtggcctggcscattgcgtagggacagcttttaccgtgggaaaatggcgttgttggaaacaatattttctaaggtagattgcttgttcaaatgaggagtgctatgttttcc

SEQ ID NO: 63988 - DNA, 201 bp, Homo sapiens
gggctagatcactactggttacaacctggaagatgaccgctgtgagtgtgtggctctgcaggattttcgggctggagagcaggtgggtctcgtggcatctmacaaaatgtgagccagccagtgggcactaacgttaacaccgtgttggtaatcttaaaaaggaacttaacttaggggaaaaaatgtggaattcacattgag

SEQ ID NO: 63989 - DNA, 201 bp, Homo sapiens
aaacagtatttacaagatgaaatgctgaccaggtgagacgcgagggtttccttgtaacttgtgtgctgaggccatgacattggctgaccttcactaagacrggggagcttagaaggagacgcaggtttggggtataatgagaggattttctatatttatttgtaatggacttagaaactctcacattgtatttctcagcag

SEQ ID NO: 63990 - DNA, 201 bp, Homo sapiens
ttgcattgcattttaccgagccgcccatctctgctcagcttttggcttttctccgagtattctgtatgactgaaggtaagtcatttcaggaaaaaagagawgttgacttttttctttttaaatcatgaaagtgtaaagcatagggattcagattaaaggtaaagtggattaaaactacagtacttttgggaagagagaaga

SEQ ID NO: 63991 - DNA, 201 bp, Homo sapiens
tttcatgaagagcatgaagtatgttcagaatacctatttgagtgtctcatttgtttaaacttgtaatttagccccaaattcagctgaaatgatcatgaaarttattcacggtatataacagacttttgaatcataaatgaaaagggtagttatttaaatccataaggttggggaacttacatggcatgaatcttttttgat

SEQ ID NO: 63992 - DNA, 201 bp, Homo sapiens
agagagacgttgtgcagcttagtttaatcaagcttgcgtatacttagagtccacctatatgctggagctaatgcaggatttcaggtttgaagctatgggtytgctgcttggcagctgtggtctcttggccaagtcacagccctctctaagcctcctgacaactggctgtggtcactgccggcctcagtgggctatggtggg

SEQ ID NO: 63993 - DNA, 201 bp, Homo sapiens
tgtggtctcttggccaagtcacagccctctctaagcctcctgacaactggctgtggtcactgccggcctcagtgggctatggtggggatgcagggaggtcrtgggcggatgctcgtgtccttggtcacaagtgcccatggagcttttccctgtgcttgggccgtaagctttccttttctatcagaaacagactaattcctg

SEQ ID NO: 63994 - DNA, 201 bp, Homo sapiens
ctttattgctttctaaagaccaataatgctttaaaaattccagtgtgtttttcagagtctctcttattaaatgtaatgtcctaaagcttttctatctaaarctggattttgaaaagagatcatctttaaaaaagttttttttgagacaggattttgctatgttacccaggctccagcccaatggctattcacaggtgtgat

SEQ ID NO: 63995 - DNA, 201 bp, Homo sapiens
tgggttacagaactggtaccgagaaacacttgccttcagtgacttaagttcacgcccgactgcctgggattcagggtacaggggactgaggagagccctcsgacagggtagacccagccagtggggaggcttactggaagagccctggaaacttgtttttggggggaacagattgaggagatggcttgggtctaggatcct

SEQ ID NO: 63996 - DNA, 201 bp, Homo sapiens
atgaagctggacatgtaaaatagagtgaggcagttcagtcctcgaagaccttgctagggaggttacgcattatcccgtgagctgtggaaagacgtgtgagygaaagaaacctacacagtgtagaattccacttatatgaagtttaagaataggcagaactaatcggtaatagaagttgaaatgtgggctactgggggaagg

SEQ ID NO: 63997 - DNA, 201 bp, Homo sapiens
attttcactttgtagcatgcttactacacaagaatgttacactcagttacatctcctcctccagcaagcacttcaaatatgtcaaaaattatacatgactrttgtcttcatgtggaaatcaatcactcggtttttctaaactttaggaagtcattaggaatggtcatacagtatgtatatagcttttatttcaagttggct

SEQ ID NO: 63998 - DNA, 201 bp, Homo sapiens
ctataccaaacaggtgtatcaatactttcagctatttcgtgtctaaatgtaaagtagcactaagcctctgccctgccctgtgttaagaatacatgccaagyttgtctaatgcccttttcttttttctttactgcatctcagatttacattttttatggcactcgatccaacgcagagtttgtgatccacagtggttttttc

SEQ ID NO: 63999 - DNA, 201 bp, Homo sapiens
tctaaaacttctaattcccagacccatcctcatgccaacaaactacccttgaaggattctttcacttacgaggactacaggttggtgtgggctgtgagtgygtctgtgtattgagggtggtttctaagtgaagtgggatcctggaagggagggaagggcttcagtgagaagtgacctgctgtgaccgttaaagcatccaaa

SEQ ID NO: 64000 - DNA, 201 bp, Homo sapiens
ttatcatagattttcctgttagtaagtatattctaaaaagagttaactaagaataaggtggatgtgagctaggtgcttgctcagtgctctctcttgggtamgttaagtgggggatgtttttatgatgccccagggtttgtctgctttgagaagtgtacctgccttgtacttctcacattcattatcatggctgtcatatgt

SEQ ID NO: 64001 - DNA, 201 bp, Homo sapiens
atttgaatatttatttgaagtgctgatatgcagccttaagttgtacttcatgtgtgattggatttctgaccgtagatatggttggattgaagactgtaccrtgttttgatgattctcctattattatttttttccctaggcagaagaattgtttttatgggttccacgaaaattgctaatgactgttgaatctgctaaaaa

SEQ ID NO: 64002 - DNA, 201 bp, Homo sapiens
aagcagtcatggcccatgtgggggaagctgctgtgctcggcggtcactggctttggttttaatgtctggatccagggagcagtgcagcacaagtccagggyttgacgtcatgctggaggcagaaaaaacctagtcccgaaacaggagaggcagttcacacaccaaccgcagaacccaaactgagatacagtcattgttcct

SEQ ID NO: 64003 - DNA, 201 bp, Homo sapiens
ctgcccatctttagagacttaactcgcatgccacctcctctgtgagtcattgccagatccccctcttcccgacagtgactgcagcttcttttctgaattcsagcacgtgtcatgtatcctggtgtgacacgtcacagtttgcctgtctgggctccctgctccaaagtcgttggctccttaaaagcagggaactcatcttgc

SEQ ID NO: 64004 - DNA, 201 bp, Homo sapiens
aatatttgattaatgattaaagtgtgaactcaacataaattattaacactttttaaaaaccatgtgtatgtttaatttttgaatgtattatgtgcaacctragattacagctgttaggctctaggaaaagcttgtgaggatggtctccaattctggatgtccgcttgcctccgccccagcctgcggccttttgcaggggct

SEQ ID NO: 64005 - DNA, 201 bp, Homo sapiens
tttaagattttcttgcatttgaggcataaaatgataaagaagacaggaattaggattcattagttctccagggaatagaggaaccattcttaatgaaaatrgattatgcagaccttttttttattgaacttgtcaatatttgattaatgattaaagtgtgaactcaacataaattattaacactttttaaaaaccatgtgt

SEQ ID NO: 64006 - DNA, 201 bp, Homo sapiens
tcggccgtgctcaggaacttggggtttattccgaaggcagagcggaatcataggaagattttgaacaggagagtgacatcgtacaattagcaactccagarggacagtattggattttgagactaggttccaagagttggaaggtttttgcaaataacaagctaggtgagaaggaataaggactatagccatgcagaggaa

SEQ ID NO: 64007 - DNA, 201 bp, Homo sapiens
agttaacctcagtgctcaagcagttctttgccccattttccaaagcattcagatgccaccttttgagtaccttgggatcccctttttcctctgattgccaraaacaagcttgtagattaagtgagatgtgcgtgtgtttgcctcaccatcatttccttcctcctccccgggctagatcactactggttacaacctggaaga

SEQ ID NO: 64008 - DNA, 201 bp, Homo sapiens
gaccatcgacagacaacctaagagattgggcgctgctctaaaagacaggactctgagaaggaggttttaatagaagctggggaccctttcctttcccctgsgggttcatgcatcacgtgaatattctcaaagaccacttcaggttttaggttctgtgtgctgagcactcgggacacagagatcaacaaggggctccagctt

SEQ ID NO: 64009 - DNA, 201 bp, Homo sapiens
tcaggttttaggttctgtgtgctgagcactcgggacacagagatcaacaaggggctccagcttccaagtgtgaccgacggggaggcaggtgcacagataaygtgacttgggctggagcgcataaggactgggctgtgggagtgcacaggagggcagggtaaggaggggcttccctgagaagccaggccacaacaggagtag

SEQ ID NO: 64010 - DNA, 201 bp, Homo sapiens
gggagcagggctccatggagctgctggaggcttccactccctgctgggttcctcctccagcattgccaacaaactccggctgccacccgctcccctccccygggcacacttgagactcctgtggggctattctcagttccacttgcttttatatatacgtatatatataaatttttttctccctgtgtcttttccactaga

SEQ ID NO: 64011 - DNA, 201 bp, Homo sapiens
ctctgcgtttctgcttagatccagtgctcatcgcgtaggcgtgcctgccttttgtaaagtcggtccaccttaaattgtgttttgcgcgttgtctgtgggtrctagtatcgaaatatgaagaagcagatttatggcggctgctgggcacaacaaattaagttgacagtgatgtatgagagcataacagcgcgatgatccctc

SEQ ID NO: 64012 - DNA, 201 bp, Homo sapiens
cctcccattagaatggaagatccatgaacgcagggtgattttgggggagggtctgttttgctcattgctatatcgctgtggtttttaatgaattcatgacyggtaaataaatgactgtaaaagccccatgcctaggaaaaaagatcagaaagaaataaaccaaaatgttaacgtgattgtgatcttttttctttgtttttt

SEQ ID NO: 64013 - DNA, 201 bp, Homo sapiens
cttgcatgatttgttcaaacttaatgtaagcagcaggtttcctttgttgaggatttttcggttgatatgacaaggatacttctaagtgactgttagacagyggtattagttcccatacagagagtatgttggaataatcagtgcttgcatttgaatctgcgactctaccaggtgggatgaaagggcagctggaaattcagg

SEQ ID NO: 64014 - DNA, 201 bp, Homo sapiens
gcttccatgtaaatgggataaaacaattcctttttccctaccaagtgttaaaaaaaaaagaggttagtttatctcaaaataaagaaattgatgacaaccartgctgtgttttccctaatacgactacatactttttaacctaccacagtcctggcagaaacattgctaacctgtagaaggtttattcaggatgctggtact

SEQ ID NO: 64015 - DNA, 201 bp, Homo sapiens
cttgatcaggattccacatggagaggcctgacctggtgttgctccccaaaacttagctctgctctactttggagagtctaggagtggcctggcccattgcrtagggacagcttttaccgtgggaaaatggcgttgttggaaacaatattttctaaggtagattgcttgttcaaatgaggagtgctatgttttcctcctaac

SEQ ID NO: 64016 - DNA, 201 bp, Homo sapiens
tggcagatggggtagcactgtttgatttaggctgttctttcttgttttgtaacatttccattgagatataatttacatacaatgaaaggcatacttctgargcgtacgttttgatgtgagtgtctggtcatgcgaccacctgcccagtcaagtgttagaacctcccgtcaccccaaaaagttccctcatgtccccatcccc

SEQ ID NO: 64017 - DNA, 201 bp, Homo sapiens
aaaagtgaagttttagtatttttaccaaatgttcttttgtccaggaaagaagtaaaatttaaatatgctgatctgttttgtcgttatcctatgtgtttgtsaagttattttatagtctcatagacctgcacttctcctgattttccgtgcttgatccgcatttgccgtgtatatgattcatgtgcgaacaagttgattccc

SEQ ID NO: 64018 - DNA, 201 bp, Homo sapiens
cttcgtcattgtgacattgagtaagaggagaaggggtgggtcttgctgtctcaggagtggcagatctggaagaaaatctatgtataagtggacccactcarttcatacccgtgtggttcaagagtcacctgtatattccttcatttgtctatcttcccaacttgaatgtaagcccactgaggacaaggactttccttcatt

SEQ ID NO: 64019 - DNA, 201 bp, Homo sapiens
aatcgcttgaacccgggaggcagagttgcagtgagccaggattgtaccactgcgctctagcctgggtgacagagtgagactctgtctcaaaaaaaaaaaaagaaatgaaatactttttctttgtccttggggttctgtctggggtcttctcggtggtgtgtgtccctgccttggagcctgggggagggtgcccctagtgta

SEQ ID NO: 64020 - DNA, 201 bp, Homo sapiens
cctcctccccgggctagatcactactggttacaacctggaagatgaccgctgtgagtgtgtggctctgcaggattttcgggctggagagcaggtgggtctygtggcatctcacaaaatgtgagccagccagtgggcactaacgttaacaccgtgttggtaatcttaaaaaggaacttaacttaggggaaaaaatgtggaat

SEQ ID NO: 64021 - DNA, 201 bp, Homo sapiens
gggaggtggcgcggcgggtctcagcccctcccggacgccgaggcccggcccccgcccctcggagacccgcccccgcatgcggaaccgccctctgcgaggcycggtttgggccgtgcgggaatgggcgtggcctgggcggggcgggcgctaggacccaccggagcgccgtgaacgtcaccgagcggcgccgaggccccgggt

SEQ ID NO: 64022 - DNA, 201 bp, Homo sapiens
ccttgagcccaggagtttcaggctgcagtgagctatgattgccccactgcactctagcctgggtgacaaggagagaccctgtctctgggaaaaaaaaaaaagagagagagagagagaacctgaatttggccaggcactatattgaaataatgaatgagggctgggtccctgccccggagcattgcaactggatgggcccct

SEQ ID NO: 64023 - DNA, 201 bp, Homo sapiens
ccgccactcgcaacatggagaagatccaggtcatcaaggtgagatgagatgggtctgggtctgggcgcaggctctagaaacgtgatgtcgcagttccaggygggcaggggcactgcctgtggccagccacccattacattggtgtggcagcgcctggcacccagcaggtcctcaggcctgtccactgctccatctgggcac

SEQ ID NO: 64024 - DNA, 201 bp, Homo sapiens
ggttcttggatctcgcacaagaaataattcagggcgagtccatagagtaaaaagtttattaagacagtagaggaataaaaagaatgactactccatagacrgcacagcaccaagggttgctggttgcccatttttatggttatttcctgatgatgtgctaaacaaagggtggattattcatgcttctcccctccccccgcc

SEQ ID NO: 64025 - DNA, 201 bp, Homo sapiens
gaactcctgacctcaggtgatccacctgtctcagcctcccaaagtgctgggattacaggctcgagctacagcacccagcctttttttttttttttttttttgagacagagtctcactttgttgcccaggcttgtatagtggcacagtctcggctcactgcaacttctgcctcccaggttcaagcgattcatgcctcagcct

SEQ ID NO: 64026 - DNA, 201 bp, Homo sapiens
tagtgattctgaggctcaggttggaggcccctggtctggagtgggagggacagcaaagtgagggcaggccagggcccagccccgtcacccccctgaccttkgtctcctccctaggatttcccctggatcctggcggatgagcaggatgtccacatgcatgacccccggctgataccactaaaaaccatgacgtcggacatt

SEQ ID NO: 64027 - DNA, 201 bp, Homo sapiens
ggatccccgcctagggcagtgctgcatggctgccctgattccaagtgctcttatcgcctctgtgtgtggatcgcccgccccagcccggggccgctcaggtytgcttggaggatgcctcccccaggagggcagtgagggatgccgcaacctcgacttctcagcctcctggggttccgccggccaacactgtctgtctcaaat

SEQ ID NO: 64028 - DNA, 201 bp, Homo sapiens
cctctgtgtgtggatcgcccgccccagcccggggccgctcaggtctgcttggaggatgcctcccccaggagggcagtgagggatgccgcaacctcgacttytcagcctcctggggttccgccggccaacactgtctgtctcaaatactgtgctgtgagttgtttcaataaaggggccccaagggctgggctgagctgagcc

SEQ ID NO: 64029 - DNA, 201 bp, Homo sapiens
cggctgataccactaaaaaccatgacgtcggacattttaaaggtgagcttcgtggggacccgggaagctttatttaggggctgcttaacgaagtgaggccyggtgctgaggccttactagagggcttgcgggagagaacgggggagtgcctggtggagggctcctcccatctctactcttctccaccatggctatggccac

SEQ ID NO: 64030 - DNA, 201 bp, Homo sapiens
gctgggattacaggctcgagctacagcacccagcctttttttttttttttttttttgagacagagtctcactttgttgcccaggcttgtatagtggcacartctcggctcactgcaacttctgcctcccaggttcaagcgattcatgcctcagcctcccagttagctggggttacaggcacacaccgccatgctcagctaa

SEQ ID NO: 64031 - DNA, 201 bp, Homo sapiens
gtccaggctggagtgcagtggcgcgatcttggctcactgcaacctctgcctcccaagttcaagcgattcgcctgcctcagcttcctgagtagctgtgactrcaggcacctgccaccatgcctggctaattttttgtatttttagtagagacagagtttccccatgttagccaggatggtctcgatatcctgacctcaggtg

SEQ ID NO: 64032 - DNA, 201 bp, Homo sapiens
tggcctcttggggacccccagcctagcagctgagcagggctgtgagtgggccgtttctcctccttccttgggcaagggggtggaggcagggtggtgtagtsggggtggggtgcctggctctgcagtgggggttcctctctttgcagaatgatgtggagaaagtggtggtggtgattttggataaagagcaccgcccagtgg

SEQ ID NO: 64033 - DNA, 201 bp, Homo sapiens
gtagtcccagctactcgggaggctgaggcaggagaatcgcttgaatcggggaggcagagatttcattgagccgagattgcaccaccgccctccagcctggstggcagagagagactccgtctcaaaaaagaaataaatgaaataaaaattagctgggtgtgatggtgcacacctgtagccccagctattggggaggctgag

SEQ ID NO: 64034 - DNA, 201 bp, Homo sapiens
ctctgggaagcttccctgattgattctacctggcttccatctccctattgactggggcttttcttagcacttgctttgccatctgctctgggggtgctgcygagccagcaagggaagtgggaagaggctgggcccagtggctggcaccagggcggtgggggagcctccaccaacctcttgcctctccaggctgtaccttca

SEQ ID NO: 64035 - DNA, 201 bp, Homo sapiens
gaggttgaggcttcagtgagctgtgattgcgtcactgcactccagcctagatgacagagtgagaccctgtctccaaaaaataaaataaaaaaataaaaaarttggacaatccatagaacagaaagtagattagtagttttggaactgatgtacctggcaacacactttgggcatgaacaacccttctcaagacatcaggag

SEQ ID NO: 64036 - DNA, 201 bp, Homo sapiens
ccatctccctattgactggggcttttcttagcacttgctttgccatctgctctgggggtgctgctgagccagcaagggaagtgggaagaggctgggcccaktggctggcaccagggcggtgggggagcctccaccaacctcttgcctctccaggctgtaccttcacagtcctggtgcacacgagagaagccgccactcgca

SEQ ID NO: 64037 - DNA, 201 bp, Homo sapiens
gcactgaagtcgacgtgttttgctcctcatccagactcagttgggattcaagtcaggcaagtggtaatgagccactgtccaccatcacttcattcctctgycattcattctttcattcactcatttgacacacatttgctgagaacctgaattcgggctgggcatggtggctcaagcctgtaatctcagcattttgcgagg

SEQ ID NO: 64038 - DNA, 201 bp, Homo sapiens
gggtctgcatcaccaacagcttcctagtgattctgaggctcaggttggaggcccctggtctggagtgggagggacagcaaagtgagggcaggccagggccyagccccgtcacccccctgacctttgtctcctccctaggatttcccctggatcctggcggatgagcaggatgtccacatgcatgacccccggctgatacca

SEQ ID NO: 64039 - DNA, 201 bp, Homo sapiens
cggctggagctccaaaaaggtcagctattgttatgaagcgtagggcggggagggttcatcctcttgggcggtcaggccaggctgcatttaggtacccggtsggggcggagcaggggcgacgccggtgcacgccctcttttttttatttttaaaatttcacccgggccttgacaaccggtacaatcctgtcctcccctgttc

SEQ ID NO: 64040 - DNA, 201 bp, Homo sapiens
ggatgggcccctgagcgtcaggatatcaggagattgtcaccaggctatgtgtgtctcactctgtatgtcccccatacccatgtgattggtgtcctgggaaycttaggcagggtgggagagctgattcattctgccatcagcctggtggggatgggaggggtcttggaatcatttctggggtctggaaacttcattgcccgg

SEQ ID NO: 64041 - DNA, 201 bp, Homo sapiens
ggccccgcgcagggcgggcgacaaagggccgcggcgggcggtcctcggtggaccccaacaatggagcgaggctgcgcgctcagctgcggccgcgtctgtcmgggcaggggcccggggccacaaaaggattattccgcctagactgtcaaaagggacggaagaaatgcccagggcgggggaggcgggacggggaacggcggg

SEQ ID NO: 64042 - DNA, 201 bp, Homo sapiens
catcaccaacagcttcctagtgattctgaggctcaggttggaggcccctggtctggagtgggagggacagcaaagtgagggcaggccagggcccagccccrtcacccccctgacctttgtctcctccctaggatttcccctggatcctggcggatgagcaggatgtccacatgcatgacccccggctgataccactaaaaa

SEQ ID NO: 64043 - DNA, 201 bp, Homo sapiens
ggtgcatccatcacctcagcagtgtacactgtacccagtatgtagtcttttgtccctcaccttcccacccttccctcaccttcccacccttccttcccccmgagtccccaaagtccaatatatcattcctatgcctttgcatcctcataggttaactcccacttacaagtgagaacatatgatatttgcaaacccagatat

SEQ ID NO: 64044 - DNA, 201 bp, Homo sapiens
cggaatcagtgtttgacacataagaagtgctcgatgttagtcattattttttattattttaataatatcatctctgagggcccttacaggacttccagacmgagtccacgcccctgggggacttgggagcagtaaaatgtagtggcaggaggcacctcggccatcgcccaccccaccagctgggagactcgggcaggttat

SEQ ID NO: 64045 - DNA, 201 bp, Homo sapiens
ctgaaggccatcccacaggagtcacttggctctcagtttccccaccccaggccccagtctgaagggctcctttgcaaggagttgccccctatgactgccaytgcctgtcaccaatgcaaaagctgcttaagcagcctccagagagggaaaggaaagacccttgcttttcccaagttctgcaatgagtcagtctcaaggagc

SEQ ID NO: 64046 - DNA, 201 bp, Homo sapiens
gatgaccacgctcacacgacaagacctcaactttggccaaggtagggaggctggacctgcgggcccgggggcgggggcgtctgggccggcgggcttcctcsagcgcgccaccggcttgtgcccccctgcagtggtggccgatgtgctctgcgagttcctggaggtggctgtgcatctcatcctctacgtgcgcgaggtcta

SEQ ID NO: 64047 - DNA, 201 bp, Homo sapiens
ggacgccagcgtgggggtggaggttcttccagctgccctgagcctgtgcgaagcgggaggtccttccccagttcccacagactgtggggagggaagagackgtggaagcgagcgggttctgggctcctgggtctctggaactaccctctgcccttgccccaacactcaggtagcgggaaggatgaccacgctcacacgaca

SEQ ID NO: 64048 - DNA, 201 bp, Homo sapiens
aaggcctgggaggagaaagggcaagaagcaccagcatgacaaggggacagcctgtgagcagctgagatgggtccagagagatgacatgagctacccagggycacctgggtgggggcagagcccaggacacagaagcagttttctgactccccaggcaagtgtccagtcaactcgaagttgacctctggcacatgcgttagt

SEQ ID NO: 64049 - DNA, 201 bp, Homo sapiens
gcaccgcccagtggagaaattcgtctttgagatcacccagcctccactgctgtccatcaggtgggctgcccctgcccctcgcccactagctggcatcaggkgtgtctctggcaacacacccacccctttaaggcggcccttgaataccttggtaaaggcctgggaggagaaagggcaagaagcaccagcatgacaagggga

SEQ ID NO: 64050 - DNA, 201 bp, Homo sapiens
gggggcagagcccaggacacagaagcagttttctgactccccaggcaagtgtccagtcaactcgaagttgacctctggcacatgcgttagttggtcaactrcatgcttccaatggtgaggtcagggcactggaatctggcaccaacctgtccccacggcctgtgtggccttaggcaagccctttcccctcctggcttggtg

SEQ ID NO: 64051 - DNA, 201 bp, Homo sapiens
tgagattataggcgtgagccaccatgcccggccagttcttagcctcttgagggaaagtggggtctcctgggtagggagccctggagagctgctgggcctcsgaccgaaggcagatggggccttaggctcctggttgtgttgggtggtttccccatctgtgctttgggcctcacgagccgcatggtattgtgtgcagatgtc

SEQ ID NO: 64052 - DNA, 201 bp, Homo sapiens
agaacagtcacagtaactgcctcatggagttactcccaggactgagataatccacggacacacttagcccagtgcccagcactcggctggagctccaaaawggtcagctattgttatgaagcgtagggcggggagggttcatcctcttgggcggtcaggccaggctgcatttaggtacccggtgggggcggagcaggggcg

SEQ ID NO: 64053 - DNA, 201 bp, Homo sapiens
gtaaataagtggaagccctggtgtcagaagaggcatcagagctgggtttgtattcccactgtgtgattttggcgaattagagaacgtttctgggcctgttwaaccatctgtaaagtggggctataaaatggagacttagctgctagggttaatgagagaattaacggaatcagtgtttgacacataagaagtgctcgatgt

SEQ ID NO: 64054 - DNA, 201 bp, Homo sapiens
ctctccagggaggggtcctagcccaccaggttcagcgttggtgcctggagcctgttcgtcacttgggttctatggacttggcctctgtgggggatgggggsggtcctggggtctgcatcaccaacagcttcctagtgattctgaggctcaggttggaggcccctggtctggagtgggagggacagcaaagtgagggcaggc

SEQ ID NO: 64055 - DNA, 201 bp, Homo sapiens
cagtaatcccagagctttgggaggctgaagcaggaactctggaggccaaatgttcaagaccagcctgggtaacacagcgagaccctgtctctatgaaaaargagcagatgatcagtaaggtccccctgaccactgaggggtcagcaacactgggaatcagtagaaccccacggagggaatggcaggtgagggctttgctct

SEQ ID NO: 64056 - DNA, 201 bp, Homo sapiens
ctagtgattctgaggctcaggttggaggcccctggtctggagtgggagggacagcaaagtgagggcaggccagggcccagccccgtcacccccctgacctktgtctcctccctaggatttcccctggatcctggcggatgagcaggatgtccacatgcatgacccccggctgataccactaaaaaccatgacgtcggacat

SEQ ID NO: 64057 - DNA, 201 bp, Homo sapiens
aaatggagacttagctgctagggttaatgagagaattaacggaatcagtgtttgacacataagaagtgctcgatgttagtcattattttttattattttartaatatcatctctgagggcccttacaggacttccagaccgagtccacgcccctgggggacttgggagcagtaaaatgtagtggcaggaggcacctcggcc

SEQ ID NO: 64058 - DNA, 201 bp, Homo sapiens
ccgagccagaggattcgcttttgcgtgggcagctgcagggatggtgactcgggctagctcagatgtggctgccgttagtccccagctgcgcgctcccccgkccctccccagccctcttccggcgcctgctaaagcgagagaaatgccctcgggggaagatatgtagcgatccaatggaacgtggagatcaacgttgtgttt

SEQ ID NO: 64059 - DNA, 201 bp, Homo sapiens
gagccacctactggggcccccagctcatcctggctcttctgaagtgggggctctccagggaggggtcctagcccaccaggttcagcgttggtgcctggagyctgttcgtcacttgggttctatggacttggcctctgtgggggatgggggcggtcctggggtctgcatcaccaacagcttcctagtgattctgaggctcag

SEQ ID NO: 64060 - DNA, 201 bp, Homo sapiens
cttcgcgcccacccgaagttgaagggaggtggcgcggcgggtctcagcccctcccggacgccgaggcccggcccccgcccctcggagacccgcccccgcakgcggaaccgccctctgcgaggcccggtttgggccgtgcgggaatgggcgtggcctgggcggggcgggcgctaggacccaccggagcgccgtgaacgtcac

SEQ ID NO: 64061 - DNA, 201 bp, Homo sapiens
gacgaccctgggagtctgagaatgctgggttatgggtcccgtgcctcccataactcacgacggggtcggtggggccacggacgctgcaaagatcaaagagygatggggccggactcccatatgtgggaagcagcgctcccacctggcgccctgagctcgccaggtggcttccatttcgactgttttctttctccagcgtgt

SEQ ID NO: 64062 - DNA, 201 bp, Homo sapiens
ctttccaccccgcgagacagcggggcgagggggcgcgggcggccagtggatagaggctgatgcccccaagcacggacgccagcgtgggggtggaggttctkccagctgccctgagcctgtgcgaagcgggaggtccttccccagttcccacagactgtggggagggaagagacggtggaagcgagcgggttctgggctcct

SEQ ID NO: 64063 - DNA, 201 bp, Homo sapiens
atattattagcttggtgggcaccaggatggattgatgagaacactgaactgtttattcactgaaaggtttgagtcatccatcccataaatacctattgaayacctactatgtgccggcaccggaggtacagtagtaaacaacatggacaagaatccctgcccccatggagctcagattctagtgaaggagacagaagataa

SEQ ID NO: 64064 - DNA, 201 bp, Homo sapiens
gaggtccttccccagttcccacagactgtggggagggaagagacggtggaagcgagcgggttctgggctcctgggtctctggaactaccctctgcccttgycccaacactcaggtagcgggaaggatgaccacgctcacacgacaagacctcaactttggccaaggtagggaggctggacctgcgggcccgggggcggggg

SEQ ID NO: 64065 - DNA, 201 bp, Homo sapiens
tgagccacgtggttgtggggagaagacttgcaagcagaagagccactgcaaaggtcctggagcgggagtgtgcttggtgtgtttggtggagaagagtcagkctggaacagagtgaggtgacatcagacagggagctgggataggaccatgttgttacaggaaaggggtcctgacccagacctcaggagagggttcttggat

SEQ ID NO: 64066 - DNA, 201 bp, Homo sapiens
aaggcagacaaagcagtgtgcatcgcactgtagctccagtccctagaagtgcctgtctctggaaggcactcaggaaacatgagaataagtggtagaagctyaaaggacatccaggtggtccccgcttcaagtccccacaccaccattgttttctcacttccagtatggtattcaagacattacttgaggtagtcagcactt

SEQ ID NO: 64067 - DNA, 201 bp, Homo sapiens
aaaggtcctggagcgggagtgtgcttggtgtgtttggtggagaagagtcagtctggaacagagtgaggtgacatcagacagggagctgggataggaccatrttgttacaggaaaggggtcctgacccagacctcaggagagggttcttggatctcgcacaagaaataattcagggcgagtccatagagtaaaaagtttatt

SEQ ID NO: 64068 - DNA, 201 bp, Homo sapiens
tcgcactgtagctccagtccctagaagtgcctgtctctggaaggcactcaggaaacatgagaataagtggtagaagcttaaaggacatccaggtggtcccygcttcaagtccccacaccaccattgttttctcacttccagtatggtattcaagacattacttgaggtagtcagcactttattttttattttatattttat

SEQ ID NO: 64069 - DNA, 201 bp, Homo sapiens
ctggctaatttttgtatttttagtagagacaaggtttcgccgtgttggccaggctggtctcgatctcctgacctctggtgatccacctgccttggcctccyaaagtgctgggattacaggcgtgagcactttattatgaaacaggttttgtgttagataatgttgcccaactgtgggctaatgtgttttgagtgtgtttag

SEQ ID NO: 64070 - DNA, 201 bp, Homo sapiens
cttgatctcagctcactgcaacctccgcctcccaggttcaagtgattctcctgcctcagcctcccaagtagctgggattacaggtgccacctcacctggcyaatttttgtatttttagtagagatggggttttgccattttggccaggctggtctcaaactcctgacctcaggtgatccacccacctcatcctctcaaagt

SEQ ID NO: 64071 - DNA, 201 bp, Homo sapiens
gaatcagtatatccaggacacgctgcactgcgtcaagccactcctggagaaggtgagggtgcactgggctccccagccatctcaccccatgctcacccccrtccctgtgtgctcacagtccaactctgggatggggtgaagctaggactctgtggggtcttcatggctccaatacccagaagcctgttccctgcactctgg

SEQ ID NO: 64072 - DNA, 201 bp, Homo sapiens
ctgattgattctacctggcttccatctccctattgactggggcttttcttagcacttgctttgccatctgctctgggggtgctgctgagccagcaagggargtgggaagaggctgggcccagtggctggcaccagggcggtgggggagcctccaccaacctcttgcctctccaggctgtaccttcacagtcctggtgcaca

SEQ ID NO: 64073 - DNA, 201 bp, Homo sapiens
ctccgggccttcatcctgaagatcagcgtgtgcgatgccgtcctggaccacaaccccccaggtgtgtccactccccaccctctcttcccttggcatttccrtggttatctcgggttggtctgtgttcccaggtccatgtttggctgttctgagactcatctcttcctaaccctgagagtccacctcctctgggaagcttcc

SEQ ID NO: 64074 - DNA, 201 bp, Homo sapiens
ccagtgtgatgggaagacctcctctcactcccagctcagactcgctgttgtctcatgtggagcagctgctccgggccttcatcctgaagatcagcgtgtgygatgccgtcctggaccacaaccccccaggtgtgtccactccccaccctctcttcccttggcatttccatggttatctcgggttggtctgtgttcccaggt

SEQ ID NO: 64075 - DNA, 201 bp, Homo sapiens
ggtgcacgccctcttttttttatttttaaaatttcacccgggccttgacaaccggtacaatcctgtcctcccctgttcccgcccccgagccagaggattcrcttttgcgtgggcagctgcagggatggtgactcgggctagctcagatgtggctgccgttagtccccagctgcgcgctcccccgtccctccccagccctct

SEQ ID NO: 64076 - DNA, 201 bp, Homo sapiens
ccccgtgggcatcttccagaaacgcaagaagtacaacgtgccggtccaggtgaggcacgtcccagaaccacagagtgggtacagggtggacttttaaaaaytctttggtcgggcgccgtggctcacgcctgtaatcctagcactttgggaggccgaggcgggcggatcacctgaggtcaggagttcgagaccagcctgaca

SEQ ID NO: 64077 - DNA, 201 bp, Homo sapiens
gcatttaggtacccggtgggggcggagcaggggcgacgccggtgcacgccctcttttttttatttttaaaatttcacccgggccttgacaaccggtacaaycctgtcctcccctgttcccgcccccgagccagaggattcgcttttgcgtgggcagctgcagggatggtgactcgggctagctcagatgtggctgccgtta

SEQ ID NO: 64078 - DNA, 201 bp, Homo sapiens
aggagggaagggggcgggagcgcggggaggggacagaggaggggcggcgggtggcgggctcgactgcccccagccgaggggcagccccggggccgggcccsgcgcgcacccggccagcgcgccctcgccagctgcgctctgagttctgggccagctccccagaggcctaggcgccgccgccgcgagggcgcggggcagaca

SEQ ID NO: 64079 - DNA, 201 bp, Homo sapiens
gctattgttatgaagcgtagggcggggagggttcatcctcttgggcggtcaggccaggctgcatttaggtacccggtgggggcggagcaggggcgacgccsgtgcacgccctcttttttttatttttaaaatttcacccgggccttgacaaccggtacaatcctgtcctcccctgttcccgcccccgagccagaggattcg

SEQ ID NO: 64080 - DNA, 201 bp, Homo sapiens
aggttggacacatgagcaggcccagtgggtgctggggacaccatagggaacatgccacagcccttgcttttgtttttgaaaatagcttttctctgcatagygccacccatagcccgggcactgaagtcgacgtgttttgctcctcatccagactcagttgggattcaagtcaggcaagtggtaatgagccactgtccacca

SEQ ID NO: 64081 - DNA, 201 bp, Homo sapiens
cctcaactttggccaaggtagggaggctggacctgcgggcccgggggcgggggcgtctgggccggcgggcttcctcgagcgcgccaccggcttgtgccccmctgcagtggtggccgatgtgctctgcgagttcctggaggtggctgtgcatctcatcctctacgtgcgcgaggtctaccccgtgggcatcttccagaaacg

SEQ ID NO: 64082 - DNA, 201 bp, Homo sapiens
gagccagggtccgtgggcagacgcggcgaggagaggaggcggcggaaggactggcggatagacgggtccgagggctgggaaggaggcagcatcctcacttycagcctcgggaccccgcgcaccccgcccctgggcgcgccaggtagcccacctttgtccgggctcgcagccaggtggggcgggaggggcggagccaggggc

SEQ ID NO: 64083 - DNA, 201 bp, Homo sapiens
ctttccgcatgtcccgctttgcgctcccggccctgggcatcccgctgtttccctctgcgtccgcggccctgcccttttcgggggcacagctgtggtctttycaccccgcgagacagcggggcgagggggcgcgggcggccagtggatagaggctgatgcccccaagcacggacgccagcgtgggggtggaggttcttccag

SEQ ID NO: 64084 - DNA, 201 bp, Homo sapiens
acactcatctcattcttgaaggttctgtctccatgacctaatcatctcccaaaggcgctaccttctaatacaatcacactggaaattcagttttagcataygaaatttggagaaacacaaacattcagtccatagtagaatggttcctagaagctggtggtttccaggatggttctcaggaggctagaatcagtgggtgcc

SEQ ID NO: 64085 - DNA, 201 bp, Homo sapiens
atctctgagtctcagttttcgctttacatgataacaatgataaaatccacctcctaatactggtgagggtaaaattcgctaattaatgccaattgcttccytgcacaatgagaacaggggaagtgattgcattaatgtccagaggcctctggtaggtaactcaatcactctgcctatacaggcggtaggtaggtcgctggg

SEQ ID NO: 64086 - DNA, 201 bp, Homo sapiens
aatactaaatttgtatagcaaatatttctaaaattttatcaacaatgagtggatgaacgtgctatgtatgtaaaatgaaattatctggtttttttttttttacattcaaaatgaaggccgggcatggtggctcatgcctgtaatctttgcactttaggaggctgaggtgggaggaccgctcgagtccaggagtttgaaagc

SEQ ID NO: 64087 - DNA, 201 bp, Homo sapiens
tctgtggagggcagatgacgacctccactggtaaccagaacctctatggggggcagatgatgacctccactggtaaccagaccctctactgggggcagatratgacctccactggtaaccagaacctctgtggagagcaagtgatgacctccactggtaaccaagccctctgtggagggcagatgacgacctccactggta

SEQ ID NO: 64088 - DNA, 201 bp, Homo sapiens
gaaatgagataatttatttgaaaatttaatcagctgaatctccggtaagatgtctggagaggagactttggaaaagcctctggggtgagatctcttcagargatgataggagattcacaacatccatctagactctcatctccattggtagataggagtagcttagtaaaagtttgcacttgagaaatgtttgcactttta

SEQ ID NO: 64089 - DNA, 201 bp, Homo sapiens
tattgcccaggttagtctagaactcctgggtgaagggatcctcccaccttggccttccaacatgctgggatgacaggcctgacccactgtgcctggcctgktctaatctttatcattttcttccttctgcaaactttaagtttagttctttttctagttccgtaaattgtaaagttaggttactgatttgagatatttctt

SEQ ID NO: 64090 - DNA, 201 bp, Homo sapiens
ctggcctgttctaatctttatcattttcttccttctgcaaactttaagtttagttctttttctagttccgtaaattgtaaagttaggttactgatttgagmtatttcttgtttttttaaatgtaagtgtttatagcttctattctagcattgcttttactacatcccataaattttggtctattgtgtttttgtgttcatt

SEQ ID NO: 64091 - DNA, 201 bp, Homo sapiens
ctgcaaactttaagtttagttctttttctagttccgtaaattgtaaagttaggttactgatttgagatatttcttgtttttttaaatgtaagtgtttatarcttctattctagcattgcttttactacatcccataaattttggtctattgtgtttttgtgttcattataacttctcttgtgatttcttctttgatccatt

SEQ ID NO: 64092 - DNA, 201 bp, Homo sapiens
gagaccctctctgggggccaaatgacaaccagtctagacctctatggagggcaaatgatgacttccattgataaccagaccctctgtggggagcagatgaygacctccagtggtaaccaggccttctacgggagacagatgacgacctccactggtaaccagaccctctgtggagagcagatgacaacctccactggtaac

SEQ ID NO: 64093 - DNA, 201 bp, Homo sapiens
accatactggagagaaatcctatgagtgtaaggaatgtggaaacatcttctgtcagcaaataccacttattgtagatgtgagatttcagatgatcaacccyatgaactcactgtggaaaagccttgtctcagttcattgcttactgtgtgtgtgagcagccccgcaggtgagcagccctatggtttccatggctgtgggga

SEQ ID NO: 64094 - DNA, 201 bp, Homo sapiens
gggggccaaatgacaaccagtctagacctctatggagggcaaatgatgacttccattgataaccagaccctctgtggggagcagatgacgacctccagtgrtaaccaggccttctacgggagacagatgacgacctccactggtaaccagaccctctgtggagagcagatgacaacctccactggtaaccaggccctctat

SEQ ID NO: 64095 - DNA, 201 bp, Homo sapiens
atatatatatatttctatatatttaaagccatctatcatttctatgatttggtatagaagggaaggacttcagggtctcctcagtccaccatattcaatgrcagtcctgtcacacattttgaatacagcctgggggaattatggtatttctctattctgagagtcaggacaaggcaggagggaccagactttgatggcaga

SEQ ID NO: 64096 - DNA, 201 bp, Homo sapiens
ctttcctcttcttcccttcttcacagttttcctcttgtctctccagcttttgcggccctcattcccctcctccttcactcacctccaccactcccgtctcytctggctctccctctcccactccaacttgttcaaaaacgttttcttgttcactttaaatgtccctgccctacctcaccctgatgtatgacaggtctctct

SEQ ID NO: 64097 - DNA, 201 bp, Homo sapiens
aaggagggtatgtggggattggaatttgagctgggatgaacccctgacctatcaatttttttgcaggatcccataactaaagatctagttcagtcatcagrcaacatcaaagagatggattccagtcttctccaggcaattgaggaaattgagaaatttttccagcatctctctgagcggcatacagaacaggcagaaacc

SEQ ID NO: 64098 - DNA, 201 bp, Homo sapiens
cctcattcccctcctccttcactcacctccaccactcccgtctcttctggctctccctctcccactccaacttgttcaaaaacgttttcttgttcactttmaatgtccctgccctacctcaccctgatgtatgacaggtctctctctctctgtctggtccaggggagaagccctatgtatgcgatgtagagggatgtacgt

SEQ ID NO: 64099 - DNA, 201 bp, Homo sapiens
gttgactgaacagagcagaacagatttcagaaagagacctatgcattatttgaatttggaatacgatagaagtgaatcaggataggaggaaatatgggackatttttaaaaatggtttggaggtaatctgttctccaagtagggaaaaatagaccatgaaccatacacaaaagtaaaatccacagagatgaaaagcaggca

SEQ ID NO: 64100 - DNA, 201 bp, Homo sapiens
gacaaccagtctagacctctatggagggcaaatgatgacttccattgataaccagaccctctgtggggagcagatgacgacctccagtggtaaccaggccytctacgggagacagatgacgacctccactggtaaccagaccctctgtggagagcagatgacaacctccactggtaaccaggccctctatggggggcagat

SEQ ID NO: 64101 - DNA, 201 bp, Homo sapiens
ttactctgcatttgaaaggtcttacacagataaaccttataaatgtaagaaatgtggaaatatcttcagccaaaagtaaatccttgctcaaaaaaaaaaawatatacactggagagaaacctcgtgaatgcaggaaagcttttgtttagatatccctctcagtcagcagagggtttatgtggggaaagcccctctgcctgc

SEQ ID NO: 64102 - DNA, 201 bp, Homo sapiens
ggttatccaatttgttggtgtacaaactgtccatagtcctgtcttaaaatcctttctattggtgtagaagtagtagtaatgtccccacttttctttctgaktttagtaatttgagtctctttttcttagtccatctagcttaaaggtttgtcaattttgctgatcttttcaaagatcgattttttgtttcattaatttttc

SEQ ID NO: 64103 - DNA, 201 bp, Homo sapiens
caggcagaaaccccagatgcaccagaaccacagaactgtatgcctctgactgcccatgctgaggagagccaacatgagtcaacccagagcaagacgatgcmtcccttggggtccacaatgatgacttctgcatgcactaacatccctgggacagttctcacccaggacttaacaatgcaccctcttaaagcccttgaagac

SEQ ID NO: 64104 - DNA, 201 bp, Homo sapiens
ctggtaaccaggccctctacagggggcagatcacgacctccactagtaaccagaccctctgtggagagcagatgacgacctccactagtaaccagaccctytgtggggagcaggtgacgacctccactggtaaccaggccctctatggggggcagatgatgacctccactggtaaccagaacctctacggggggcagaata

SEQ ID NO: 64105 - DNA, 201 bp, Homo sapiens
ccctctatggggggcagatgatgacctccactggtaaccagaccctctactgggggcagatgatgacctccactggtaaccagaacctctgtggagagcasatgacaacctccactggtaaccaggccctctacggggggcagatgacgacctctactagtaaccagaccctctgtggagagcagatgacgacccccacta

SEQ ID NO: 64106 - DNA, 201 bp, Homo sapiens
tcctgtcacacattttgaatacagcctgggggaattatggtatttctctattctgagagtcaggacaaggcaggagggaccagactttgatggcagagatrggaaaggagaacgtattagataagataatttggctggataaggcagactgagcaatggattggataggaacatggcaaaactgagtagactgatctggct

SEQ ID NO: 64107 - DNA, 201 bp, Homo sapiens
gtgagaaagtcttcagccgcgtgtcagtttcaccgagcatgagcattttcacactagagagaaaccctttgaatgtaatgaatgtggaaaagcctttactraaagcagtatgtcattaaccatctgaacgctcataaccacagagaagctttgtgaatataacaaatgtggaaaatccttttgccagaaggaaagtctccc

SEQ ID NO: 64108 - DNA, 201 bp, Homo sapiens
taaccagaccctctgtggagagcagatgacgacccccactagtaaccagaccctctgtggggagcaggtgacgacctccactggtaaccaggccctctacrgggggcagatcacgacctccactagtaaccagaccctctgtggagagcagatgacgacctccactagtaaccagaccctttgtggggagcaggtgacgac

SEQ ID NO: 64109 - DNA, 201 bp, Homo sapiens
gtaaccaagccctctgtggagggcagatgacgacctccactggtaaccagaacctctatggggggcagatgatgacctccactggtaaccagaccctctastgggggcagacgacgacctccactagtaaccagaccctctgtggggagcaggtgacgacctccactggtaaccaggccctctacggggggcagatgatga

SEQ ID NO: 64110 - DNA, 201 bp, Homo sapiens
gatgatgacctccactggtaaccagaccctctactgggggcagatgatgacctccactggtaaccagaacctctgtggagagcaagtgatgacctccactrgtaaccaagccctctgtggagggcagatgacgacctccactggtaaccagaacctctatggggggcagatgatgacctccactggtaaccagaccctcta

SEQ ID NO: 64111 - DNA, 201 bp, Homo sapiens
aatcataaatagatatatgttatatatgtatattctttgggttttaaaatttttctttaaatatatgtaatatatgtacatatattatatatatatatatwtttctatatatttaaagccatctatcatttctatgatttggtatagaagggaaggacttcagggtctcctcagtccaccatattcaatggcagtcctgtc

SEQ ID NO: 64112 - DNA, 201 bp, Homo sapiens
ctccgactcctgggctcacgtgatcctcctgcctcatcattccaagtagctgggactacaggtatgtgccaccacactcagctaattaaaaaaaaaaaaaatttgtaggagctggatctcactatattgcccaggttagtctagaactcctgggtgaagggatcctcccaccttggccttccaacatgctgggatgacagg

SEQ ID NO: 64113 - DNA, 201 bp, Homo sapiens
ggctggtctggaactcctggactcaagcaattctcccatctcagcctctcaaagggtgaggtaataggcatgagccaccatgttcagccactttttgtaartttgaattaaaatttccctcacaaaattcagtactatacacatactatacatgtatgtacgtaaatgtttctgaaatggtttggaagaatatagcccaat

SEQ ID NO: 64114 - DNA, 201 bp, Homo sapiens
atgctcaggaaatatgtactaggatatttactatggtttgatttgtagtagccaaaaattggaaacatcaaaaagaagaaatccttatgatggaataatayatgtctgtaagtgcaacacctgagattcacatgtattaacaggaagatctcagaatcatgttgaggggggtaatatcaagttgcagaatgatgcatatag

SEQ ID NO: 64115 - DNA, 201 bp, Homo sapiens
gtggaaatatcttcagccaaaagtaaatccttgctcaaaaaaaaaaaaatatacactggagagaaacctcgtgaatgcaggaaagcttttgtttagatatycctctcagtcagcagagggtttatgtggggaaagcccctctgcctgcatggtatgtgagaaagtcttcagccgcgtgtcagtttcaccgagcatgagcat

SEQ ID NO: 64116 - DNA, 201 bp, Homo sapiens
cacgatcatttctagggtaacctgatggaattatcaagataattatgcaagataaaataaataaataaataataaataagtaaataagtcaaaaccacagraaaaaaaagccattaagtttccagggtaaactgatggaattatcaggatttcacagtagaagtaatttgattaagtttacagctgccaaagaggtggagt

SEQ ID NO: 64117 - DNA, 201 bp, Homo sapiens
aaatagattttcatatgttgaaccatccttgcattctgggagtaaatcccatttggtcttgttgtataatccttgtaatatgctgatgaattgggtttacyagtacttttttgggatttttgcatcaatgttcttaagggatatgagtccgtagttttcttttcttgtagcatcacatctggctttgacattgggtatatg

SEQ ID NO: 64118 - DNA, 201 bp, Homo sapiens
ggtttcccatcttggccaggctggtcttgaactcctggcctcatgatccacccacctcggcctcccaaagtgctgggattacaggtgtgagtcaccatgcscagccttccagttttacttctattatggatttctattatggatttagaggtggatgtggtggcaagcacctgtagtcccacgtactagggagtctgagac

SEQ ID NO: 64119 - DNA, 201 bp, Homo sapiens
cagttaactcctcattccccctcccccttttccccccaaccatctgtctgtctctgattttgattactcttaggtacttcatataagtggaatcacatgaytttttatgtgagtcacttttttgtggctggattatttcacttagcataatgtcctcaaagttcatccatgttgtagcatgtgtcagactatccttccatt

SEQ ID NO: 64120 - DNA, 201 bp, Homo sapiens
ggacactggatgaagttaactccagagtcagttgaaaggcaactacaggcttctaggcaagagatgatggtgggctggattaggatagggtcaacagggayggagaaggagggtatgtggggattggaatttgagctgggatgaacccctgacctatcaatttttttgcaggatcccataactaaagatctagttcagtca

SEQ ID NO: 64121 - DNA, 201 bp, Homo sapiens
gtaaccagaccctctactgggggcagatgatgacctccactggtaaccagaacctctgtggagagcagatgacaacctccactggtaaccaggccctctayggggggcagatgacgacctctactagtaaccagaccctctgtggagagcagatgacgacccccactagtaaccagaccctctgtggggagcaggtgacga

SEQ ID NO: 64122 - DNA, 201 bp, Homo sapiens
tcaatcactctgcctatacaggcggtaggtaggtcgctggggctccgccccgaggggtgtggccgaccaaagacgcaaagcagtgacctgggtgcatccgrgccaggctgtataaaagcccaggccccagaaggcgcccagaagtttcagagtgtgttcctctccgtctgcaagtagcaaagtgcccggcctgccatatgg

SEQ ID NO: 64123 - DNA, 201 bp, Homo sapiens
aactcctcattccccctcccccttttccccccaaccatctgtctgtctctgattttgattactcttaggtacttcatataagtggaatcacatgactttttatgtgagtcacttttttgtggctggattatttcacttagcataatgtcctcaaagttcatccatgttgtagcatgtgtcagactatccttccattttaag

SEQ ID NO: 64124 - DNA, 201 bp, Homo sapiens
ttggcctaatactttatctattaaaagatttaggtggcatttctcctttattccattaatgtagttctgctttacaattcttgtctggacaatttcagcaktggtcttcattgatgatctttattcttgatgcggagtcacatctgttcccttattcttcaagaaagactattggattttctacactgtgcaacttcagcc

SEQ ID NO: 64125 - DNA, 201 bp, Homo sapiens
ctggaaactagttggaattcacacatgcataaacctggatgtgagagagagctgcttcatgggaacccttgaccaatggggaataggagtgggtgaggagsaaattctcttatccatcccacaggtggacaattctgagatgcgttcattcttcatggttcctcagaggatcccagcagtattgagacataatcacccatg

SEQ ID NO: 64126 - DNA, 201 bp, Homo sapiens
aatgctctttccttggtcattaaggggcctgggagtcctggaccagcttttcatgcagctagaccacttacatgcaactagagccttgactttgaaaccarggacaaaagcatctcttgctaaaggtaacttctgctgcttagaacccaggtatggggaacttctttcatgtctctgtgtttagcctcgaagtgcctctgg

SEQ ID NO: 64127 - DNA, 201 bp, Homo sapiens
agggtaatatggtttacctgggaatcaagggaaaagatctctgtctcttctgtgcagaaattcagggcaagcctactttgcagcttaaggtgagtgattgygcagctaacgagagaagtactgtcatatggactttctatttcatttactatgttactgaataaaaataatatgcttgcaaccctggactattcaatgtaa

SEQ ID NO: 64128 - DNA, 201 bp, Homo sapiens
agaatgctctttccttggtcattaaggggcctgggagtcctggaccagcttttcatgcagctagaccacttacatgcaactagagccttgactttgaaacsaaggacaaaagcatctcttgctaaaggtaacttctgctgcttagaacccaggtatggggaacttctttcatgtctctgtgtttagcctcgaagtgcctct

SEQ ID NO: 64129 - DNA, 201 bp, Homo sapiens
aagaacagaagcaaggagactattgcaatgctccagaagatagagtcaatggtggatttccaagagcagaaccacaaagagtgattgggagtaggactgascaataatattcggtttcaagagtaatgattttctttcatagccaacattgaagccgcgtctgactcctaattcagagttagaaagccacaagacctccaa

SEQ ID NO: 64130 - DNA, 201 bp, Homo sapiens
acatagttctctggcctcaagacaaaacaggttccctggccccacagaactggcattttggtagtggagataataaataaataaatagatggataaatacrttttccaaaaccatggaagcatacattttatgaagaaaatagttgagcaaaataaggggctaggacatgggtgagggactcttggagataggctggctgg

SEQ ID NO: 64131 - DNA, 201 bp, Homo sapiens
ccactccccttttctcttccctgtcttcctcttattcatgagatactacatacatttatttgtttatcaaaaaatatttgttagttcccataagaggtccrcaccattcctgccactgagcacatagttctctggcctcaagacaaaacaggttccctggccccacagaactggcattttggtagtggagataataaataa

SEQ ID NO: 64132 - DNA, 201 bp, Homo sapiens
aatcacatcagggtctccctgaactccctcaccacacactgccctggccaaggagccaaggtgagcctgtgggtctctaggtgtgccagtcatccagatgrgggcaaagctgccagtcccactgactgtttgagtgattctcttgggaggctccatcctggcgataggagagcatcccctggcccttctccatgaggaggt

SEQ ID NO: 64133 - DNA, 201 bp, Homo sapiens
ggaatgaaaactgagcttcatatcaagggttggatgccctcagctgcattcatcagatatttggtttttctctctgagcaaaaagagaaaagatgccatgrggtgtgtctgaataagccctcctaagtttcctatatttatctccttaaaggagactcagcacccacttcatgaaaaaaaaaaaaaaagcaaggtgttttc

SEQ ID NO: 64134 - DNA, 201 bp, Homo sapiens
agactgtacaaaatcagaaagtatagaccatttggatttttttttttttttgagatagagttttgctcttgttgcccaggttggagtgcagtggcgtgatytcagctcaccgcaacctccgcctcctgggttcaagcaatactcctgcttcagcctcccgagtagctgggactacaagcatgtgccaccacgcctggctaa

SEQ ID NO: 64135 - DNA, 201 bp, Homo sapiens
cagacaccgactatatccttgaactcccaagatgaccagagtgagtctcatatccaggggccaacctggactatgctgatatcccaatctagagagaggargctggatgcagaaatccaaggccaacctacttttccttccttctcatcccttaaacttaaaggacagaacccacgacgacttgccttcactctggtgaga

SEQ ID NO: 64136 - DNA, 201 bp, Homo sapiens
tcctgccactgagcacatagttctctggcctcaagacaaaacaggttccctggccccacagaactggcattttggtagtggagataataaataaataaatwgatggataaatacattttccaaaaccatggaagcatacattttatgaagaaaatagttgagcaaaataaggggctaggacatgggtgagggactcttgga

SEQ ID NO: 64137 - DNA, 201 bp, Homo sapiens
aatcagttttatctatgcctataatagcagtgtggccataataaaagccacatctaactgaccaaggccaaagccactagcaatgtcttctccaaactcaycatgtagtttgaaccccaaacaacaaagcttgtttttatctcaaaggaagtgtcaggatcaataatctgaattattcaacaaatatgttttgagcaccta

SEQ ID NO: 64138 - DNA, 201 bp, Homo sapiens
aaatacaaaaaactagcccagtgtggcagtgggtgcctgtagttccagctactcgggaggctgaggcaggagaatcacttgaacctgagaggcggaagttkccatgagccgagatcgtgccactgcactccagcttggcgacagagcgagagcgagactccatctccaaaaaaaaagtaaatgtagcgtgaagattaaaag

SEQ ID NO: 64139 - DNA, 201 bp, Homo sapiens
aggagactatgacccaggggaggcatgtcacataatcattaagaatagagagacttggcttctaacttggctagatttcttagtagctgtatgactttggrtacattctgtcatccctcagagccgctgttttcttacatgagaaataaaattaatggcccctaaagagttgtgtgtgggacgggcgcagtggctcacgcc

SEQ ID NO: 64140 - DNA, 201 bp, Homo sapiens
tgccttcactctggtgagaaagggacatgggaaaacatggttaatccagtctgaaactgacagtctcccactgagtcactcactgtagaacccatcacctraaacaagcatagatggagatcaggcattgagaggacagcctctctccaggatgtctctgaattaatgattggctctgcagctcaatcttttatcctcatc

SEQ ID NO: 64141 - DNA, 201 bp, Homo sapiens
actgcacgtagatcctttcaaatgctttgattcacaaactagtccctgccctatttcccctccatttatcgttatagccactacttctcagagcaatgagwctctctccagaaactcaaaagccattaataccaggatgcaactggagtcctgaagttgataacctcacgtgtattttgtgcatttttgtcatctggcagg

SEQ ID NO: 64142 - DNA, 201 bp, Homo sapiens
agatggtgtgggtcctgagtggaaattctttaatagcagctcctcttagccgcagcattaagcctggtgagtgacaatcaaacccactgttgcttcttgasgtgatgccatcttcaccaggaatgaggctgagcttgcataagcctggccctggacctcacccacttctaggcaccagcccaacagccacaggaaggtcaa

SEQ ID NO: 64143 - DNA, 201 bp, Homo sapiens
tttttcttgggcactattttaacatgttgaagttttcttctattcctagtttgctgggagtttatatcctaagtagatgttacctttggcctaatactttrtctattaaaagatttaggtggcatttctcctttattccattaatgtagttctgctttacaattcttgtctggacaatttcagcagtggtcttcattgatg

SEQ ID NO: 64144 - DNA, 201 bp, Homo sapiens
ctgagaggcacggcctccgattcaaggatcaggaggccaggctgagaggcacggcctccgattcaaggatcgggaggccacgctgagaggcacggcctccrattcaagctctcttcctctttttctgtctctttccacaaggatctgcagccctcacccgagtagcgagcatctaaagcaggactagacgaggcaagggag

SEQ ID NO: 64145 - DNA, 201 bp, Homo sapiens
aacggcctttgaaaatctcggggcacctagctcttttattattatctgtatttagaattgcttgtttattttgatgagaggattttaaaaaacaacatatrgataactaatttaaatattatggggttttttttaccacctagacattttatcattcggaaaaagacaagtcactaatagccctagaaaaaggtgaatctt

SEQ ID NO: 64146 - DNA, 201 bp, Homo sapiens
tttcttcttcctttttttttttttttgtggcaaagtcttgctctgtcacccagggctggagtgcagtggctcaatctcggctgactgcagtctcaacctcygcagactgaagtcatccttctgcctcagcctcccaagtagctgggaccacaggcgcaagccaccatgccccactaatctttgtgtttttttagagacagg

SEQ ID NO: 64147 - DNA, 201 bp, Homo sapiens
gaggcttccagagcctgcggactcgcctccgccggactgtgtagtttgaccattgctctccagcaggaaactggaaataaacccagggctaggcactggcygagctccattctccccggtcctgcgctggcccctccggcggggcctgccgctctcagtgtgccgggccaggatctaccggcagggggcgctctccaccag

SEQ ID NO: 64148 - DNA, 201 bp, Homo sapiens
tctgatttctatttcttgtgtatttttagcagacttctcaaaatgactaggacttcaaatacgatgttgaacaaaagtggaaaaagcaaacattcttgacytgttatgaatcttagggaaaaaaatcaattctttcaccattaagtatgtgctgtagacttttttttcttgggcactattttaacatgttgaagttttctt

SEQ ID NO: 64149 - DNA, 201 bp, Homo sapiens
tgccctaatagaggttccattctggatacgacaacatagggtgacaggtgaatgaacaggtgcctcagatacagcccttaaaacacttcaggtgctgaaasccatggctggtgtcagaggcacctcctagtggttgtccttatgaggtgaagtcctgctctctttcccctgatgttccatatcagatgtcctttgtcacta

SEQ ID NO: 64150 - DNA, 201 bp, Homo sapiens
aacacagcaatggcttcatgcagtttagtgggtcaagagagccacacctctgcctccaagggagacacacctctgcctccaaggaagaccagtaaaggcaytctcctcaactcagcatctggcctaatccgcatttcctcattgctgttttctgatgttgcctctgctcttgttaatcaggaagcacagaccagtcatgct

SEQ ID NO: 64151 - DNA, 201 bp, Homo sapiens
tatataaaattacaaaacaaatgaaaacaaacctatagtgacagaaagcagatctgtagattcctggtgaataggacgggggatgggagggaaggacagaytccaggagacatgaagactctttgggggatggtgaatatgttcatgattttaattttgatgatggtttcacaaacatagacatatgtcaaaacttatcaa

SEQ ID NO: 64152 - DNA, 201 bp, Homo sapiens
atagagaattgcttgaacctggggagcggaggttgcagagagctgagatcgtgccatgcactccagcctgggcgacagagcaagactctgtcttaaaaacwacaacaacaaatacaatcagtggagaaaaaaataccatgttcaacaaatggtgacaaatcaatgagatattcatataatgacaacaaaaaggtgaattat

SEQ ID NO: 64153 - DNA, 201 bp, Homo sapiens
atgaacaactgattttcaacaaacatacaaatacaaccagtgtggctgggtgcagtggctcacacctgtaattccagcactttgggagacctaggtgggcrgatcacctgaggtcaggagtccaagacaagcctggccaacatggtgaaaccccttctctactaaaaatacaaaagttagctgggtgtggtggtgcatgcc

SEQ ID NO: 64154 - DNA, 201 bp, Homo sapiens
gaatattgccaaggataagaagtttatttcacaatgattaacagtacactgacacactgaaaattttaaaatattgctaaaagaaagtttttgaaaggccyaaaaagccagaacgatatgccttcctcaagggtcagaggattcaatattattaaaaagtgaattttccccaacttgacctgtagatccaatacaatccca

SEQ ID NO: 64155 - DNA, 201 bp, Homo sapiens
ggttttcatgaaaaatgggaagatcagacaacattgctcctgaattcccacagagcagcaagctactagagctcaatctgttatttcttttcctgatgtayaggggttaagtcctatggaagaaacagcagaattattcaaaattatttacataatgtgcaattattcactagagcatgaggagtgaaacgctctgtttag

SEQ ID NO: 64156 - DNA, 201 bp, Homo sapiens
gctgggattacaggtgcatgccaccatgcctggctaactgttgtattttttacaatttaatacaattacaattgtattttagtagagacagggtttcaccmtgttggccaggctgaactcttgatctcaagtgattcaagtgattagtatttgcatgatacatctttctccaccttcttacctttaaactgtctacagttt

SEQ ID NO: 64157 - DNA, 201 bp, Homo sapiens
actccagaagctgaggtggtaggatcacttgagctcaggagttcacagctacagtgaactaatgatcatgccactgtactccagcctgggcaacagagcartgtttctaaattcacacacacacacacacacacacacacacacacacacacacacacatatagatatagatatatcaaagtaaattgcagaataaagaat

SEQ ID NO: 64158 - DNA, 201 bp, Homo sapiens
atttttgtcattttgtggtacagatagtgatttcttggatcatctttctccaagcttgtttggcattttctttcctttcttcttcctttttttttttttttgtggcaaagtcttgctctgtcacccagggctggagtgcagtggctcaatctcggctgactgcagtctcaacctctgcagactgaagtcatccttctgcct

SEQ ID NO: 64159 - DNA, 201 bp, Homo sapiens
aacaacacgggttatcaacaagaaaggaggggagataaatatgcagttaaagaactgatcagttaactaccttactagtttgagtcacttacaagtagaasatttctgattataaaaagaatacttcaaagtcaactctaggccgtatggttgggaagtaacaccagaaataagtgaataaactacatggaaacccataat

SEQ ID NO: 64160 - DNA, 201 bp, Homo sapiens
gatttttgtcattttgtggtacagatagtgatttcttggatcatctttctccaagcttgtttggcattttctttcctttcttcttcctttttttttttttttgtggcaaagtcttgctctgtcacccagggctggagtgcagtggctcaatctcggctgactgcagtctcaacctctgcagactgaagtcatccttctgcc

SEQ ID NO: 64161 - DNA, 201 bp, Homo sapiens
ggatctgcagccctcacccgagtagcgagcatctaaagcaggactagacgaggcaagggagctgcaccagggctacccctgagaaagccccagctctcctyggctttctcagtgatgtgtggctttcgtgggctcctcaaaaacagaaactatctttttttattattattatctgtccctttttgctgtttttgataactt

SEQ ID NO: 64162 - DNA, 201 bp, Homo sapiens
ttgatttttgtcattttgtggtacagatagtgatttcttggatcatctttctccaagcttgtttggcattttctttcctttcttcttcctttttttttttktttgtggcaaagtcttgctctgtcacccagggctggagtgcagtggctcaatctcggctgactgcagtctcaacctctgcagactgaagtcatccttctg

SEQ ID NO: 64163 - DNA, 201 bp, Homo sapiens
gtgatggtgtgcatgcacagacacagcctccagggagccgtgagcagaaggggacctccagctgcatccaggactccctctccaacccagccacatcagargggaagggtaccacttggctcatagcgctttcgagaaaccctggatgccagtgaagtcatggggaggctgtgggccaggatccacagggctgcagctggg

SEQ ID NO: 64164 - DNA, 201 bp, Homo sapiens
tcttgatttttgtcattttgtggtacagatagtgatttcttggatcatctttctccaagcttgtttggcattttctttcctttcttcttcctttttttttktttttgtggcaaagtcttgctctgtcacccagggctggagtgcagtggctcaatctcggctgactgcagtctcaacctctgcagactgaagtcatccttc

SEQ ID NO: 64165 - DNA, 201 bp, Homo sapiens
gtgaaagtccttcctggagtaggagtgatggtgtgcatgcacagacacagcctccagggagccgtgagcagaaggggacctccagctgcatccaggactcyctctccaacccagccacatcagaggggaagggtaccacttggctcatagcgctttcgagaaaccctggatgccagtgaagtcatggggaggctgtgggcc

SEQ ID NO: 64166 - DNA, 201 bp, Homo sapiens
catagtaacttctctgtaatgaatatagtatggaaatgggggtgaaagagtaactttacagtggagaaacctaatgaacactatctcagccaggtaatcaagattaacatcagcagtaataagttatgttgacagtatgtaccttagatatgatatataataaaaatagcattttatctctgtgatctccctcccccaaac

SEQ ID NO: 64167 - DNA, 201 bp, Homo sapiens
gtggctcgcacctgtaatcccagtaccttgggaggtagaggcgggcagaacacttgaggccaggagttcaagaccagcctggcaaacatgaagaaaccccrtctctactaaaaatacaaaaactagttgggcatagtggtgcacacctgtaatcccagctacttgggaggctgaggcacgagaatcacttgaatcccagga

SEQ ID NO: 64168 - DNA, 201 bp, Homo sapiens
tgtggctgcttgactggatgagacagaggatgtgaagagccaggttggcatctagcacaaacccacagacacgggttcctccccactctgtctttctcacytctccttcacttttcctaggtatgtaaagaagacattaagaacacggcaaaggccaaatttacattgacttaaatctaagactggttcatgaccaaaaat

SEQ ID NO: 64169 - DNA, 201 bp, Homo sapiens
acatagtaacttctctgtaatgaatatagtatggaaatgggggtgaaagagtaactttacagtggagaaacctaatgaacactatctcagccaggtaatcaagattaacatcagcagtaataagttatgttgacagtatgtaccttagatatgatatataataaaaatagcattttatctctgtgatctccctcccccaaa

SEQ ID NO: 64170 - DNA, 201 bp, Homo sapiens
cctagctcttttattattatctgtatttagaattgcttgtttattttgatgagaggattttaaaaaacaacatatggataactaatttaaatattatgggkttttttttaccacctagacattttatcattcggaaaaagacaagtcactaatagccctagaaaaaggtgaatcttgggactgtgactgcacgtagatcct

SEQ ID NO: 64171 - DNA, 201 bp, Homo sapiens
acacatagtaacttctctgtaatgaatatagtatggaaatgggggtgaaagagtaactttacagtggagaaacctaatgaacactatctcagccaggtaatcaagattaacatcagcagtaataagttatgttgacagtatgtaccttagatatgatatataataaaaatagcattttatctctgtgatctccctccccca

SEQ ID NO: 64172 - DNA, 201 bp, Homo sapiens
acacacacacacacacacacacacacacacagacacacacacgcactctgtctctccctccttcctctcaacccagagactcagagtactagaaggtgccygtggtgatgtgttggaacctcctaacaatcccagatgtgattaatggaaagcataccaagaccatcacagcctagagaagcaggactgtgccagccacag

SEQ ID NO: 64173 - DNA, 201 bp, Homo sapiens
gtggtgaattgcaaatcagcttggaaatatctccatctgacctcatcaaagacaataggatggaaggacccctatcatttgctaagctataaatgtatttkctcttgctaaaacactcagttcctaaaacggcctttgaaaatctcggggcacctagctcttttattattatctgtatttagaattgcttgtttattttga

SEQ ID NO: 64174 - DNA, 201 bp, Homo sapiens
tttttttttgttattagtttatttcacttaactgagtttactttcaagattcatccatgttgtagcatgtatcagaacttcattccttttaaggctgtgtsgtgtgtgtaccacattttctttattcgttcatctgtcgatggacacttgggttgccatcaccttttgggtattgtgaataatgctgctatgaacatgggt

SEQ ID NO: 64175 - DNA, 201 bp, Homo sapiens
acctagctcttttattattatctgtatttagaattgcttgtttattttgatgagaggattttaaaaaacaacatatggataactaatttaaatattatggrgttttttttaccacctagacattttatcattcggaaaaagacaagtcactaatagccctagaaaaaggtgaatcttgggactgtgactgcacgtagatcc

SEQ ID NO: 64176 - DNA, 201 bp, Homo sapiens
attttagggggagaggagaaaaaagcataacatgtttcttctctccttctctcacatggccaactgttaacagcctcctcaccaccatctgatctatcttrttctcttcacaaaaggctctgaagacatcatgaacccacaacgtaagtggtgaattgcaaatcagcttggaaatatctccatctgacctcatcaaagaca

SEQ ID NO: 64177 - DNA, 201 bp, Homo sapiens
cacatagtaacttctctgtaatgaatatagtatggaaatgggggtgaaagagtaactttacagtggagaaacctaatgaacactatctcagccaggtaatcaagattaacatcagcagtaataagttatgttgacagtatgtaccttagatatgatatataataaaaatagcattttatctctgtgatctccctcccccaa

SEQ ID NO: 64178 - DNA, 201 bp, Homo sapiens
gatgatctttattcttgatgcggagtcacatctgttcccttattcttcaagaaagactattggattttctacactgtgcaacttcagcctgcccaccttaygaaactttcaaaaatgggaaattgacccatgcagatgattttccccgagtgactactccctccaggatctgcctgcatgccttgtcttatgcttattcac

SEQ ID NO: 64179 - DNA, 201 bp, Homo sapiens
ggtggcatttctcctttattccattaatgtagttctgctttacaattcttgtctggacaatttcagcagtggtcttcattgatgatctttattcttgatgyggagtcacatctgttcccttattcttcaagaaagactattggattttctacactgtgcaacttcagcctgcccaccttatgaaactttcaaaaatgggaa

SEQ ID NO: 64180 - DNA, 201 bp, Homo sapiens
ttctgtaaatttgaaagctttccaaagtaagaatgcattattatgtattaaaaaagtacttagcagctaacacagtaaaattacagtgtctgacatccaaygcttacaagaaaggcaaagaaacaggaaattcagacacagtatgaggagaaaaattaatcaaagccaacccagaactgatacagatgttaaaatgaacaa

SEQ ID NO: 64181 - DNA, 201 bp, Homo sapiens
ggacttcaaatacgatgttgaacaaaagtggaaaaagcaaacattcttgacttgttatgaatcttagggaaaaaaatcaattctttcaccattaagtatgwgctgtagacttttttttcttgggcactattttaacatgttgaagttttcttctattcctagtttgctgggagtttatatcctaagtagatgttacctttg

SEQ ID NO: 64182 - DNA, 201 bp, Homo sapiens
gtgcctttctgttttaagaaggtctcttttaatggagaattaaattcatttaaatggactgtggtttctgaaatatgtggatttattcctaccatgctttmattttttctttgctttttttcctgatacctctttttctgttcctgtttctccttccctttatggcttcaactggattgagtaaggtggttttgtttgttt

SEQ ID NO: 64183 - DNA, 201 bp, Homo sapiens
caggtgcacaggccgggatctgagagagcgcgtgggcagtccacagggcaggtgaggctctgagagagagtgtgggcagtccacagggcaggtgaggctcyggtgtgtgtcacacccacagtttctgctgactgagtcccatgaacagggccagagccaccggcaacttctgtaccccagatccacattcaggcgctttcc

SEQ ID NO: 64184 - DNA, 201 bp, Homo sapiens
ctagtatgaaggctcatctatcttcacagaaatagaagtggcacaggatgaagtctggtccagaatgaccatactagacactgggcagatgtctgagcccrgtcagcagtgaggagcactctggaactgggagtgaggatctggtccaggggtcctgttctcagaaggcctctctttcaacaacttgtagcaagaagaaaa

SEQ ID NO: 64185 - DNA, 201 bp, Homo sapiens
gccatgagagacttgcaacaatgtacttggatacgtagtacataggttttctgagaagggctgcaaagaatgtgagttctgtaaatagctaaatgtgcagraagaatctataggaagatggtgatgaaaaatgcaatgtaatcctggacagtgcttataaatatcagcttcccagctattccaagggcactgaacatgagc

SEQ ID NO: 64186 - DNA, 201 bp, Homo sapiens
ctttgcacacatctcaaacacttccattgctgcctatgtcttactaacatcctaaatcccttccagctgttttacgggactctcctcatcttcccaaccgwaggcaacatcttatcttctgcgaggtccatagcatttttgccttctcatggaacatttattttcttaggctttgtgctatagcttcttctccttgtcttg

SEQ ID NO: 64187 - DNA, 201 bp, Homo sapiens
aaattctcttatccatcccacaggtggacaattctgagatgcgttcattcttcatggttcctcagaggatcccagcagtattgagacataatcacccatgrcaggtctaagttcaagaatacatcctgaattgacttctctcacttccctgtttcaatttccccagtcccttctcatgttccctagggtcacttgtcatca

SEQ ID NO: 64188 - DNA, 201 bp, Homo sapiens
ataatttgtccccaaaactatgcttctggcattatctcttattgcttcagtgccccgcattctctttgggatactcctgaaccccaccttacatgctgtawgcaggccttttactccagtcattgccgtgcaaccaactttgagacagtgtaacctggcagtgtattatctcagcaacattgaacatttctctcttccagc

SEQ ID NO: 64189 - DNA, 201 bp, Homo sapiens
attttgttcatacaacttcttcaataaaacattataatatgtgccccaaagataaagctgaagaatgagatgaatgtgaaattaaaggtttgcatgtcttyctaatcctaatgaattcttaatgtcattcgttaataatttgacacacagtgtatacacttaacccttgaacaacacgattttgaactgcacaggtccact

SEQ ID NO: 64190 - DNA, 201 bp, Homo sapiens
tcactcgaatgtcactatcccaagatgaaacctaaaaatcactttccattctttcttgatcttaccccaccatccactcagctgccatgcccagtttagtyaaccccccaaatgctgcttcatgcaaccttccattcctattccttttgccaacccatgatgtagagatgtggattcatgacattttgttcatacaacttc

SEQ ID NO: 64191 - DNA, 201 bp, Homo sapiens
ctcattcttactatccaaaagccacctcctcctccaaacatccatttctgtaccaagaccctcactcgaatgtcactatcccaagatgaaacctaaaaatyactttccattctttcttgatcttaccccaccatccactcagctgccatgcccagtttagtcaaccccccaaatgctgcttcatgcaaccttccattccta

SEQ ID NO: 64192 - DNA, 201 bp, Homo sapiens
tttttttttttgttattagtttatttcacttaactgagtttactttcaagattcatccatgttgtagcatgtatcagaacttcattccttttaaggctgtrtggtgtgtgtaccacattttctttattcgttcatctgtcgatggacacttgggttgccatcaccttttgggtattgtgaataatgctgctatgaacatgg

SEQ ID NO: 64193 - DNA, 201 bp, Homo sapiens
tcatctgcctttgtccctagcctctgtcccttcctttgggggcagcagtccctctcctgttacacactcagagctgagttactttagcttcctcctcctaycctcctctctaacaagcctcttttccacccccaggaaaaaaatatcatggacctgtatgtggagaagaaagcacagaagccctttctctttttccacaat

SEQ ID NO: 64194 - DNA, 201 bp, Homo sapiens
agggaagacagtgatgcttcaaagagtcagagcaccttgtgtcagaggatcctggggtggagccaggctatgggaacccagtgagttcccgtttttaacastctaatgccctgcttcatctgcctttgtccctagcctctgtcccttcctttgggggcagcagtccctctcctgttacacactcagagctgagttacttta

SEQ ID NO: 64195 - DNA, 201 bp, Homo sapiens
ccacttttatctcatgggccacatcttaagcatatgaccacattttgctgcaagtgtggtaggaaattttacttctttttgggaagcaacatgtcctggtsacaactggggttctgttattaaggacgaaaaacaaaataggtttgaggagggtgatggagggtctctgccacatggctaatgggaggagcctgtcactat

SEQ ID NO: 64196 - DNA, 201 bp, Homo sapiens
actctcctttgtctctgaaatctccaaatgatggcgttcctcagggctcagccagtcatcatttacaagccctgtgaatgggtaatgagctgatcttttgsattgatgaatcacccctacactcattcactctgccgtttacacttccaacacagatctcctctctcaatagtttacccgtgtcctcttgaggtcctctca

SEQ ID NO: 64197 - DNA, 201 bp, Homo sapiens
cccatgcagatgattttccccgagtgactactccctccaggatctgcctgcatgccttgtcttatgcttattcaccgatgtcagcagtttcccaccccttygctatctgacccaggtcttatagctgtttttgtaaaagtcctgatccaatacaagccaactcagtgacacaaaaataaactcgtgcctttctgttttaag

SEQ ID NO: 64198 - DNA, 201 bp, Homo sapiens
ccttgtctgtatctctagagtacaccacacttcagtaaaatcacatcagggtctccctgaactccctcaccacacactgccctggccaaggagccaaggtsagcctgtgggtctctaggtgtgccagtcatccagatgggggcaaagctgccagtcccactgactgtttgagtgattctcttgggaggctccatcctggcg

SEQ ID NO: 64199 - DNA, 201 bp, Homo sapiens
aagaagacattaagaacacggcaaaggccaaatttacattgacttaaatctaagactggttcatgaccaaaaatgcatgtagctagcatggctttcccaaygcagagagaaaaaggcatggactcagctccaacagactggcgtaatgagtgcagaatatgctgtgaggttttaaatttgctgacaagaaaggttaacgtt

SEQ ID NO: 64200 - DNA, 201 bp, Homo sapiens
gaaatttttctcttttcttgggttctggagagtttgtaaaacaaggacactatgtatttttaaagagttggtaaatcttacctgtaaagctagagaaggtyggagtctttttaggagtagatttggactacataacctgtaaatgtgttttgtccagtccttagagtgttttttaaaaaattgtaaagtcaaggttttcat

SEQ ID NO: 64201 - DNA, 201 bp, Homo sapiens
tagagaaggtcggagtctttttaggagtagatttggactacataacctgtaaatgtgttttgtccagtccttagagtgttttttaaaaaattgtaaagtcraggttttcatgaaaaatgggaagatcagacaacattgctcctgaattcccacagagcagcaagctactagagctcaatctgttatttcttttcctgatgt

SEQ ID NO: 64202 - DNA, 201 bp, Homo sapiens
cccaccctgcacaaggacttgatggaagccatttccaaagacaacatcctttacctacaggtgagctgagccgtggggcctttgatctgatctcttggtgkagggagtccagtcccactactggcttagataagtcatttcccctctaagtcttttttgtaaatcccattcatctgttgctcagtgctgggtatatactgg

SEQ ID NO: 64203 - DNA, 201 bp, Homo sapiens
gcagtcaggaggaaaggatagagagggaggaagaagggaaggaggagagaacggagaaggaagaagtgggggaggaggaggaaagcaccagaggggaaggrgagagggagaaagaggaggaggtggaagaggaagaagagaaggtggagaaggagacagaaaaggaggctgagcaggaaaaggaagaagacagcctgggag

SEQ ID NO: 64204 - DNA, 201 bp, Homo sapiens
tacatgtagtgactctgtgctctctgccccaggctgcacgaagaggagaaaacgggcacaaggatctgccagaaactcaagcagtccagctcgccctctcygcccgaggagcccccggccccaagttcaacctctgtggaaaaaatgtttggaggcaagatagtgactcggatctgctgtctctgctgcctcaacgtctcc

SEQ ID NO: 64205 - DNA, 201 bp, Homo sapiens
aggctgagttgggctcttctagagtccggacagagcccaccctgcacaaggacttgatggaagccatttccaaagacaacatcctttacctacaggtgagmtgagccgtggggcctttgatctgatctcttggtggagggagtccagtcccactactggcttagataagtcatttcccctctaagtcttttttgtaaatcc

SEQ ID NO: 64206 - DNA, 201 bp, Homo sapiens
cgtaattataaacatgtttacatgttttaatattacatttttttttttttgagacagagtcttgctctgttgcccaggctggagtgcagtggcgtgatctyggctcattgcaagctctgcctcccaggttcacgccattctcttgcctcagcctcctgagtagctgggactacaggcgcctgccaccacgcctggctaatt

SEQ ID NO: 64207 - DNA, 201 bp, Homo sapiens
tggctgttggggaaggtaaatgggcatggataagctgagtgccccggaaggggacccgcatgtacatgtagtgactctgtgctctctgccccaggctgcaygaagaggagaaaacgggcacaaggatctgccagaaactcaagcagtccagctcgccctctccgcccgaggagcccccggccccaagttcaacctctgtgg

SEQ ID NO: 64208 - DNA, 201 bp, Homo sapiens
ttggctgaggccaagcagctggatcgtgggctctggcctccctttgactgtgaggagaggagtagtcatcctattttgcagatgaagaaactgaggcaggrtgtcttagatcatattgttgggaaaaggagtcacctgcctgcagagctcagagccccatctgggtcaggggacagtggtcaggtgggcaagcctccctac

SEQ ID NO: 64209 - DNA, 201 bp, Homo sapiens
ccgccgccgcctgggctctgtgatgcgccccacagaagacatcacagcccgggagttgcccccaccaaccagtgcacaggggccaggcagggtgggtcctsggaggcaaaggaaacactgcatcacagaggacaccccccccaccagcctgtacatcgaaggcctggactccaaggaagctggtgggcagagcagtcagga

SEQ ID NO: 64210 - DNA, 201 bp, Homo sapiens
ctctttggcttcctagaacacagccaggtgagtgtaggggcagtcagaggggggtggagaggcagctctggtcaggccccgacatggacacctttcccttycccaggacctgcctgcatctggctgtcatctcccatgtcagttgctgagcccctggccgggctggcatatggaactgatttagtgccctgctggggcagg

SEQ ID NO: 64211 - DNA, 201 bp, Homo sapiens
ttgggcagtatggccattttcatgctattgagtcttcctatctatctgtgagcatggaatgtttttccatttgtgtcctctccttcacttcccttgttagytgtattcctaggtattttattctgtttgtagcagttgtgaatgggagtttgttcatgatttggctccctgcttcttgttggtgtataggaatgctagcaa

SEQ ID NO: 64212 - DNA, 201 bp, Homo sapiens
aaagcccttggccagggattatgcaaagctctgtgtgggggcacagaaatgagtaatccctccctggctcatggagggaagggaaaggtcagtgagggagrgttgggaagatgacatggaagaggcagcgctgtatctgggactcatcttgacgggagagaatggcagtgagtggaggcagggagagaatgtttgaggtgt

SEQ ID NO: 64213 - DNA, 201 bp, Homo sapiens
agacgagggctttggatgctgagctgttttgaagctctgtggagccctggacaaatctaaggcattgtgaccaggatctggaaacaagaacagggctagargaactgttaggaatgttgctgaactctaagtagcgggatgtggtgcttagatgttgttctttggaagatacctctagcatcattagaactagtgcttggt

SEQ ID NO: 64214 - DNA, 201 bp, Homo sapiens
tttgcttttgttgcaattgcttttgatgtttccatcattaaatctttgcctatgcctatgtcctgaatggtatttcctagattttcttctaggggtttaayacctttgggttttacatttaagtctttaatccatcgagtgaattttttgtataaggtataaggagggggtcgaatgtcaacattctgcctatggctagcc

SEQ ID NO: 64215 - DNA, 201 bp, Homo sapiens
tcacagcccgggagttgcccccaccaaccagtgcacaggggccaggcagggtgggtcctcggaggcaaaggaaacactgcatcacagaggacacccccccmaccagcctgtacatcgaaggcctggactccaaggaagctggtgggcagagcagtcaggaggaaaggatagagagggaggaagaagggaaggaggagagaa

SEQ ID NO: 64216 - DNA, 201 bp, Homo sapiens
ccaggcctatgacctctgcagtgtggtggtgcactctggagtgtcttcggagagtggtcactactactgctatgcccgtgagggcgctgcccgccctgccscttctctgggaactgccgataggccagagcccgagaaccagtggtacctgttcaatgacactcgggtgtccttctcttccttcgaatctgtcagcaacgt

SEQ ID NO: 64217 - DNA, 201 bp, Homo sapiens
ggtcactactactgctatgcccgtgagggcgctgcccgccctgccccttctctgggaactgccgataggccagagcccgagaaccagtggtacctgttcartgacactcgggtgtccttctcttccttcgaatctgtcagcaacgtcacctccttcttccctaaggacacagcctatgtgctgttttaccggcagcggccc

SEQ ID NO: 64218 - DNA, 201 bp, Homo sapiens
tgtcagctagtcagtcacaccctagtatcagctggctcagggactagagtttttattgagaggagggggtcttttgaagtcttttgaaggtgtccaccccrgatatcctgccactgagctgcaatgtctctgtgtgtccaggccctggggacctagaggaaacattgaaaggtgttgtgctgggtagactcactctggctt

SEQ ID NO: 64219 - DNA, 201 bp, Homo sapiens
gatgaagacaaggatgaggatgaaggctctccagggggctgcaatcctgcaggtggcaatggtggtgacttccacagactggtcttctaatgtgaacctgytgccaacctgaccccttccctccaggagccaggtagggcctgagggaagctgtggaggcaggccctaccaagaggaaggatggtacagctcatggcacct

SEQ ID NO: 64220 - DNA, 201 bp, Homo sapiens
gcgtgctgtcagcagggaccacagccccgtgtctcaggtgggcgggttggtgctgagcctgacgcagctctgctcccacagctcctccctcacatcccccscatggtggcctctctggtcaaggaggactcgaactcggggaccagctgcctggagcagctggcggagctggtccactgcatggtgttccggttcccgggc

SEQ ID NO: 64221 - DNA, 201 bp, Homo sapiens
ttttctaattctgtgaatgtgaatggtagtttaacgggaatagcattgaatctgttaattacattgggcagtatggccattttcatgctattgagtcttcctatctatctgtgagcatggaatgtttttccatttgtgtcctctccttcacttcccttgttagctgtattcctaggtattttattctgtttgtagcagttg

SEQ ID NO: 64222 - DNA, 201 bp, Homo sapiens
ccttccctagcaggctccccatgcgggaagatctgatgatgttcaggaaacaggctagacctcagctccaatgttttgacatcaagtactattttccttcsgactgctgtacggtataaagcacagcaggatccaagccttgcacaaaggggtggggggggcagtgtctcctctggctgtcctgtttgtttgtttctcata

SEQ ID NO: 64223 - DNA, 201 bp, Homo sapiens
tttctaattctgtgaatgtgaatggtagtttaacgggaatagcattgaatctgttaattacattgggcagtatggccattttcatgctattgagtcttcctatctatctgtgagcatggaatgtttttccatttgtgtcctctccttcacttcccttgttagctgtattcctaggtattttattctgtttgtagcagttgt

SEQ ID NO: 64224 - DNA, 201 bp, Homo sapiens
gttcaggaaacaggctagacctcagctccaatgttttgacatcaagtactattttccttccgactgctgtacggtataaagcacagcaggatccaagcctkgcacaaaggggtggggggggcagtgtctcctctggctgtcctgtttgtttgtttctcatatgggggtggggggtacctgcactgtctgtacctttctgag

SEQ ID NO: 64225 - DNA, 201 bp, Homo sapiens
ctgtccatctgggtctgtgagcacctcagtgttgatccctctgcatgggtttgaactctagggtgtctctgagtcccctctcaggcttgtgattctacttsgcctcagcagctcaagcctggggactcctgaccagggactctcttgtaggttttctctaagctgctgtaccccatcgtccggggagctgccttgtctgtg

SEQ ID NO: 64226 - DNA, 201 bp, Homo sapiens
ttctaattctgtgaatgtgaatggtagtttaacgggaatagcattgaatctgttaattacattgggcagtatggccattttcatgctattgagtcttcctatctatctgtgagcatggaatgtttttccatttgtgtcctctccttcacttcccttgttagctgtattcctaggtattttattctgtttgtagcagttgtg

SEQ ID NO: 64227 - DNA, 201 bp, Homo sapiens
tctaattctgtgaatgtgaatggtagtttaacgggaatagcattgaatctgttaattacattgggcagtatggccattttcatgctattgagtcttcctatctatctgtgagcatggaatgtttttccatttgtgtcctctccttcacttcccttgttagctgtattcctaggtattttattctgtttgtagcagttgtga

SEQ ID NO: 64228 - DNA, 201 bp, Homo sapiens
cttctcttccttcgaatctgtcagcaacgtcacctccttcttccctaaggacacagcctatgtgctgttttaccggcagcggcccagggaggggcccgagkctgagttgggctcttctagagtccggacagagcccaccctgcacaaggacttgatggaagccatttccaaagacaacatcctttacctacaggtgagctg

SEQ ID NO: 64229 - DNA, 201 bp, Homo sapiens
gggagcggacatgtggctctgagggctcccgctccgtcctggacctggttaactacttcctgtcccccgagaagctgacagcagaaaaccgctactactgygagtcgtgtgcctccctgcaggatgccgagaaggtggtggagctgagccaagggccgtgctacctcatcctcacactgctgcgcttctctttcgacctgc

SEQ ID NO: 64230 - DNA, 201 bp, Homo sapiens
tctctttcgacctgcgcaccatgcggcgccgcaagatcctggatgacgtctccatccccctgctgctccgcctgccactggctggtggccgtggccaggcmtatgacctctgcagtgtggtggtgcactctggagtgtcttcggagagtggtcactactactgctatgcccgtgagggcgctgcccgccctgccccttctc

SEQ ID NO: 64231 - DNA, 201 bp, Homo sapiens
ctgtttgatgtgacacagataatgagtgggaagcatgccaaggaccaagacccatacctcagaccccagggattcacccactgtcctgactgtagggtcargttttggggaggtgactctctcttcttgaaagctgattctgcaaatctaaaagtaaaaggtggacatgggcacatcattgtgtgcccacaccatgaaaac

SEQ ID NO: 64232 - DNA, 201 bp, Homo sapiens
ccaagggccgtgctacctcatcctcacactgctgcgcttctctttcgacctgcgcaccatgcggcgccgcaagatcctggatgacgtctccatccccctgstgctccgcctgccactggctggtggccgtggccaggcctatgacctctgcagtgtggtggtgcactctggagtgtcttcggagagtggtcactactactg

SEQ ID NO: 64233 - DNA, 201 bp, Homo sapiens
ttccacctggtaaggtcccctgcctgctgcccctggtgaggcccctgcctgctgcccctggtaagggccctgcctactgcccctggtaagggccctgcctrctgaccctgggctcttggggcaggtcacttggctgaggccaagcagctggatcgtgggctctggcctccctttgactgtgaggagaggagtagtcatcct

SEQ ID NO: 64234 - DNA, 201 bp, Homo sapiens
acctggtaaggtcccctgcctgctgcccctggtgaggcccctgcctgctgcccctggtaagggccctgcctactgcccctggtaagggccctgcctgctgmccctgggctcttggggcaggtcacttggctgaggccaagcagctggatcgtgggctctggcctccctttgactgtgaggagaggagtagtcatcctattt

SEQ ID NO: 64235 - DNA, 201 bp, Homo sapiens
cccctctctgggcctcagattctccccattagtttccctgactactcatccaagtatgtgtgtctgacttttggtgtgtccatccattcctcagatatctrtgttgctgtccatctcaccatctgtctgtccatctgggtctgtgagcacctcagtgttgatccctctgcatgggtttgaactctagggtgtctctgagtc

SEQ ID NO: 64236 - DNA, 201 bp, Homo sapiens
gagtcgtgtgcctccctgcaggatgccgagaaggtggtggagctgagccaagggccgtgctacctcatcctcacactgctgcgcttctctttcgacctgcrcaccatgcggcgccgcaagatcctggatgacgtctccatccccctgctgctccgcctgccactggctggtggccgtggccaggcctatgacctctgcagt

SEQ ID NO: 64237 - DNA, 201 bp, Homo sapiens
tgattccctgaggtctgtggggacagagagcctcaggccattgccaaggcaggtcaggactggatgggaactcaagaaggggcttaaggggctgggcagcmctgggaagtggggtctgctctgggttggctgacatcactgacttttcttctagagtctgtgggggtggattttgtcttccagagtagaactgccacccat

SEQ ID NO: 64238 - DNA, 201 bp, Homo sapiens
tggtacaagccagtttgagaggcaaggcagcaaattataggattttactgcttataaaattatttcgcatgggttctatgagtacatccttttgtacataygcctttgtaaataagttctggaaagttctctgacttaggcagatgtatcaggttgtggcggtttctttgggacctgtgatacttgccaagggagccatca

SEQ ID NO: 64239 - DNA, 201 bp, Homo sapiens
ttaagttccttgtagactctggatatcggacttaggtcagatgggtagtttgcaaaaattttttttcattctgtaggttgtgtctactctgatgatagttycttgtactccgcataagctctttagtttaagtggatcccatttgtcattgtttgcttttgttgcaattgcttttgatgtttccatcattaaatctttgcc

SEQ ID NO: 64240 - DNA, 201 bp, Homo sapiens
tttttttcattctgtaggttgtgtctactctgatgatagtttcttgtactccgcataagctctttagtttaagtggatcccatttgtcattgtttgctttygttgcaattgcttttgatgtttccatcattaaatctttgcctatgcctatgtcctgaatggtatttcctagattttcttctaggggtttaatacctttgg

SEQ ID NO: 64241 - DNA, 201 bp, Homo sapiens
ccatgcggcgccgcaagatcctggatgacgtctccatccccctgctgctccgcctgccactggctggtggccgtggccaggcctatgacctctgcagtgtkgtggtgcactctggagtgtcttcggagagtggtcactactactgctatgcccgtgagggcgctgcccgccctgccccttctctgggaactgccgataggc

SEQ ID NO: 64242 - DNA, 201 bp, Homo sapiens
gttttacatttaagtctttaatccatcgagtgaattttttgtataaggtataaggagggggtcgaatgtcaacattctgcctatggctagccagttcttcyagcaacatttattaaacagggaatcttttacccattgcttgtttttgtcaggtttgttgaagatggttgtaggtgtggagtcttatttctgagtgagttc

SEQ ID NO: 64243 - DNA, 201 bp, Homo sapiens
gtcgtgtgcctccctgcaggatgccgagaaggtggtggagctgagccaagggccgtgctacctcatcctcacactgctgcgcttctctttcgacctgcgcmccatgcggcgccgcaagatcctggatgacgtctccatccccctgctgctccgcctgccactggctggtggccgtggccaggcctatgacctctgcagtgt

SEQ ID NO: 64244 - DNA, 201 bp, Homo sapiens
ggtgtttggtgtgtgcatgtgtgtttgtgtgcgtctcaatgtgtggctgttggggaaggtaaatgggcatggataagctgagtgccccggaaggggacccrcatgtacatgtagtgactctgtgctctctgccccaggctgcacgaagaggagaaaacgggcacaaggatctgccagaaactcaagcagtccagctcgccc

SEQ ID NO: 64245 - DNA, 201 bp, Homo sapiens
ctattctgttccattggtctatgtgtctgtttttataccagtactatactacaaggctacagtaagcaaaacagcatagtttgaagtcaggtaggcattargcttccacttttgttctttttgcttaggatggtcttggctatatggactttttggctccgtatgaattttaaaatagttttttctaattctgtgaatgtg

SEQ ID NO: 64246 - DNA, 201 bp, Homo sapiens
ctgcgagtcgtgtgcctccctgcaggatgccgagaaggtggtggagctgagccaagggccgtgctacctcatcctcacactgctgcgcttctctttcgacstgcgcaccatgcggcgccgcaagatcctggatgacgtctccatccccctgctgctccgcctgccactggctggtggccgtggccaggcctatgacctctg

SEQ ID NO: 64247 - DNA, 201 bp, Homo sapiens
acactgcatcacagaggacaccccccccaccagcctgtacatcgaaggcctggactccaaggaagctggtgggcagagcagtcaggaggaaaggatagagrgggaggaagaagggaaggaggagagaacggagaaggaagaagtgggggaggaggaggaaagcaccagaggggaaggagagagggagaaagaggaggaggt

SEQ ID NO: 64248 - DNA, 201 bp, Homo sapiens
gtttgaagtcaggtaggcattaggcttccacttttgttctttttgcttaggatggtcttggctatatggactttttggctccgtatgaattttaaaatagttttttctaattctgtgaatgtgaatggtagtttaacgggaatagcattgaatctgttaattacattgggcagtatggccattttcatgctattgagtctt

SEQ ID NO: 64249 - DNA, 201 bp, Homo sapiens
agcagaaaaccgctactactgcgagtcgtgtgcctccctgcaggatgccgagaaggtggtggagctgagccaagggccgtgctacctcatcctcacactgstgcgcttctctttcgacctgcgcaccatgcggcgccgcaagatcctggatgacgtctccatccccctgctgctccgcctgccactggctggtggccgtgg

SEQ ID NO: 64250 - DNA, 201 bp, Homo sapiens
tcctagagcctcgttcatttctctgagcccaatgccctgctcagccctgctcagaggcgtggacatgtgggctgggttgggtcagggacaatagaaaagcrgggaggacctcatggaggaggccaggaagtttgaggccgagggaatgaggtagaccctcaggcctaacctgtgcagagctggctggtgagtggcctcctg

SEQ ID NO: 64251 - DNA, 201 bp, Homo sapiens
agggggtcttttgaagtcttttgaaggtgtccaccccggatatcctgccactgagctgcaatgtctctgtgtgtccaggccctggggacctagaggaaacmttgaaaggtgttgtgctgggtagactcactctggcttcagggtgtgaattctaagtctaagtctcctctcatctgtgttcccaggagcaggagaaggagg

SEQ ID NO: 64252 - DNA, 201 bp, Homo sapiens
acatgtagtgactctgtgctctctgccccaggctgcacgaagaggagaaaacgggcacaaggatctgccagaaactcaagcagtccagctcgccctctcckcccgaggagcccccggccccaagttcaacctctgtggaaaaaatgtttggaggcaagatagtgactcggatctgctgtctctgctgcctcaacgtctcct

SEQ ID NO: 64253 - DNA, 201 bp, Homo sapiens
aaggaaacactgcatcacagaggacaccccccccaccagcctgtacatcgaaggcctggactccaaggaagctggtgggcagagcagtcaggaggaaaggrtagagagggaggaagaagggaaggaggagagaacggagaaggaagaagtgggggaggaggaggaaagcaccagaggggaaggagagagggagaaagagga

SEQ ID NO: 64254 - DNA, 201 bp, Homo sapiens
aaggatcgccatgaggctgacgtcctggtagcaggaggatgggctttctcataggcagagcccattcctcgtgatcatgaggcctgcggacaggttcccgygtggtgtgatatgaccctcgaagtcctcagacctctcggtaccacattaggcccttgtcagctagtcagtcacaccctagtatcagctggctcagggact

SEQ ID NO: 64255 - DNA, 201 bp, Homo sapiens
atattagcttactgagccatgcagcacctcccaagtgctgatataccactgttaaaaacccaacccccaaacccctaccttccttaacatctccaggggcstcatcagaaaagccttggagtaaggaaaagctgctaagctcacagtagttcataaaagttttccagaattctggtttttcttgaaagcacaaatgttgtc

SEQ ID NO: 64256 - DNA, 201 bp, Homo sapiens
tattagtttacgttggtaactttctcaagaacaggaaactagtcttctttttgtaatttttatcggctgtcacggcatcattcttggtgatctcttctctygtgctcaaaccagactttaaactcttcttcagctgtttgtggagcacacagtcccaagtacatgaagcaacataactttaggcaatgcaagataaataat

SEQ ID NO: 64257 - DNA, 201 bp, Homo sapiens
gcacacagtcccaagtacatgaagcaacataactttaggcaatgcaagataaataatagccctttcataaggacgctctggctttttattctataggcttktatagaccatttcctttcacagtttttactctgtgggcttgtatggactgaccatttcctttcagtttttagtagatctagggcttttaaagaagggctt

SEQ ID NO: 64258 - DNA, 201 bp, Homo sapiens
ttgtactagtgactttttaaagattgaaaagtcaaattagatttaatagctctgagagtgtagtttagagtttatctaataggtgggaatttttttactcytttagaacaccggcttattaagaggtgccttttcttggctgtggagtattgcatcctgtcggtaaccacagtgcccttctcctcccctcttccaggtatt

SEQ ID NO: 64259 - DNA, 201 bp, Homo sapiens
cttggttaacttaaggcacctttttaaaagcagaatttaatttgatttaaattttccagattttatagcttgcctgtatggatgctcctcaatttatgatrgggttacatcccaataaacttattttatttgcctttgctttgttggttaaaaaaaaatttcttttaaaaaaccatcttaaattgaaaatacatttaatac

SEQ ID NO: 64260 - DNA, 201 bp, Homo sapiens
acactgggccagttgctcatttctgcagttagaaaggaatgacagtgttttggaacagaagctcgtttcagctctttcacttgggtacttaaatttagcayggatctgaagactcgtgcagtacttagtaaggaagaacactggttaggaagaaggatcttactctgctgagaagaagaatgctttgttgcctttagtaag

SEQ ID NO: 64261 - DNA, 201 bp, Homo sapiens
gacgctgttggtggtgttttcattgcagcgttcaccctttctggcctgtgtttattgttgacacatatttcatttctacacatgctataatcccacaaccrttgttatttttgctttaaaaagttgattgttttgtaaaggaaataagagctgagggaaaaaagagtcttcatttgcccacatttgaccatgcctggagct

SEQ ID NO: 64262 - DNA, 201 bp, Homo sapiens
tttgtgtctgccttggtgggactcatcctctttgtgtgttttactggtttgttttgtcgtactgatgagaagtatttttccatttttcttttctttttttstttttgttttttgagacggagtcacgctgtgtcacccaggctgaagtgcattggcccgggtttgagtgattctcctgcctcagcctcctgagtggctggg

SEQ ID NO: 64263 - DNA, 201 bp, Homo sapiens
gtggggcatgctgtttctggtgaaccagctgtttaaaatctacttcaaggtgtgcttctgtttgaatcctttctgtctttacaattttcgattgtcctggrcttcccacatatcatatatatatcagctagcctccctggcgttgcttgtgaaatgatcataaccgtattcctagtcctaatagcaaacatttgttgaatg

SEQ ID NO: 64264 - DNA, 201 bp, Homo sapiens
aattttcccctgtgtggcattcagtgtattgttgtaggttctattcgaacagaatattttattttctacttaggtttccctttcaaatgtttcaggtgtaygaagccatcgacagcagagatggagcatcttgtgcagagttggtgtcttttaaacatcctcatgttgcaaacccacgacttcaagtaggtgaaagagctg

SEQ ID NO: 64265 - DNA, 201 bp, Homo sapiens
cacatccagctaatttttgtaattttttttgtagagacgggctttcaccatgttggccaggctggtcttgaacttctagcctcaagtgatctgcccacctygccctcccaaagtgctgggattacaggcatgagccactgtgctcacggcctgaaccttttatttagagtggtaaatataaagtgttactgtgaactgtaa

SEQ ID NO: 64266 - DNA, 201 bp, Homo sapiens
cagatttatataaacatttgctcagatttccacactgttcatatagagggagaggttccattttgtggttaaccatttatggtatgtgttatttttatgamgtgagtggaacaacaacaaatgagcttattctgcatctcttctacctttaagatgtggcctgctcccccaccaaaaagaattcagcttcatatagatttg

SEQ ID NO: 64267 - DNA, 201 bp, Homo sapiens
tggggcaccaccgtgttccttgtagtacaaagcacctgtgatttcctagctctgtgcagtgtgcgataggttccagatttggcgatgaactaacactgacrttacccagctgggaatctagtttgaatgtcattgtcagcccctgctagagtggaagggtcatactatgttatcaacatgtgttactcataaacctgctgg

SEQ ID NO: 64268 - DNA, 201 bp, Homo sapiens
ttactgtgggacttcctcttatcctcacctgtttgtgttcagccatttgtgtgtttcttccttcactcctttcatcccaggaccactgggacctgtgcaaygaagtgagctgtgtgggctgcataactagtgctaggtttttattgtgtgacagcatgtttctgtttctcctccaggtgcacttatgcagtggggaatcat

SEQ ID NO: 64269 - DNA, 201 bp, Homo sapiens
gagctgtgcacacagatgtctgcagacaattacagggtaaccactttcctaagagaagcgtagagtttgagtaagaagaaaactaatattgtcactcttayttgaaaattttaaagtttctttatgatttgtgtaatttcaatccatttgtggagcactgactatgtacgcacactgtggtgatgtggacctcctgccctt

SEQ ID NO: 64270 - DNA, 201 bp, Homo sapiens
ttttttttttacaccacttacctcaagttctatacttgccaatcttttgatgtaagcccagggccttttctttaggctgtgtctgttttggcctaatcttwgcagacttaacattttccaatataagtttatttaaagttaaacaaggatataggcatttaagaaccaatttgatacgattatctttagaattttcttaat

SEQ ID NO: 64271 - DNA, 201 bp, Homo sapiens
aagttctatacttgccaatcttttgatgtaagcccagggccttttctttaggctgtgtctgttttggcctaatctttgcagacttaacattttccaatatmagtttatttaaagttaaacaaggatataggcatttaagaaccaatttgatacgattatctttagaattttcttaatcttttacaatttttcccccatacc

SEQ ID NO: 64272 - DNA, 201 bp, Homo sapiens
attatataaataattgttatgatataataggttttgtaatttgcattttaaggagacatgcttagtaatttgttttgccacctgtttttgttgtttttaartattttaaatggattgttattcattatagatcaacaaactccatttatgtaaacccctaattagagcaattgacagctcaaacctgaaagacgattacag

SEQ ID NO: 64273 - DNA, 201 bp, Homo sapiens
ttgatacgattatctttagaattttcttaatcttttacaatttttcccccatacctaattatttttttaacaaactcaagtgagccttttaaaaacatacmacttagcttatagagaaacaactgtttccttttgcattcatatttcattgatgagcttaaaagtacataactaccataacaggttcgggtagcaaaaata

SEQ ID NO: 64274 - DNA, 201 bp, Homo sapiens
taggaccacccctgggacacattcatgcctgccaagcaagctggggccctccttgggctcaaggccctgtggcactgagccctcctctggtcaggtcaccygtgggacactgggtgcagcccaggtaggtgtggccaagcagagcccaggatgtggcgacatcaccctgcatatgtgcagggaccaccctgggaggtcaca

SEQ ID NO: 64275 - DNA, 201 bp, Homo sapiens
tgtttcctccagggaaagttccaaatgctttagcacatcatctggtccatgtttacctgttaacttggcatcaccagtctgaaggtttatttcacttatgytgaatgcaccattgccccaccgaagtactcataacttaaaatataccatttaaccattttaaagtacacaattaagtacattcacaatattgcacaacca

SEQ ID NO: 64276 - DNA, 201 bp, Homo sapiens
attcacaatattgcacaaccatcaccattatccagaattttttgtcaccccaaatggaaatgtcataagcattaagcagtcactccctggtcctccctccygagcgcttgtcaaccgctaatgtgctctctgtctgtatggatttgctgactctggtgatttcagtatgtggcttttgtgtgtctttcccttgcatcatgt

SEQ ID NO: 64277 - DNA, 201 bp, Homo sapiens
atcatttgcattagattctgccttctccatcctgtatttccttttgggatgtacatgtgacacacacacagacataaacacacatatttttcttgtttccyttcattcttatacaagacgcagcattctatacatactcttttacaacttgcttttttcacttaactgtatcttcctagaaattattgcatgtaaattcct

SEQ ID NO: 64278 - DNA, 201 bp, Homo sapiens
gctggagtgcagtggcgcgatttctgctcactgcatgcaagctccgcctcctgggttcgcgccattctcctccctcagcctcccgagtacctgggactacrgatgcccaccaccacacccggctaatttttttgtatttttagtacagatggggtttcattgcgttagccaggagggtctcgatcttctgacctcatgatc

SEQ ID NO: 64279 - DNA, 201 bp, Homo sapiens
taaccaaaggccttttgcaaacaaacccgcccttttatctttttttttttttgagaaggagtcttgctcagtcgccgaggctggagtgcagtggcgcagtmttggctcactgcagcctctgcctcccgccacccttttatcttttaacgtgaaaacttgcacatgaaaacagtccagttttgccagttggctgtaaaagtt

SEQ ID NO: 64280 - DNA, 201 bp, Homo sapiens
tgagatgtgtctggtatagggagcaaaagaaagatattgactattctttctgggttaacaccaacagatttatataaacatttgctcagatttccacactrttcatatagagggagaggttccattttgtggttaaccatttatggtatgtgttatttttatgaagtgagtggaacaacaacaaatgagcttattctgcat

SEQ ID NO: 64281 - DNA, 201 bp, Homo sapiens
gtaatttttctcttcttttttctcccaaatcaagttatacagttttcctgcagttaactttttttttcatttaatcatcatattgtggacattttctcatsttactacatacagatctattttattctttttaacagcagccgagtatcgcattgtatgaatgtgacatctatttagctatttccattttccttttatttt

SEQ ID NO: 64282 - DNA, 201 bp, Homo sapiens
agaagccccttagttgagcaaggttggagtctgttggggctcctgtggctaggcctgcccacatggcacagggagggccactttggaaggcatatcctctytggggctaaactgactaatactggttttcttgggggacttgcagaccaagacctgggtgggatcggttgttttgccttccatcccagggccaactactga

SEQ ID NO: 64283 - DNA, 201 bp, Homo sapiens
ttgttagtcagaaaggctggcaagccaaggcccagcctggggttgtacatggagtttccatgtcatctgtggcgtagatgatgttgaggcagtattttctrtagaaaatcttgtggacatttggtaaagccctgtttcctcattgacaccctttatcatattggagtgtgttcctactggaagcagcatttttcttttgga

SEQ ID NO: 64284 - DNA, 201 bp, Homo sapiens
gtggctgtggggaactcttagcttgaacctcctgtttgtgtggaaccaaagagagcacggcttggccagcaggctccagaaccgctttctagccagaagcsccttagttgagcaaggttggagtctgttggggctcctgtggctaggcctgcccacatggcacagggagggccactttggaaggcatatcctctctggggc

SEQ ID NO: 64285 - DNA, 201 bp, Homo sapiens
acatgcagtggattacttgggacttgagacccggaaacactgggccagttgctcatttctgcagttagaaaggaatgacagtgttttggaacagaagctcrtttcagctctttcacttgggtacttaaatttagcatggatctgaagactcgtgcagtacttagtaaggaagaacactggttaggaagaaggatcttactc

SEQ ID NO: 64286 - DNA, 201 bp, Homo sapiens
gatcttagtatctgtctgtctaccttttagatgaaatccctaaacctgtggccagggctatgaagagaaacttagtttccataatacttgggcccaaatcrtcttgcacccatttgtgactttgaaaatgtcaggagctaggctatgatgtgacgttgagcagcagcttgtgaccttgcatggactggggcaggagggctg

SEQ ID NO: 64287 - DNA, 201 bp, Homo sapiens
caggtaggtgtggccaagcagagcccaggatgtggcgacatcaccctgcatatgtgcagggaccaccctgggaggtcacaggcaaaggagggctaccagtragtgcccccagcaggggtctccgcctctccttggagggccccggtgtctgtactccagggtttgatcccttcgtgaccactgtgtccccagtgtgtttag

SEQ ID NO: 64288 - DNA, 201 bp, Homo sapiens
ccagacgctgttggtggtgttttcattgcagcgttcaccctttctggcctgtgtttattgttgacacatatttcatttctacacatgctataatcccacarccattgttatttttgctttaaaaagttgattgttttgtaaaggaaataagagctgagggaaaaaagagtcttcatttgcccacatttgaccatgcctgga

SEQ ID NO: 64289 - DNA, 201 bp, Homo sapiens
gtcgttcttttttatggctaatgatattccattgtatggagtattttgtttatccattcatcagttgatggaccacttcagttgtttcctctttttggctrttgtgctgctgctgtgaacattcttgcgcaggttttgtattctttttggcatatacctaagagtggaattgctgagtcatatggtaattctgtgtttaac

SEQ ID NO: 64290 - DNA, 201 bp, Homo sapiens
ctcatgctggaagacaaagaggagcccactacatggcaagagaggaggcaggagatagaaggggaggcgccaggctcttccacaaccagctgtctgggaaygctcacaggagctcagagcgagaactcattcattatggcaaggacagcaccaagccattcatgaggggtccacccccatgacccaaaaacctcccattag

SEQ ID NO: 64291 - DNA, 201 bp, Homo sapiens
tttgtgtgtctaaacagatctaaacacagaaaagatgcagtaaaaatacagtgtgagactccgtagggccccatctcacatgtggtcaagtgtgagactcygtagggccccatctcacatgtggtcaagtgtgagactccgtagggccccatctcacatgtggtcaagtgtgagactctgtagggccccatctcacatgtg

SEQ ID NO: 64292 - DNA, 201 bp, Homo sapiens
atgtggtcaagtgtgagactccgtagggccccatctcacatgtggtcaagtgtgagactccgtagggccccatctcacatgtggtcaagtgtgagactctrtagggccccatctcacatgtggtcaagtgtgagactctgtagggccccatctcacatgtggtcatctgtagttgaccgaaatgttgtgtaacatgtgact

SEQ ID NO: 64293 - DNA, 201 bp, Homo sapiens
attgacgaagttcagtgtattctggctaacttgatatacatggtgtgtgagtcctggttttaatttaagcagctactcacagcaagattcagcccagaatytgaagcttcagtgtggtggtgttaaaattgttaaaaggccttctgctttttttttgatagaactaattttagcccaggaaataccattcaccagggcctt

SEQ ID NO: 64294 - DNA, 201 bp, Homo sapiens
gcccaggatgtggcgacatcaccctgcatatgtgcagggaccaccctgggaggtcacaggcaaaggagggctaccagtgagtgcccccagcaggggtctcygcctctccttggagggccccggtgtctgtactccagggtttgatcccttcgtgaccactgtgtccccagtgtgtttagtcattgaagtatgcttccattc

SEQ ID NO: 64295 - DNA, 201 bp, Homo sapiens
gaaaggaaaaagcaaagttggggacatgttggaaaaagcagcagagttactgatgagctgtttccgggtctgtgccagcgacacgtgagtaaggacttgargaccgaccaccagacgctgttggtggtgttttcattgcagcgttcaccctttctggcctgtgtttattgttgacacatatttcatttctacacatgctat

SEQ ID NO: 64296 - DNA, 201 bp, Homo sapiens
gcctttgagcattgtcaccgttctagtcagaagaacaaaaggatgattctgatctatttgcttccagtaaaaatgctattggtgagtgattattactccaygtttatagatcctggtgctttcacaaagttgacagctgataggtttttttaaaacctagcagacagtctgtagttgatcacagcctgagctgtgtatgag

SEQ ID NO: 64297 - DNA, 201 bp, Homo sapiens
gtccgacctgggcgacagagcgagactccgtctcaaaaaaaaaaaaaaaaaaaaagaaattattgtttacccactgcagagagtagtgaccatctgttacwttttgattgttctgtcttctttcaaagtaggggaaaatgaattttcccctgtgtggcattcagtgtattgttgtaggttctattcgaacagaatatttta

SEQ ID NO: 64298 - DNA, 201 bp, Homo sapiens
gacagcagagatggagcatcttgtgcagagttggtgtcttttaaacatcctcatgttgcaaacccacgacttcaagtaggtgaaagagctgtgcacacagrtgtctgcagacaattacagggtaaccactttcctaagagaagcgtagagtttgagtaagaagaaaactaatattgtcactcttatttgaaaattttaaag

SEQ ID NO: 64299 - DNA, 201 bp, Homo sapiens
gtaagaagaaaactaatattgtcactcttatttgaaaattttaaagtttctttatgatttgtgtaatttcaatccatttgtggagcactgactatgtacgyacactgtggtgatgtggacctcctgcccttgtgtttgattcctagacagctctctgaggtttagagaagttagatggtggagaggcggtggagcttagat

SEQ ID NO: 64300 - DNA, 201 bp, Homo sapiens
catctgtaactcattagacctcacttactaaacctatgacagttacttaacaagtatttcttgactgactggtcaagaatactaatatactgaaatgtatrtgaaagtgcctagaatattttctgacttgcagaaggcgagaccaaattatattcatgggcttctttttcccctgaaatattgataaatatttgttgaagt

SEQ ID NO: 64301 - DNA, 201 bp, Homo sapiens
acataactaccataacaggttcgggtagcaaaaatagatttgagaacaaacacatctggatatgagaacacatacaacttagctggcaaaagcttgcgatrtattagagtgaagcctacttgctgaaagtcgtcatcataccttgggcatcagctcatgtatttcagggagggattggagagagtcatttttccaattcaa

SEQ ID NO: 64302 - DNA, 201 bp, Homo sapiens
tgacttgatatgaataagttgatatgaatatgacttgagctttgggacttacctcaagatattaatttgtttaggcagtttattttgtgatttataaatamaatttttatttcctatgtaacttaaaaaaaattatttccccatagccgtgctggtatagaggactctaagaagtggggcatgctgtttctggtgaaccag

SEQ ID NO: 64303 - DNA, 201 bp, Homo sapiens
gtaaacagccatgagacacccgtgtgcaacagaagtgctgtatgcttctcatttcatcacaaagaatataaaaaacgtgtgctcaaggaccaagatttaaraaaattcatatttactgcattatcaaggacattttatttatttatttagagatggtcttgctctgtcacccaagctgaagtgcaatggtgcagtcatagc

SEQ ID NO: 64304 - DNA, 201 bp, Homo sapiens
tgcatttgtaacttcagtttggtaaagcctgtggaaattgtaaacatcagttatataatactatttttaacatcacacagtatttagcagagtgcctgctyagtggtctttttagtagagtttggagccgaactgttcacttacccttttcgtggaaatatgtctgtttttgaagctctttacgttactgggaaagaaatt

SEQ ID NO: 64305 - DNA, 201 bp, Homo sapiens
aatgtttgcagctcatttaaggtaatctgttggggaggaagaaaaacacacacatctggaaattgctgaattaactggggattttatcttgcattatcttrtgcttgaagcagtgaataactgactttgaaaaagtgggaaaatgcatttgtaacttcagtttggtaaagcctgtggaaattgtaaacatcagttatataa

SEQ ID NO: 64306 - DNA, 201 bp, Homo sapiens
tagagggttgattgtatttatttttactcattgtcttcccgctgaactgaactgtgccgctcttggggaagaatgctaatgccaaattaattagatcaccyagcatctttgacatgactcagatccaaaaatgtaaacgcattcctccctttctgccccgcagggacacgtcaaaggctacatatcgcatcagcatcagaa

SEQ ID NO: 64307 - DNA, 201 bp, Homo sapiens
gtatagaatgggtctttttcctctggctatgattttctctttatcattggcattcagtaatttggctctgatgtgcatagttggttttttttttttttttwaatttcttctgtttagggttcattgggcttcctgtatttgtaagttgatgtttttaaaaatttaatgttttacattctttaactacttttggccccattt

SEQ ID NO: 64308 - DNA, 201 bp, Homo sapiens
tacagggtaaccactttcctaagagaagcgtagagtttgagtaagaagaaaactaatattgtcactcttatttgaaaattttaaagtttctttatgatttrtgtaatttcaatccatttgtggagcactgactatgtacgcacactgtggtgatgtggacctcctgcccttgtgtttgattcctagacagctctctgaggt

SEQ ID NO: 64309 - DNA, 201 bp, Homo sapiens
gcctgtcgtgcagtttgtgggattaatcttgacaaatagaattacttttgtattttgaaatctattaaattcaaatctgttttttaatattgctctcaggmcagaattaatatgttgtgtgttagtaataataagttaattttttaaagcatgtggtcatttaaaatggaagatatatgatcactaattatatgttaagct

SEQ ID NO: 64310 - DNA, 201 bp, Homo sapiens
ggccccacagcattcacgctcactgtgcaagactggatgttttttgtgccaatgtggccacatagtttaggagcagaggcagtgtgtggtctcagtgtggrttccctaggcctcgacccagaccccagggcctgctgcttctggtgacccattctgcataagggagggcctctgcagctctgagcatctctgttctcttat

SEQ ID NO: 64311 - DNA, 201 bp, Homo sapiens
gacgacacagcaagatcttgcttcggaaaaatgaaataaaagttcttatattttattaggcagatcaacagttggtaaagaaaggaaaaagcaaagttggkgacatgttggaaaaagcagcagagttactgatgagctgtttccgggtctgtgccagcgacacgtgagtaaggacttgaggaccgaccaccagacgctgtt

SEQ ID NO: 64312 - DNA, 201 bp, Homo sapiens
gctactcgggaggctgaggcaggagaatgacgtgaacccgggaggcggagcttgcagtgagctgagatcgcgccactgcactccagcttggcgacagagcragactccatctcaaaaaagaaaaagaaaaaatgcattttttgtacatccaggagaatttgagattaccttgggcagtagcaaaggtacactttttagagg

SEQ ID NO: 64313 - DNA, 201 bp, Homo sapiens
acttttacgcattgttgctgcaaatgaggcagtttttagctggtgccgcggaggaaggatgttactcaagtagttaattgggattttcctggtttgttttytcttttatttttacccatcaggtaagacatcttttttcataatgttattttgtttgatgaatatgacttgatatgaataagttgatatgaatatgacttg

SEQ ID NO: 64314 - DNA, 201 bp, Homo sapiens
actttttaaagattgaaaagtcaaattagatttaatagctctgagagtgtagtttagagtttatctaataggtgggaatttttttactcttttagaacacyggcttattaagaggtgccttttcttggctgtggagtattgcatcctgtcggtaaccacagtgcccttctcctcccctcttccaggtatttgttactgaaa

SEQ ID NO: 64315 - DNA, 201 bp, Homo sapiens
gtccatttccctagatatttattaaatactgttttttccttcagttgtcaattttgaacttttggttttaaaccttagataaaagaggtagaccaactacrgttcatttggggtgttctaatacataataatggtggtatttttaaatgccttgccaaactaaattttatgatttattaacaaactataggttaatactga

SEQ ID NO: 64316 - DNA, 201 bp, Homo sapiens
tagctgcatcattttacattttcaccagcaatgtatgagggttgcaatttcttcactttcttgtcaatgcttgtttttttccattctttttattatggccrtcctgctgggtgcggagtggtatcttcttgtggcaccccatgatctttcttgtcccaaagattttcttcattatgttccttttgccaagaacacctctct

SEQ ID NO: 64317 - DNA, 201 bp, Homo sapiens
caatattgcacaaccatcaccattatccagaattttttgtcaccccaaatggaaatgtcataagcattaagcagtcactccctggtcctccctcccgagcrcttgtcaaccgctaatgtgctctctgtctgtatggatttgctgactctggtgatttcagtatgtggcttttgtgtgtctttcccttgcatcatgttttca

SEQ ID NO: 64318 - DNA, 201 bp, Homo sapiens
acaattactgtattttatttttaaatgtggaccaagttatatatacatatttgacactaaagctgattaaagggaaattatattgaagattcttaatccayactgggtctctgaagtgcatgctggagtctcacaggcattacagacatcgtttctgagttcactgagcatgactgttctcagaatagaatgtaaatcatt

SEQ ID NO: 64319 - DNA, 201 bp, Homo sapiens
caatccagcaagacagaactctgaccgtcactgcctcactccagtgccaggcgcaaagaagtcagcaggtccgtcccaccccatctgcaaagtggtgcggrctgggggtggcccaggacctccaccctgggctagcagtaatgaggagctagtccccctccccaccaggtggatgtcagaggctaagcaggggacctagac

SEQ ID NO: 64320 - DNA, 201 bp, Homo sapiens
tacttgagcctaatgagatacagatatttgtaatgtgagcttataccttttttccttcaagaacttactattgttgcaacataaatctgctcaagggtgakctacattccttaaaatttagattcttattctttacttttatcgtacgtagcattatttgaactttgtatgccatatcttccttaatacagtacatcattc

SEQ ID NO: 64321 - DNA, 201 bp, Homo sapiens
tggatatgagaacacatacaacttagctggcaaaagcttgcgatatattagagtgaagcctacttgctgaaagtcgtcatcataccttgggcatcagctcrtgtatttcagggagggattggagagagtcatttttccaattcaagtcagttaaagtgagactgataagcgagcttctactctatgtgtgtaaactgaagt

SEQ ID NO: 64322 - DNA, 201 bp, Homo sapiens
ctgggacctgtgcaatgaagtgagctgtgtgggctgcataactagtgctaggtttttattgtgtgacagcatgtttctgtttctcctccaggtgcacttaygcagtggggaatcatgacttcatagaggcatacaagtgccagaccgtgatagtccaatatcctttgtcgttcatggcagctgtcccgcatagaacacatg

SEQ ID NO: 64323 - DNA, 201 bp, Homo sapiens
gcctcaactctggaggatgaatagatcagtccttgccatgtgcagttattttcttaaattcacccactgcttatttttttaacataaaacatttaaagaawtgcttcctggctctaaagcaaatgtataaaaaaaaaaaacagaaaatatatttttttcagacaaagttcccagtttactgctctactatttatctgaaga

SEQ ID NO: 64324 - DNA, 201 bp, Homo sapiens
gttgtatatttcctcaataagttagttccttgatagttctatgtcattctttgatttaaataatgttcctagaacactgcagtagatatttgagtactatygattaggttgtttagaaatgcagtgtgttctgtccatttgctccaaattaacaattttttgaaaagcatcaggtttagtatcttactattatgctaaccc

SEQ ID NO: 64325 - DNA, 201 bp, Homo sapiens
aatcatctttgtaattggtacacacacacctatatatatatatagatagatatacacacacacacatataaacacaccaattggcatatatatatatatayacacacacacacatacaatatatacatatacatatatatatataccaattggtatatacacacacactgcaattggtgtatgtgtgtgtgtgtgtgggta

SEQ ID NO: 64326 - DNA, 201 bp, Homo sapiens
ttatccaaatgtttgttttaatgaatcccacttataaaacagtatttaatatttcagttaaaatgtttgtgttttgtagtctcactaatatatacaataaygaggtaaagataaaaatatatagcaaacatgagggaattactaacagcattaatgtaacagcacacattagcccacaatgaatggtttgtacaaaaatta

SEQ ID NO: 64327 - DNA, 201 bp, Homo sapiens
aggcttttaagattggctcctttcacttagtaatacacacgtaagtttattccatgtctgttcatggattgatagctcatttccttttagagatgaataayacttcattgcctggatgttccacagtttacctatccatttgcctactgaaggccatcttggttgctttcaagttttggcaaattatgaatgcagctgcca

SEQ ID NO: 64328 - DNA, 201 bp, Homo sapiens
aaactcagaagggaacagagctcagatgtttgtacctttctttaaatggaagtagctttaaagtgtttatcactatcatttccaactatctacccattagrtggaggtctctaaatagttctagatatgaacagacaagatgagtgatattcttgctccaaaatgttacttcttaaatatatgagcctcaactctggagga

SEQ ID NO: 64329 - DNA, 201 bp, Homo sapiens
actcatattactcaacttctccactgcttttgatgctgttcaacactcttctgagaactccttcctcccatatcttctgtgtctattttgcctgttttgcycccttctgtcataatgcccctaacaacatattgcaagagtctgctaaataaatatctgcttcctcttattgtctgtgcaatcctggagggcagggagttg

SEQ ID NO: 64330 - DNA, 201 bp, Homo sapiens
aagaattggaaaaaaggaagagaggaagaaaaagagaaggttgtgacttctgcctccatggacatcatgaggaaacacacacgtgccttgacttgatggamctatgcaattcattttttaaaatattggcatttcatactcacatcaaatatcttgcacctgaatgatatcattccagctagtacagtttctggttataaa

SEQ ID NO: 64331 - DNA, 201 bp, Homo sapiens
ttggaaaaaaggaagagaggaagaaaaagagaaggttgtgacttctgcctccatggacatcatgaggaaacacacacgtgccttgacttgatggaactatrcaattcattttttaaaatattggcatttcatactcacatcaaatatcttgcacctgaatgatatcattccagctagtacagtttctggttataaaattgt

SEQ ID NO: 64332 - DNA, 201 bp, Homo sapiens
catcatgaggaaacacacacgtgccttgacttgatggaactatgcaattcattttttaaaatattggcatttcatactcacatcaaatatcttgcacctgmatgatatcattccagctagtacagtttctggttataaaattgtagatgaggattaatgattattaagcccggttttccaaattattgaggctcacaattt

SEQ ID NO: 64333 - DNA, 201 bp, Homo sapiens
gtgtgtgtgtatgtatgtgtctgtgtgtgtgtttggtcaagattaggcagggagacagggatcctaaactagtgctttttaaatgataatacatttccacygtttaaataaggtatgctttttttctcaagatttttttcaaagcagcaattcccttcccagttcctgtagcaaatgaccatccaactgcttgaacacttt

SEQ ID NO: 64334 - DNA, 201 bp, Homo sapiens
gcaaccactgcccttatttatgttccatcttggtgtcactctacttatttgtcctaattctgtcttctgaggcaaaactaaatcattccattccctgtttytgtgacagccccacaaattgttgaaaatgacatgtcatcatcttcagattaaacattttcttacacggttttccccaggcccaccctgtctgtcactctc

SEQ ID NO: 64335 - DNA, 201 bp, Homo sapiens
tcatttagtggtatattaaaatgctaattctcatccaaggtcaaattcaactccatacaagctgttttaaaattcagaattggttgctttatgaaaagtamatttgagactatttggaaataaagactatttgaaaattttctggcttccttaacttcagtacctcttgccattgtgtcacagcttgggtgtggtggggga

SEQ ID NO: 64336 - DNA, 201 bp, Homo sapiens
cagccccacaaattgttgaaaatgacatgtcatcatcttcagattaaacattttcttacacggttttccccaggcccaccctgtctgtcactctcctctcrtctgtcagtgccccttcactgtgtgtttgtatcaggggtggtctgagaacactgggatgtccacctagagcacagctgagtggtacctgggcagcgtgag

SEQ ID NO: 64337 - DNA, 201 bp, Homo sapiens
gcgctggatattacctttctgtttatacagcctcattgttttaggactcacatcatgctattggtttaatgatgatgtggacaattgacagcaatctgctktggttgtaaattcctctcagctcctaacaaaacgcttggaacaaagtagattcacaataaatgcctcctaaaggagcaagttaaatatcttggcatttga

SEQ ID NO: 64338 - DNA, 201 bp, Homo sapiens
aaaaaataagttttgagcgtggaatcaaaagtattttccattttgatattatctaggtgaaagtaattacctacttgtggattattataattacagaaaawtaagagataatagcttgactcttaaagaacttgctgatattacacatctgctttcaaattgtgtaattcttcactgtatacatttgtagcattacttctt

SEQ ID NO: 64339 - DNA, 201 bp, Homo sapiens
ctattggtttaatgatgatgtggacaattgacagcaatctgctgtggttgtaaattcctctcagctcctaacaaaacgcttggaacaaagtagattcacartaaatgcctcctaaaggagcaagttaaatatcttggcatttgaaaacatgcttaaacaaaacatagaaaggatttctcctcctgttttccaatgtaaaat

SEQ ID NO: 64340 - DNA, 201 bp, Homo sapiens
caggcagcagtcactgtggtctttaaaataccccaaaatacaacatagattgtggtataactttctcatctgagttttccaactagcaagaaaatctctawctatgtgtgtcattatgtctcatttttcctcatttttaggcagtatataagttaaagaatctggtttgtgttttctcctgcatattctgtgatttatttg

SEQ ID NO: 64341 - DNA, 201 bp, Homo sapiens
cctcctgttttccaatgtaaaatgttgtatttctgtggctgtgttgcagaattctagagatagatgtgtctgtaagattgattaagggtgatgttatgaaytgcctttctaaaattttaagccttaataaataaaaatggtcaagaggcatcacttcctggtgataaaataaggagaaactttgggttttagagatgcata

SEQ ID NO: 64342 - DNA, 201 bp, Homo sapiens
gacatgttcttaacttttcgaaaccatcctccacactgacaacagatttgtatttataacatacgaatcaggccctattattattcccttgcatattcagraattcaacatgtcttcctctcacttataagacatctaatttgtttattagagttttcaagaccctttattatgtttctcaaacctatcttcccatctaca

SEQ ID NO: 64343 - DNA, 201 bp, Homo sapiens
gtattcttttctttctttctgtacataacatctggtttaaatgtttttcctgtctggttaaaagtgtagatgtctacttggattcataggtatcgtatctstgaatgccgcctcttttcttctccttcccttgctgtttgggagattctgtagagaggattattaataaaaaaaaaattttatcactcccatctcctccca

SEQ ID NO: 64344 - DNA, 201 bp, Homo sapiens
aataaaaaaaaaattttatcactcccatctcctcccagaagcagctagaagacaaatgtctggaaaagaaactcagaagggaacagagctcagatgtttgyacctttctttaaatggaagtagctttaaagtgtttatcactatcatttccaactatctacccattagatggaggtctctaaatagttctagatatgaaca

SEQ ID NO: 64345 - DNA, 201 bp, Homo sapiens
ttttcatagagctgaaattaaaggaggagtttttgtttggttttcacaaacatgtcctgaagcattaacctgaaattttaaaactggtttgaaatattagrttttctatcccctgcaaagctgtactataaaattaaaggaaaccaaaaacaggcatgggaatatgatagttaggtggtgttcctgagtgtggtattttaa

SEQ ID NO: 64346 - DNA, 201 bp, Homo sapiens
aggcagcagtcactgtggtctttaaaataccccaaaatacaacatagattgtggtataactttctcatctgagttttccaactagcaagaaaatctctatstatgtgtgtcattatgtctcatttttcctcatttttaggcagtatataagttaaagaatctggtttgtgttttctcctgcatattctgtgatttatttga

SEQ ID NO: 64347 - DNA, 201 bp, Homo sapiens
ctccgcctcctggattcaagcagttctcctgcctcagcctccccagtagctgggattacaggcatgtgccaccgcacccggctaatttttgtatttttagyagagacggggtttcaccatgttggccaggatgatctcaatctcctgacctcgtgatccgcccacctcagcctcccaaagtgctgggattacaggcgtgag

SEQ ID NO: 64348 - DNA, 201 bp, Homo sapiens
taaactttagtatcagtgtgtcaaaatccaccaactaagtcactgggattttgattgggattgaattgaatctatagatcaagttggaaataactgatatkctgacaatattgagtcttcctacccatgaagatggagtatctcttcattcatttggttcttctttgatttttccattagagccttacagttctcctcata

SEQ ID NO: 64349 - DNA, 201 bp, Homo sapiens
ttaatcagttatgcactctaactagatcttttgccctagatccagagtgggaaaatgtgatgagcttgttgttgcttttctatatgtctctttacctgttkaagtctgccagcttgtgtcctctcaattggtaatagtccactgtgcacatttgtaggataattaatacaactgtttactgaagcagcaaaatggagtccc

SEQ ID NO: 64350 - DNA, 201 bp, Homo sapiens
gcaaattaatattcaagcttctgctggaactcatctgttgttgattttgttgtggtgggggtgatggttctaaacatagtcaaggaggcaaggtgagaaamagatacatcaaactccttatcgatctcgttttggcagattcaaagagtttatatttaagcctaaatttaaataagcattttcatattatcactgccagtt

SEQ ID NO: 64351 - DNA, 201 bp, Homo sapiens
attggttaaaacaacaaaaatgatggcatgaggggcaaagaaaatacttgtgcacaagatttgttttatgatgttggatttacaactaacaacaatttatrtttttcacagccctcttgcaatggcagtctatttggggcataaatcaataacccttttctatgatttttttcctccacgaaaatggccttgattctagtt

SEQ ID NO: 64352 - DNA, 201 bp, Homo sapiens
gacagtgtgaaggcaagagaaaaataatttctaaatgattttcaagtgacacttgccttctttatcagttcttcaaagaagagggattcaccctcattcaktttttattaatattttgttacaaattagacaatcacagataacaatgttttgatgatggttccattcatagcatcttccaataaagcaaaataaataaat

SEQ ID NO: 64353 - DNA, 201 bp, Homo sapiens
ccattcatgatagacaatgtttatcttcacagcactcttcaacctcataccagtgggactacgtgttgttgccatccagggagtgaaaacagggttgtatrtagccatgaatggagaaggttacctctacccatcagtaagtaagacgccaaagatctcggccattcgttcaatgcatgtaaaataacaatggcagcaaca

SEQ ID NO: 64354 - DNA, 201 bp, Homo sapiens
attatcattgtcctgatgtagtcatgatgacctaagtcatcctttgatattgctttcatataaaggttgtagaatatatgaaccaaatcaaaatgggacarggagagctccttgctcacaaaatgcctctgatctattgtgtgcataaagcatgactttatgacaaacacatagagactctagatgggggaagttacagtc

SEQ ID NO: 64355 - DNA, 201 bp, Homo sapiens
ttaatttgtataatttaggggctactagtactgtttttctttgttgctgtttttttacatggctgtattgtatagtggtaaagtatgggcttttagtgtaygttgtacccattaaagaatttatctgtcgtccccctcctatcctcaccccctttcaagtctccagtgtctattaatccatactgtatgtccatgtgtaca

SEQ ID NO: 64356 - DNA, 201 bp, Homo sapiens
attaactgtgtgtgcccttcatgaggaaacaatgacaaagagttgatacttaatgactccccgttaatgtaaacatctccaatgaactcatctgcctttcmactatggaccttttataatactgtttctattacctataccgtagaccacgtgcaaaagagatgcctgtcacagcaaattattttctatggtgggcaatac

SEQ ID NO: 64357 - DNA, 201 bp, Homo sapiens
gcagtgatatgagtgctgcaccaaagcaaagatcaagtctaattcattcaacagtgtatgtctattgtcttaaacagttcaagacacacagcaggtgtttmataaacacatgctgaccctggaaagccatgagtaaaattgacaagtgggacaagagaaagattagataagaatgggaaaatagctgggaaatgggaagat

SEQ ID NO: 64358 - DNA, 201 bp, Homo sapiens
tgttttcccagcacactatggggagaccagcctactgtcaaatgttagattttgttcctggagattttaggatgaatatgggacaaactacctccttgttytctgcaaattcattttccctttagccatataacactgggtttggggtattttggggacgtggtagtgagtcataacaagcttaattccttttacttcaca

SEQ ID NO: 64359 - DNA, 201 bp, Homo sapiens
ttttgttttgaataatctaagaatgttgctaaattgataaaactgagatattcctatggtttcaagtaaaaataaagcaaccaatatcttagctcatcaarcttcatcattatctgcattgaacttcacaaaaactttgatgtggtgatggtatcacaagtatatgaatatgtccaaactcatcaaaatgaattgcatttt

SEQ ID NO: 64360 - DNA, 201 bp, Homo sapiens
caaatcatgggtcgttctgttgaaggaaagaagataatcttataataaatgtacagagtatagactatttatctatctctgtctctctctctctctctctstctctctctctctctctctctctctctctatatatatatatatatatatatatatatatatatatatagtcaaaaaaggcacaaataacattaaagaatt

SEQ ID NO: 64361 - DNA, 201 bp, Homo sapiens
ggggtcaggtgcgtcaatgagtgaatcagtttgggtgtaggaagtgatgggtcaggttgagggacagaagaggctgtgcactgctggtgggactgtgaatkagtgctgccattatggaaaattgtatggaggttcctcaaataactaaaaatagaattgccatatgatccagcaatcccttttctgggtatttacctaaaa

SEQ ID NO: 64362 - DNA, 201 bp, Homo sapiens
gcactttgggaggctgaggcaggtggatcacctgaggtcaggagttcgagaccaccctggccaacatggtgaaaccccatctctaccaaaaatgcaaaaaktagctgggtgtggtggcatgtgcctgtaatcccagctactcaggaggctgaggcaggagaattgcttgaaccaggctgggaggcagaggttgcagtgggc

SEQ ID NO: 64363 - DNA, 201 bp, Homo sapiens
tgcacaaaagtataggattgctaaggaaagcaattatattgaaagagagttttagctgggcatggtggctcacgcctctaatcccagcactttgggaggcygaggcaggtggatcacctgaggtcaggagttcgagaccaccctggccaacatggtgaaaccccatctctaccaaaaatgcaaaaagtagctgggtgtggt

SEQ ID NO: 64364 - DNA, 201 bp, Homo sapiens
agagaatgcatcaaataaagatgtactacctaaagtgcaaaatctactaggagcactttgacatttcagttcaagttctacagtgtttcacattttttcartctctattgtagtctcacttggaggtgattgcttgatcactagaggaatatgatattattcgtttcagaaatgaagcagctatggtgttctcttgtgaat

SEQ ID NO: 64365 - DNA, 201 bp, Homo sapiens
atttcccacacttgacagcgtaaactcctcattacaaggagacctagaggataattgccccgataatggcatctttgtaccagtttatgtagacataaaaygtttaaaactactgaactcagttagactatttattatccattgtaaaaacacatattcttgattttctctaaatataaataggtttgaatagttaagatt

SEQ ID NO: 64366 - DNA, 201 bp, Homo sapiens
tggaaaattctgtgaatgaatcaagcagcagtttttcttcagattctttaaatttagggaatcctatttctagtttccgaaaggagaagtgaatcattctkcgtagtgttttagctgaatatgttaaatctgtgtattaaatttaacataatactgtatctacagttaaaaaaagaatagtatttagataacaattaaact

SEQ ID NO: 64367 - DNA, 201 bp, Homo sapiens
tggaccctttctaaacaggtgtttgtccccagtaacaaactgttcttgtcacggtcacccatgacctgcaagtgatcaaactcaagattctgttttcagtycttatcctacccgtatagtatttggcattcaaattttcataataaatttgtattttttactacaaagtggtaaagttagcatcgaaatactttaaaccta

SEQ ID NO: 64368 - DNA, 201 bp, Homo sapiens
ccagttgggtgatttcctggtaaaccactatccccttatgccatgtttacagtgtattcggggtggataacataatgcaatgagaaaaaaataataaagtraggaatttaaatagctttttaatttttatctccttattgtatatgccacttaagttttttttaaatcaaaggagaactactaccattgaaagaagtatta

SEQ ID NO: 64369 - DNA, 201 bp, Homo sapiens
ggcgcatctgcgcgcctggccccgcgccccgcggagagggcgatgggtcccggtcaggactgagccccccttcccctctccccagtcccgcctggcacccyctcctctgccccgagggcgagccacggtctgcgccgccgccttcccctccggtgcccccggctcgccgtcctcccgcgccctccctccccggacccgttc

SEQ ID NO: 64370 - DNA, 201 bp, Homo sapiens
ttcaaggccacccagctgtaaaggggaagagacagagcacaggacttccttgcccaccaagtgttcctttacagccacttacaaaaagagctaatgcttgygtgttagcaaatatgtttcatcaacattttgcaaattctttacttcatctgacttattgatagaacaaaagaaaacacagcatgcactttcaaatgcaag

SEQ ID NO: 64371 - DNA, 201 bp, Homo sapiens
gtcctgatgtagtcatgatgacctaagtcatcctttgatattgctttcatataaaggttgtagaatatatgaaccaaatcaaaatgggacaaggagagctscttgctcacaaaatgcctctgatctattgtgtgcataaagcatgactttatgacaaacacatagagactctagatgggggaagttacagtccttgagtga

SEQ ID NO: 64372 - DNA, 201 bp, Homo sapiens
aaattcaactccatacaagctgttttaaaattcagaattggttgctttatgaaaagtaaatttgagactatttggaaataaagactatttgaaaattttcyggcttccttaacttcagtacctcttgccattgtgtcacagcttgggtgtggtgggggaggtgcaatcttctgggtagagaccaggaatcccactaagcct

SEQ ID NO: 64373 - DNA, 201 bp, Homo sapiens
atcaacttgcattgttttttattactgggctttaagagatatttgtatatttaaaatcagatatttctattgcaaaaaaaaccttcctcccagtctgtggyttctcttcacataatgttgacagtcatttgcaaagcagaaatttttaattttagtgaagtccagtttattaattatttcttccctgaatcatgcctttgg

SEQ ID NO: 64374 - DNA, 201 bp, Homo sapiens
gaaacattgagagaatggtagaaaaaagactaaaagatgaatatatttatggctgcatgttttaacggtgagaaagaaaattctcgtttttgaaatgcatmatttctattctacttcccttccaaaggcaatagaggcttaaaatgatagataaaagttacacagatatgcatttgtatataaactgaattataatttggt

SEQ ID NO: 64375 - DNA, 201 bp, Homo sapiens
atatttatttaccttagatgaaaatggcatagtaatttaaaaaatcaaacaaaaatagagacatcatctcaagaaaggagagaaaacgaagaagtaatcartgcagagtctatggctgagcaagctggtgaaaaaacttacagaagaagtgtgattaacaagctcagagaaccccaagaatggtaagcgtgcacgcgcgca

SEQ ID NO: 64376 - DNA, 201 bp, Homo sapiens
cgtccggcttcccgggatcgtccggctgcgccctgggcgcatctgcgcgcctggccccgcgccccgcggagagggcgatgggtcccggtcaggactgagcsccccttcccctctccccagtcccgcctggcaccccctcctctgccccgagggcgagccacggtctgcgccgccgccttcccctccggtgcccccggctcg

SEQ ID NO: 64377 - DNA, 201 bp, Homo sapiens
acccactaagtcagctctcagcatgtcactcatagctgattttgagataggtttttaactggtaagcaatatgcttaggtgccctgccctgtctcagtgawaaagacaagtgaaatgccaaagtctaatccttttgtttgagaaagtatagtttcaaccaatatatttattagtctcttggggagaagccagatttatagc

SEQ ID NO: 64378 - DNA, 201 bp, Homo sapiens
cttcatggtgtggtcggtgctggtaaagccctggaggtagacacactgggccttgtgctcccacaaactggctggaaaacttgggcaggtctgttaacacrcagagacctctatgcaatgaacccattgaacaagacaatttgatagatgcctctcagctttcagttcttcttttgcacgctgtgtagagtccctcatgaa

SEQ ID NO: 64379 - DNA, 201 bp, Homo sapiens
cctctattaaaatcctaccatcctgcctcccacattactctcacaattaagtccttgtcactgtccagcctctgagaaaggatctggcatctactgcaggrtcatgggtatggcatcttaactgcatgcatcatacccaacatccagtgaccagagtgatagttcacctgtctacgtatgatcttgccactgcctgcttta

SEQ ID NO: 64380 - DNA, 201 bp, Homo sapiens
ccttctgctgcccaagggtctttttccatgattgtaggaaatgaacattgaaatgataatctcctgaaggctctggcttatgggaagagagttatttgttrttattttgtgtagctttgaagttgacactagtatgactatgttgcttttgaaccacatgaaagaaagtaatttaatgttctaggatgtaaataccgcagc

SEQ ID NO: 64381 - DNA, 201 bp, Homo sapiens
tcatcatctgtgagtgtataattttcaatttgcctaaattcagaaaatcgctcttgttggctaatactacttctgtaatttcaatgatgttgacttagtgkcactcttaattatatttttctgtagaacaatttattgaaacccaaacagttagctaccagggcctatacaggaaaagacagattattccagagtctgaaa

SEQ ID NO: 64382 - DNA, 201 bp, Homo sapiens
aagacatctaatttgtttattagagttttcaagaccctttattatgtttctcaaacctatcttcccatctacaacattctccacttctgtcccacaaagcktgtatctcagtgatgaactatttacagttctccaaatgtaccaggccatttcccacctcttgcctttcacaataccatttattctccctataatcactct

SEQ ID NO: 64383 - DNA, 201 bp, Homo sapiens
tcatctcaagaaaggagagaaaacgaagaagtaatcagtgcagagtctatggctgagcaagctggtgaaaaaacttacagaagaagtgtgattaacaagcwcagagaaccccaagaatggtaagcgtgcacgcgcgcacacacacaaagtaaatataagcccatcatattcaaacggttgaaaaccaagcaaataacaatg

SEQ ID NO: 64384 - DNA, 201 bp, Homo sapiens
gatagtgccaattgtatgaaaatatgtagattcaactgttatttgcttcttttctaggacagttttttgtttgtttgtttgtttgttttttgtttttttgktggtggaggaaggagtcttgctctgtcacccaggctggagtgcagtggcacgatctcagctcatggcaacctccgcctcctggattcaagcagttctcct

SEQ ID NO: 64385 - DNA, 201 bp, Homo sapiens
tttgacctcatgatcgcctgccttggcctcccaaagtgctgggattacaggagtgaccaccgtgcactgccaaaagttgtctcttaaactcgtacataatyatgcttttatttgaggtacacacacaaccaattaactaattttttttctcctgtgggcattagtcacagcccaatattaaaaatttttgactacatacaa

SEQ ID NO: 64386 - DNA, 201 bp, Homo sapiens
tgatgtgttaatctctaaatgttgagaaatatttttactgccaaaaaatgctttaattttccattttgtttcccgggaaactacttaagtaacagaatttkgccctataaatataagttgctgtcgagactcctttgttggtagaaatatacttaaatttcctgggtcctgtaatcaggataaaagttgtctctctctctc

SEQ ID NO: 64387 - DNA, 201 bp, Homo sapiens
ttgctcaagaaataagttaaagtactgatgcaactctaattcttttcagtgatcaaaatgggaatgagtagtgattatgtccagaaactgatagataaaaraatataatttatgctcagcattggtggctagtccactaagagtgatgtgctgtctggagtgaactaaaagaataaggttatagtcaatacttttcttcat

SEQ ID NO: 64388 - DNA, 201 bp, Homo sapiens
tttctatggctgctttcacattacaacagcagagtgaggagttgcaagagacttgatactccaaagcccaaaatctatactgtctctttagaaaaaaaaawaaaattgtcaacatctgcattgagcatatactgaatatgcagtaaatatataattaattgttttagatcatattttccaaacgcagcatagctctcctta

SEQ ID NO: 64389 - DNA, 201 bp, Homo sapiens
caccatgaaacccacctacactccactcttctctccatataagctttattcttcaagacgtggtcaaacctaccttctttgaaaagttcttccaaaccatytacatttaaaacagtatctactaatgagctatcaagccatgaaaagagatgaagggagcttaaatgcatattgctaagttaaatagacctacttgtaaag

SEQ ID NO: 64390 - DNA, 201 bp, Homo sapiens
gagttttgaaatcttaacccctagtgaatcaagagtctactgtgagtccctgatggggtcattcaaccaaggcagttatttctgaaattcttccaactctrgcagatcctggtatttactttagccctgggtcatcagttttcctaatgaaccacattttttttttatgatgacgatgctggaaatgggttttaaataggg

SEQ ID NO: 64391 - DNA, 201 bp, Homo sapiens
cattttgtaacttttctttctgtctaaatttcccagtaaacttccttgagggcaggaaattatatctttttcactgctgaatctctgacacttattatagmgcttgctagttaatgggtacctaatacttgtttgctggatgaatcacacagtcttgatgaaagacattttttccccagcatctatcatgtactcattagc

SEQ ID NO: 64392 - DNA, 201 bp, Homo sapiens
ctcgaagttaaaggagaaaaacataattttacattttatttgtgctccctcacccaaaatgaggcataatcccaaatctctctgtataagcatgagggcgygtgtgagtgggtgggtaggtggcttctcactgcctcgcctgatctagttaattcaactccagaagacagagtagctcaaataggagactgcttaggaata

SEQ ID NO: 64393 - DNA, 201 bp, Homo sapiens
taaatggaattggagaagaagtgtgcctaattaatattttggtttgaaaagtaagattactgtattagaattttatccaaggattaaatttttaatagggkatttaggtgaagtaatactttttttttcatccttcaagagagtaattaattctacaaaatattaagcctgctgactttgaatatttttaaatgctttaga

SEQ ID NO: 64394 - DNA, 201 bp, Homo sapiens
caaataggagactgcttaggaataagtgatgtcagaacataaaagttttacagaaaaattgtaaatcactaatattctcattttttttcttgacaagagartaataaaaaattctctttttcatgtttttaactctttttgcttttattcgcttcttttccatgctacatattttcagtgaagagcataaataaaatacag

SEQ ID NO: 64395 - DNA, 201 bp, Homo sapiens
tatttgaaaattttctggcttccttaacttcagtacctcttgccattgtgtcacagcttgggtgtggtgggggaggtgcaatcttctgggtagagaccagraatcccactaagcctatatcgtatgggatagccctatgacaaagaatgacatggcccaaaaggccaatcatgccaagcttgagaaactgctcagaataag

SEQ ID NO: 64396 - DNA, 201 bp, Homo sapiens
tttacagttgcagccaagcaagggtctgcattgaattgacccaaacagggaattttcaagtaatttctctatctttgtatgtgtgagttttttagtagtcmattcaattttcattagcttgtcaactctaatatctgacaactgaaatataaagtagggaggagaaagagcagaattaagagaaggaatatatgtgccaga

SEQ ID NO: 64397 - DNA, 201 bp, Homo sapiens
ctctttttatatggatgccagtcatgagatttaggcccaccctaaactactatgaccttatttaaagtaaacttaactaattacatctgcaaagaccacayttccacataaagtcatattcagagttccaggtagacatggatttttggaggacactcttcagcccagtactgcactcatattactcaacttctccactgc

SEQ ID NO: 64398 - DNA, 201 bp, Homo sapiens
actctgggcaacaggtgtattcttactcataagcaccctgcaaagactggagtagccctgacaagaaatctgagtattcttctctgaagcctgtggttcaytgtgatgctgctgccagctttggccacaccccaaatagacctctatttgcagagctcttccacattagacctgtgtgcttttgaataagtgactcggctg

SEQ ID NO: 64399 - DNA, 201 bp, Homo sapiens
agagaataaacagacaaacattacaaattagtgattaattgcatttaaagcctagttaagactatttaagactattatgcataatacaggaaaactacctktattatttatagtgggtgccttctgaaggatctgaaggagaatcagttctatgcctctctcctcattcccaggaggtgcctggcattccttggcttgtag

SEQ ID NO: 64400 - DNA, 201 bp, Homo sapiens
tccatttttaaatcaacttgcattgttttttattactgggctttaagagatatttgtatatttaaaatcagatatttctattgcaaaaaaaaccttcctcycagtctgtggtttctcttcacataatgttgacagtcatttgcaaagcagaaatttttaattttagtgaagtccagtttattaattatttcttccctgaat

SEQ ID NO: 64401 - DNA, 201 bp, Homo sapiens
aacaggctgctcctttataattattaatcatagtgtatattaattcatcatcacatacgtggctagaaaaaaatttagaacaaaaagatatgtgatatgtraaggcctacgataattcagacttctttgaggagagcttttattttattgttattcttattttatctcttgtcaatataaattgagagaataaacagacaa

SEQ ID NO: 64402 - DNA, 201 bp, Homo sapiens
caagaatggtaagcgtgcacgcgcgcacacacacaaagtaaatataagcccatcatattcaaacggttgaaaaccaagcaaataacaatgtctaaaggcarccaaaaaattgcaaggaatgaacaataaaatttaagctgaccttctagtagaaagtatgaatcctgaagaaaaaaagaaagtaatcattaaagtgttaaa

SEQ ID NO: 64403 - DNA, 201 bp, Homo sapiens
cttctcaacaaggcaaccactaagagagctgtttttacttactgtagctgagtgtttctcaaccctatcaggcttcaaatacactttatacagcaaacatytgagactgtccctttgctaatttcacatgaaattcatagataatatcacctgcttatagtcataagttttaaactgtaatgtaataccttactataatat

SEQ ID NO: 64404 - DNA, 201 bp, Homo sapiens
aggtagaatcattatgaatccaacagttacaaatgcagtttgatgtaggtgtgttgcattgggtatccaggcaccattaatgagggaaccatcaaagatawaattttcttaaatgcgaaacaattcttggtaactgtcaagtaaaacaaaagataatctttctttggtttacatggtagttgcatttttgtaagagctagt

SEQ ID NO: 64405 - DNA, 201 bp, Homo sapiens
agcatttggcaaactgtaactgctggttaaatctggcctgtcccctatttctataaataaagctttattggaatgcagccacactcattcatgtgaatgcrtattgtctgtgactgctttggcaaaatagtggtggagttgagtaattaatacaagcgcttttcagccttagagcctaaattatttactatctggccaact

SEQ ID NO: 64406 - DNA, 201 bp, Homo sapiens
actaaaatgaagagctgtcattttgtaccagaaatgtcttagctttatttcctgttgtttcagcaatccaaagcaatggtggtgtttgggtgtggaccacrgctcttttcctcaaatctaaggatttcatctgaaaataggaaaatagctacagttcactgtagttgttaatctttataccactcttgccaattttgtttt

SEQ ID NO: 64407 - DNA, 201 bp, Homo sapiens
actgtactgttttgctaatctgggcagtgtagggcatgatgccttggcttagtgctctccagcattgagctagctgcctccctgagaggcccctctctacmaattaaatagctcttacgtccatcagatattctccatttccatttcaccatcaacactgaactctgccaaagtcatcctcagttcttgctggagcttgtg

SEQ ID NO: 64408 - DNA, 201 bp, Homo sapiens
cttgagtgatcttggtttttagaaatctgccagtctgctgtgccttagcagttgcagaaggccatgattgactctctccctaataataatctccttgcttrtaaggaagtattggagaaaggagttgaaagtaatattagcaagaagcctttactaatgagtaggtatgcttgtaaagtccttcacttgaaacatttgtca

SEQ ID NO: 64409 - DNA, 201 bp, Homo sapiens
tttcatatatttgttttaaaattcgtcttctcaccccagtttacctcgggtagtcctgagatcctttgaattttactggaaccttttaaagttggagaacmcatgaacctcaggtgcatgacagcttacgctttacattttgaagtgatccaaatgattagagaagaatttagaaacttacatgaatcaactttatgatgg

SEQ ID NO: 64410 - DNA, 201 bp, Homo sapiens
tctcaccccagtttacctcgggtagtcctgagatcctttgaattttactggaaccttttaaagttggagaacacatgaacctcaggtgcatgacagcttaygctttacattttgaagtgatccaaatgattagagaagaatttagaaacttacatgaatcaactttatgatggtcagagaatctgtgaaatatgtttcaaa

SEQ ID NO: 64411 - DNA, 201 bp, Homo sapiens
aaatctcacaggactaacctggagatcagaaactggggcatgaaggcacctatgaatctctgaaaagttgataatattaggtacttgctgacctgttgagraagaaagaacccctaatggttccagaatcacaagcctggagacacaaaagagaatataagtggtgggaagcatggaaatagggaaaatgatgtcttaaga

SEQ ID NO: 64412 - DNA, 201 bp, Homo sapiens
gctaaccgaatgaacatacacgcatgtgttaataagtaaaatgaaataaactatttaaagcatcaattcttaataaaaatgacacgtttgtttttgttttkcagctctagatcttacaagtatacaatgggaatatttacatcccctagctcttagatttaaaagctatttcttttaggctgtattcccccacatacaatc

SEQ ID NO: 64413 - DNA, 201 bp, Homo sapiens
tttgagaaatccagttaaatgcctgtctctcctcccccttgtatctagttttgaacttgatcacattcaaagtaagcaaggaaggcaagcatgtaatgtcsaagtcacattaaaggaatcgaatttgtctctcttacaacaacatgcttccggttcataataaattaatccagcattctatctcaaaactgcctcttttta

SEQ ID NO: 64414 - DNA, 201 bp, Homo sapiens
aaaagatatgacatttaacttccatttctgttaggaagtgtattctacttagcattttaaccctagtttacagttaaatgagaaccgagaactgattttttctccaagtttaataactgtcatcttcctcttcatcattattatgagtattttggattttcagattctccatttatagaatggaaatcacaggaactgttc

SEQ ID NO: 64415 - DNA, 201 bp, Homo sapiens
gacagagacagcctggacagggaaatcagaaagcagacatttcaacaatctcaaagtagctgggtggttatcccatatcactgggtcaccctgccctggastacctgcactctataccatgctagcagaactgccctatgatttcaggaaaaaaaaagtggaggagggggcagggggcaggggtggtggctcacgcctgtc

SEQ ID NO: 64416 - DNA, 201 bp, Homo sapiens
cctctgaacacatataatactatagagccagctactttgataatagaatacggttacaatatataaggtatcctactttaaagatagatattgataatagwtaatagataaatagatagataggtgatagacagataatgtagtttagtttaaacttaaagtttaacttgtagtacccagttagtaatatcaagaatggct

SEQ ID NO: 64417 - DNA, 201 bp, Homo sapiens
aggagacaggactggaattcaaactgaaggtcagtcatagaaatgcaaaattaaggttatgaagtcatcaaaaagaatgagatctccatagaccaaaaagracatgtactgaattttaagggatacctttattcaagggaagttggaaaggagagccagagaaaaatgaaagcatagtaggctttattgattcaattgctg

SEQ ID NO: 64418 - DNA, 201 bp, Homo sapiens
cctggagtgcagcggtgtgatcatacctcactgcaaactgaaactccgaggtgcaagcaatcctcctgattcagcctcccaaagtgctgggattacaggcrtgaaacaccatgcctcgcctctggttcttcatgtgtaacgtaaagtttaagaggcaattgacagacataaagaaaattgggaaagaatatacaaggatta

SEQ ID NO: 64419 - DNA, 201 bp, Homo sapiens
ggtgttgcaacattcacatggtgtgggttgtactgggaagagatggacaatagggtggcttagcgatggcaacgggcatctttagatgagaagaatgtacrtgagatttcgaaaaaaatgatcaacagaattgaactgtattgagcactaagctagtataggcagacagttccaactgggtaaaataacattataaccact

SEQ ID NO: 64420 - DNA, 201 bp, Homo sapiens
ggtgagctacttacacaaggagaaccatgatgaaccatgatggaagtggtgttgcaacattcacatggtgtgggttgtactgggaagagatggacaatagkgtggcttagcgatggcaacgggcatctttagatgagaagaatgtacgtgagatttcgaaaaaaatgatcaacagaattgaactgtattgagcactaagct

SEQ ID NO: 64421 - DNA, 201 bp, Homo sapiens
acaaatccatgtttgctgggcatatgttatgacaacagagaaattcacagactggtcttacccggcaggggagatggcatgatcatgaaaatggtttttcscagggtgagcttacccattgcattctgatgtgctgatttccgtgatttccccaaatgtgggaaactcactcggctgcataattggtggtagtgggggctg

SEQ ID NO: 64422 - DNA, 201 bp, Homo sapiens
tagtggaacaaagcctagtggaagaaacagtgaactgaaaatacatagaaattcaggcagtgataaactctttgaagtaaaatagagcagaataagagaawggcaagatcagtttgggaaggctctatttcagatgtagcactcaagggacatacaacttaactgaaatgagtgagtgagagagagagagagacaaagaca

SEQ ID NO: 64423 - DNA, 201 bp, Homo sapiens
ggtagtgggggctgtgttatgctctctccttgatgtcagttttttttttttctaaaagcaaacaaaaacaattggcttcagacattttgaacaaaacaagyagaagctgttttctttaagaaattacaagcagtgtctatctatagatacatacatagtcacacatgctcataaaaacacacaaccacagcaaaattcatg

SEQ ID NO: 64424 - DNA, 201 bp, Homo sapiens
agcagtgtctatctatagatacatacatagtcacacatgctcataaaaacacacaaccacagcaaaattcatgctgtaatctataaacactttttagaaamggggagaggttgtgtgggcctaaagagccaggtggggcagaacctaaaaggaccttgagaatgacaaacatttgaccatgggaagcaggacaggagaagg

SEQ ID NO: 64425 - DNA, 201 bp, Homo sapiens
gatgcctctcagctttcagttcttcttttgcacgctgtgtagagtccctcatgaattagatcttagaacattgagacagtagtgtattcctttgccagagsaattatatgttacattagaaggccacctacattgtggttttaatttgtaggatggatacttaaggtatccatgacttcaacactatgcaatctatgcctg

SEQ ID NO: 64426 - DNA, 201 bp, Homo sapiens
caggaagaggctgcctgcaggaatggtgtggaagaccatcagctgcagactgaggcaaggcgatggaggtttaggcttgcttcaataggtgagctacttayacaaggagaaccatgatgaaccatgatggaagtggtgttgcaacattcacatggtgtgggttgtactgggaagagatggacaatagggtggcttagcgat

SEQ ID NO: 64427 - DNA, 201 bp, Homo sapiens
agcactaagctagtataggcagacagttccaactgggtaaaataacattataaccacttcttaagtaaataatttggcagccggactttcctttgcctcaytgactgaagcaagcatcccagacatttgatttaccaggcactctcacgaagtacctcaaggatgtgcttccgagcatatgttttatcacagtttcattac

SEQ ID NO: 64428 - DNA, 201 bp, Homo sapiens
agtattgcacataaattaccaggagacacagaagagtagctatagaacatgcttcatgcgaccagatctcagcaatgagatgtgctgtggaagaaccatgsgttttgttctgcagctgggattttcttatgctcttcttgcctttcagtgactctagctggagctgtggtcttctccattttgaaggagacaccctcgaag

SEQ ID NO: 64429 - DNA, 201 bp, Homo sapiens
agagatgatgcagaaagaaagctgccctctgatatccccactgataataatgtgaagtgtggaaggcctcagatgtcttttctggatacctatgtgtaatkttcatctatattaatggaactcgtaagcgcaccacgtgaataagaaaatgaatctgtagaaggtagtccctgttgactaggctggttttgaatttcagaa

SEQ ID NO: 64430 - DNA, 201 bp, Homo sapiens
aatgtcccacatgtttttactcccttttttagattttatacattttttatgttctttgctttagggtggctattttcaattaaaacattttaaaattattyattcttctcttgctattgaactcatccattgaatttacctttccagtattatatttttttccagttttaaaacttccatttgattaattcagttctttgg

SEQ ID NO: 64431 - DNA, 201 bp, Homo sapiens
ggaaaaatgaaatgtgacaattgctaattccatacagttcaaggaaaactggcctatttcaggttcccagcaggtatttaatactgaagtgtaaagaaagrtggcaaacttacaattattttgattgaactatggttatctccattcaactaagggagcatttgcagcaatgccgatgggccagctattttggttttgcca

SEQ ID NO: 64432 - DNA, 201 bp, Homo sapiens
gagccactgacggcttttgatcaagggaacagcatgaacagttctttgagcacgtgaaacactggaaagccattttcaaagtgcactttatgcttactttwcatcgattttgttgccactttaactctccctgcgacagtctttgtgactctgaaaattatcatgtgaataggcatcatttaacaataggtattgataggg

SEQ ID NO: 64433 - DNA, 201 bp, Homo sapiens
tacatatgttcctgtaggatgttacatcctttcatggactttttcgatttgttgccaaccacatagagaactagaaagttaggtcaagaaataagagaaartattaggtttagatttctgggtgccaagcaagccctgcaattatttagttattgtgtctttatggttactgtatctttattgttactaggtccacatagt

SEQ ID NO: 64434 - DNA, 201 bp, Homo sapiens
agattttacattgtagaacaagttgggacacatttttatttataatcttaaaatatcttacttatagacgtattgtaaataccacagatttttgtttctawtttcttgcttttataaattttgtactaatgttaagaaatggtagcaagcttatgactaatgtcaatttaattgacagctcttaaaatgtgatcattaatt

SEQ ID NO: 64435 - DNA, 201 bp, Homo sapiens
tcattcaatatatgcttaaagtctttacctgaaaaaaatgtctgaagtaataggttagctcaatctcttatcttctgggactcctatctctcagtattcayttccaataaatagcaggtgtgttgtagaatcatggctatccaacaagagaggccaagttatagctaccacgtcatattttcattactaatagctcatttt

SEQ ID NO: 64436 - DNA, 201 bp, Homo sapiens
tgccagaatgaccatcaggggtactaataagtctctttgagtcttttattgttattgtttggttttattttatttacaggttacttgtaaatctgactgcyaattaatacttttcaaaactatcgtggaaatagaaagacttatatgaaaatgtttatggctctattattcatagtaagcccaacactggaaacaacccaa

SEQ ID NO: 64437 - DNA, 201 bp, Homo sapiens
gtttcccaggcttaatcactcactccaccctccacttcactcctcccacaccagtccagttatggtaatttaccaaaaacatggatgcttactgtagactsccatcttttctttctttccaccagctcagatatcagtatccagttctagtaggaacgtcattcttcctctaaccctcttgtggaattgcagaacaacatt

SEQ ID NO: 64438 - DNA, 201 bp, Homo sapiens
ctgtcagcactacactcctcagtttcttcctcatatcattcttgacttttgcctaatcaggcactcagaaccaccgagtttcttcttgataaagtgcttargagaaatctacatggggtgggggggtattatctcaatgggctacaccatcctcttccagctgcaactagttagcaccttgggtgagctaaggaggagatc

SEQ ID NO: 64439 - DNA, 201 bp, Homo sapiens
tattaattgaccaatacaatttgagatttaactgggatagctatttcattggttatttgtgtctgatcggtctactcaaaatttgattaatgtcaatgtgrgtatttagtgataggttgagacaagtgaatcaaattatcctcagactcataaatttctgtagaatgtgcctcaggataaagctttattgctaggtgtttc

SEQ ID NO: 64440 - DNA, 201 bp, Homo sapiens
gcttccttaacttcagtacctcttgccattgtgtcacagcttgggtgtggtgggggaggtgcaatcttctgggtagagaccaggaatcccactaagcctayatcgtatgggatagccctatgacaaagaatgacatggcccaaaaggccaatcatgccaagcttgagaaactgctcagaataagcagggagagtgaagaaa

SEQ ID NO: 64441 - DNA, 201 bp, Homo sapiens
attattctcatgacttctagcatttcagattgagcaaaaatctattgggcaatagttctggatatagaatatatatacacactctatatatcttctctctmtatatatgtattatatgtatattctatatatattctatatatattctattctctatatagaatatatagagaatgtatatatccatttctatatatatag

SEQ ID NO: 64442 - DNA, 201 bp, Homo sapiens
caatcagaggcagtgatcactgacagtgaccccaggcatataaaactacagtttctttgtaaagatctccagagacagggatagttttactaactttctcmacccagatgagtgtttcttctttatttctaacctaaattctagtactgttttctagggaggtcattttcttttgttctgtctcaaagttggctaggtaga

SEQ ID NO: 64443 - DNA, 201 bp, Homo sapiens
actttgtgtatattttttagtccagtggtattttcaaaaagatcaaggacagtaaggatctattttccatctatattttatatacatatagaatagcacastgttggacctatttaaaactagctaggtgtctttcatggtctataaccagacaggttgaacttcaaatttatttttaatagagggctatcaaaaatgcat

SEQ ID NO: 64444 - DNA, 201 bp, Homo sapiens
aatgttttagtttttagcccctaaggaatatttttcagaacaggtatacaacatttttagaagaaaaccaaaaattattattttctgcaataataaaatcwattaaagaaaaatgaaaactttgtgtatattttttagtccagtggtattttcaaaaagatcaaggacagtaaggatctattttccatctatattttatat

SEQ ID NO: 64445 - DNA, 201 bp, Homo sapiens
gaatccttaaggtatccaccgagaataaattacttcctctacatcaagcatcttcttctcttccatattcaacacagtgaattcataatggagacaatacmtccctaagttgctgatggtgttgcaagcaccattcatgttttggacattatggcagtgacgatcagaagagaatcctgtggacctacgtttctggtgttt

SEQ ID NO: 64446 - DNA, 201 bp, Homo sapiens
tataggaaatagcataaacatctgtttcgataaacttcccctaataaagacataccttgaacacgagctattgttttgcatttgccaacttttccatttcrtaattgtattaaattgctagagatggctttgtaatcaaagacattagaatattcagttgaatatagcatgggtttcagggacacatttttgttgttgtag

SEQ ID NO: 64447 - DNA, 201 bp, Homo sapiens
tcttcccatcactagttgccatgtaccgagaaccatctttgcatgatgttggggaaacggtcccgaagcctggggtgacgccaagtaaaagcacaagtgcrtctgcaataatgaatggaggcaaaccagtcaacaagagtaagacaacatagccagatcctcacaggtgttgtgacttattcgtcctgagcacagttgagt

SEQ ID NO: 64448 - DNA, 201 bp, Homo sapiens
cagttagacccaaacaattcataagtgattcttccgttatgaatgcaggaaaatccacaggaataaaatcttgatataaatgtacttaaaaaaagacttttatgtttttacagcactcttagatgctcagaaaaagtgagatgaaggcacagagattccccttatgccccttgcccccacatgcagagtctctcctgttac

SEQ ID NO: 64449 - DNA, 201 bp, Homo sapiens
tcatcctatgtgcccactcttttcattctccatcttagccacagcatcactgaagaaatcaaggagattaaatttcaacagagaagaggggaacatttaaragtcggcaaaaatgcagtgaaatgagggtgtagtcaatatagactgcacacattccattccagagagtcagtttatgtaactggaaaatgtctgcatttt

SEQ ID NO: 64450 - DNA, 201 bp, Homo sapiens
gaaaaaataaaaccctaatttttagtaaatgttgccaccacttaaacttgaacgttttaaagcaagagcattaataattataattagaaaaagagctttgytatttctacatgttcataaaatgacacaaaatactttggttttatattttctttcagcgtcaaagaagaaagtcataaacatcactgcagtttgcatttt

SEQ ID NO: 64451 - DNA, 201 bp, Homo sapiens
gatagcaacctctgacgcctgttttctgagggcagagaagaatactggaaaaaggacaaaagaaatttggcaccatatggagcttaattgctttttttctrttacctgtatctaaaatacttcagcaaagattagctataagcctaaaaccacaccaaatgagcaataaattctatagctcagtgaccatgaatagatcat

SEQ ID NO: 64452 - DNA, 201 bp, Homo sapiens
ggaatgaatgagtgttgtttctattctcttatatactttgggatcactcttagaaatcttaggaagactaaaattatgataacagcaataagcatttatawttatgcataaatgcatatacatacttgttataatctcaaataaagaaaagattccatcaaaacacatgattcttctaaattgtacgcacacagtttgagt

SEQ ID NO: 64453 - DNA, 201 bp, Homo sapiens
ttcctagtgactgttaccattccgatgttcaatcaatgctggcaactgctttctacctctgaacacttttcttgctagtcttaggttttatgacttctgaratatgagactgaatttgtttgagtttactataatgggattttgcattatgtatgctcagtagtaaataatatgtatgcttaatagtaaattattttggga

SEQ ID NO: 64454 - DNA, 201 bp, Homo sapiens
ataataaattctgaaacagccactctggctatcttagtatgtagacgtaagttatcatgtagtcatcccatcagggagaaatctgaattttaagatcaacrttggctgtgctgaggtcatcctatgtgcccactcttttcattctccatcttagccacagcatcactgaagaaatcaaggagattaaatttcaacagagaa

SEQ ID NO: 64455 - DNA, 201 bp, Homo sapiens
aatattgataaaggaagataaagtaaccagactagattttggtaggatatagcaagacacaaaattgatatctcctaactacataaactaaaatacttcawtttttgcacagcaaattctattcttgttctggctaacaaaaattctgttggagtaaattaaaactgtgatcatatcactttttcgttggacataaaagaa

SEQ ID NO: 64456 - DNA, 201 bp, Homo sapiens
tattatgattcttcccactttatagtctcacactttcaactaacaacctggaaagtaagacaatataattcattaatttctataacatttcataatataawatgaaaattcactgctgatttttagaggacaaaatctatagcatggtgaactttcacagctccagctttatctagttagagttatttaacccacaggttg

SEQ ID NO: 64457 - DNA, 201 bp, Homo sapiens
tcaactccctgttttcaattctttgggacatatactcagaagtgaagttgctggattatatagtaattctattttttttttttttttttttttttttttaraaacctccatactcttttccttagtggctgcaagattttataattccacaaacaatgcacacagactccaatttctccacatacttgacagcacttgtta

SEQ ID NO: 64458 - DNA, 201 bp, Homo sapiens
tgcattctgatttcgttgttttctctttttcattcaaatgccttgtctctcctcctgccccagggtctttgtatattatatcaccctttccaggaatattyttcacgctgctcttagtctagttaactcatactggtgtttcagatctcagttcagaattcaatgcttttccttaccacccaagctaggccagatttatct

SEQ ID NO: 64459 - DNA, 201 bp, Homo sapiens
caggaattcctggcacaatatagaatcaggaaagctttttctagatgtgattgtaagtgatggattgacttggatcccaaatgttatcaccaaaagatacrtgcttttctttcttttcttacttaaatatgcacaagaattttgctgattgtattttgcaattacataattgatatttaggatttaatttggaaaatatgt

SEQ ID NO: 64460 - DNA, 201 bp, Homo sapiens
accagctttagtagtcatctctttaattatttcacaatagtttataattttttaaactatctgataggaagctctcagttggactgtatttttcaaagtcyatgtgaagaaagggcaaataaaattctggtttgaaaagtaacaaatgttctcagatgcaacatttgctaaactccaaatctttatatagatttatataga

SEQ ID NO: 64461 - DNA, 201 bp, Homo sapiens
aaacttttataacttgcagtttgttttcatccttaaaggttattgtcagttcatcctgcatttttttttgtcattctgtatgtatagtgaaatatagtcargtgctctatatcagtaagtctggaatgttccattctggcagttatatgctgggatacataacattgttgcacaagccagagtaagtgtaaagattgctgt

SEQ ID NO: 64462 - DNA, 201 bp, Homo sapiens
cctggcctgtttgttgttaatgccagatgctatctctagtgcctgcagacataggattctgataggcagagaagtggtggagagctattctagcctgtggragaagtgttaaaatttaacacacataatagtacattggaatgggaccgtgagttgggtaatcactctgaagtaactggaaccaggttcctagagggaagg

SEQ ID NO: 64463 - DNA, 201 bp, Homo sapiens
ggttcattcatgtaacatgtatcagaattcttccttttaaaaactaaatgatatcccattgtgtgtacctaccaagttttgtttattcattcatccattgmtggacatttgggttgcttccacctctcagatgttgtgaataatgctgttgtaaacatggatgtgcaagtatctcttcaactccctgttttcaattctttg

SEQ ID NO: 64464 - DNA, 201 bp, Homo sapiens
tcaagatcatcaaagtcttatccactctacataagatagtgttctgatatcatatctttcaggagcattttcaaatgagcctcttctacaaaggtggtttyacctgccctcctctgtgccagcaggcttctcttattgatgtgtcctgagttgtgtttccgtctgtccttagctttccaagagcacccaggcataaaagca

SEQ ID NO: 64465 - DNA, 201 bp, Homo sapiens
tgagttcctgatgaactcagaggcactgatctaacactagaagcaccaaggtttagagactttctgtatgaaaggggctcactttccactgcgtaagccamtgcagtttgggaaatcccaaattcagctacaattcccttgttgctaaaagcattctgaaatgatacagagactgactttgccaagtactttcatttaata

SEQ ID NO: 64466 - DNA, 201 bp, Homo sapiens
gtttgtataagtttatatgtacatacttagatatttactccttcctgttttcttccaacaatgttgatatgccgtataagttcttaggcaaaaagatatgwcatttaacttccatttctgttaggaagtgtattctacttagcattttaaccctagtttacagttaaatgagaaccgagaactgattttttctccaagttt

SEQ ID NO: 64467 - DNA, 201 bp, Homo sapiens
actgctttgtaatcacaaattcagctctggctagcaggatttgggtttagacacagtggcagttaatcttcaaaatacaagttggttttggttttttaaasagatttgatttgcattttatttttagtgttgaagacattttagttcaattattccgcttgtacaggctgcattaggtagcagttaagtgggcagggtcca

SEQ ID NO: 64468 - DNA, 201 bp, Homo sapiens
actatcttttagaatacagttttcaccacatacagctccaaattggctgtctacataaagtaaattaacatactatctactaaataagcttattttaatayaaacaatgattaaaacttgtgtgtatttcttaagaatatagccagtagattattttataaatatgaacaataaatgttttgtgccatattgggtggcgaa

SEQ ID NO: 64469 - DNA, 201 bp, Homo sapiens
tgttgcagaattctagagatagatgtgtctgtaagattgattaagggtgatgttatgaattgcctttctaaaattttaagccttaataaataaaaatggtsaagaggcatcacttcctggtgataaaataaggagaaactttgggttttagagatgcatataactggttgcaactgaattcaagagcaaatgctacagtat

SEQ ID NO: 64470 - DNA, 201 bp, Homo sapiens
atgttttgggctgggaaatgaagaccaaatctcacaggactaacctggagatcagaaactggggcatgaaggcacctatgaatctctgaaaagttgataayattaggtacttgctgacctgttgagaaagaaagaacccctaatggttccagaatcacaagcctggagacacaaaagagaatataagtggtgggaagcatg

SEQ ID NO: 64471 - DNA, 201 bp, Homo sapiens
ttgttatgattactatatcacatatagtaatgtttctgtagtatttgtttgtataagtttatatgtacatacttagatatttactccttcctgttttcttscaacaatgttgatatgccgtataagttcttaggcaaaaagatatgacatttaacttccatttctgttaggaagtgtattctacttagcattttaacccta

SEQ ID NO: 64472 - DNA, 201 bp, Homo sapiens
gatacaaatgcacactgaattgtgaggactgctgatctatactcagtcactacatatgttcctgtaggatgttacatcctttcatggactttttcgatttsttgccaaccacatagagaactagaaagttaggtcaagaaataagagaaagtattaggtttagatttctgggtgccaagcaagccctgcaattatttagtt

SEQ ID NO: 64473 - DNA, 201 bp, Homo sapiens
gccaaataaggcttcagtaataatttctatttatgttcattgggtagtacatttcattgcatcattctctagggaaagttagtactgtgttaatttcaggktctaatgccaatatataaacacatccagcttgtcatttgatatccagggaacattacttttcaagtgggttctccaaatgaatgggtttgactcagtcat

SEQ ID NO: 64474 - DNA, 201 bp, Homo sapiens
ataaattacaacatattcataacacagaatactacacagcagtgaaagtaacacactattgatacacacaagaactcagatggatctcacagacataaaarggagaaaaagaaaccagacacaaaagaataaatgctgcacgatcaatatgtgtgaaatttttaaaaagagcaaaatttgggccgggcgcagtggctcacg

SEQ ID NO: 64475 - DNA, 201 bp, Homo sapiens
caaatctgatcctcttttctctacagtaatagctcccacccaaagactattataaggctaaataggacaggatcttaaggactgagaagtgccatagagarcattgcctcctccctcttaattttacagctgagcaaactgaagcccaaaagattaagttattttcccaggagtcacatcagtaagaaggtcatatgtaaa

SEQ ID NO: 64476 - DNA, 201 bp, Homo sapiens
cctcagtagttactggcgggaaagagaaccgggggagagagacagtgagcaagaaaaggaggagagacaaagatggagaggaaataaagtaaaaacagatraagcaaaaaaagaaattgagtcagaagaatgacagaatgaatatggtcagaagccaactgcacccatttatgaggacataactgcttgaattgctgatgt

SEQ ID NO: 64477 - DNA, 201 bp, Homo sapiens
agagcatgtatggaattgaattaacctgtggattaaactcatccatttgggagatcatggttattactgatttaatctaaacatcagtgctagccgtgtgsatatgtggaactcagtgctgtatgaatgcgaagaatacaggatgccttttcagtcttcaatttggaaacttcatcatgataacactgattatcaggtaaa

SEQ ID NO: 64478 - DNA, 201 bp, Homo sapiens
ggaaaagaccattggagtcacccctattttttgcaggctcaggggttggtattagatgaagaaacacaagatttctctgtcagttgggaaatcctttttcytcttaggagtttattaggttttttagctgccactaagtttagcttataagaagagagggaaacagcctctgaaacttccaggctgatcctttcatttatc

SEQ ID NO: 64479 - DNA, 201 bp, Homo sapiens
taataaccgtagagaaagagagctgactgcaaagtgctaggaatgactagagactgagagagagcacagatgcttacagagagcctcagtagttactggcrggaaagagaaccgggggagagagacagtgagcaagaaaaggaggagagacaaagatggagaggaaataaagtaaaaacagatgaagcaaaaaaagaaatt

SEQ ID NO: 64480 - DNA, 201 bp, Homo sapiens
ttaatcgccccttttctgcaacacttgtgggttagggaaaataattctaaagcaagagcaaagacagagttgggagatcaccagtgaggttcaattttccrtcacattcactctgctccacacctcagataatcatgtgcttaactgcgaaacttgcttgacaattacagaacactttctcacccattactaccttgatcc

SEQ ID NO: 64481 - DNA, 201 bp, Homo sapiens
actcaaagatgagaaacaggaaaaaaatttccagctgtgaactgctgctaaagcagagaagccctgtctgtgatattagttcgtgtatcaaaatgcttgcsatttggccctagaaaaagggaccgctggcagtgttgtacataagtggtcctgcttggtttgcccatgtggtatttatctcagtcccttctgatcagggcc

SEQ ID NO: 64482 - DNA, 201 bp, Homo sapiens
ttgtttttaattctctgctgctaggtagcactaaatccccaagggactcaaagatgagaaacaggaaaaaaatttccagctgtgaactgctgctaaagcakagaagccctgtctgtgatattagttcgtgtatcaaaatgcttgcgatttggccctagaaaaagggaccgctggcagtgttgtacataagtggtcctgctt

SEQ ID NO: 64483 - DNA, 201 bp, Homo sapiens
agctactatgggagagaagagaaatagcccagccagatacagtctgcatgggctgcaccactggccccacctccgctaactgcttattgcccactgatgcrttatgatctttagccatcctgatcactcttggattcatcactgcattctctactccatcccaggttccctaatacatgtacatatatatgtgcctcaccc

SEQ ID NO: 64484 - DNA, 201 bp, Homo sapiens
ggggagataacttgagcccaggagttccaggctgcagtgagttgcgatcacaccactgcactccagcctgggcaacagagtgagactccatttctaaaaawcaaaaaaggaatcataattttgaatatatatcccaggcatgtctagtgctggtgaccaaggtctaaactactttcccacaaatcagacttttcaactgcc

SEQ ID NO: 64485 - DNA, 201 bp, Homo sapiens
aagcaagagcaaagacagagttgggagatcaccagtgaggttcaattttccgtcacattcactctgctccacacctcagataatcatgtgcttaactgcgmaacttgcttgacaattacagaacactttctcacccattactaccttgatcctcacaattctgtggggtagtaggagcagatgctgaaattgccatacgca

SEQ ID NO: 64486 - DNA, 201 bp, Homo sapiens
aatgacatgaccatacatagagctcaccttttccattaaccagatgagttggcctttggggagtgcatagagaaaacttctggttgtggtcactcctcttwgtctgtgggaagaaaaggacaagaaatgtctcctcgagcaccaagatggtatagagaaagacaagacttctgctgagacttcagaaaatgaaataagaaa

SEQ ID NO: 64487 - DNA, 201 bp, Homo sapiens
aataagttagttccttgatagttctatgtcattctttgatttaaataatgttcctagaacactgcagtagatatttgagtactattgattaggttgtttakaaatgcagtgtgttctgtccatttgctccaaattaacaattttttgaaaagcatcaggtttagtatcttactattatgctaacccattttagcttttgta

SEQ ID NO: 64488 - DNA, 201 bp, Homo sapiens
tgacccactaagtcagctctcagcatgtcactcatagctgattttgagataggtttttaactggtaagcaatatgcttaggtgccctgccctgtctcagtgataaagacaagtgaaatgccaaagtctaatccttttgtttgagaaagtatagtttcaaccaatatatttattagtctcttggggagaagccagatttata

SEQ ID NO: 64489 - DNA, 201 bp, Homo sapiens
aatataagttgctgtcgagactcctttgttggtagaaatatacttaaatttcctgggtcctgtaatcaggataaaagttgtctctctctctctctctctttttttttttttttttttgatggagtcttgttctgtcgccaggctggagtgcagtggcacaatctccgctcactgcaacctctgcctcccaggttcaagtga

SEQ ID NO: 64490 - DNA, 201 bp, Homo sapiens
ataaatataagttgctgtcgagactcctttgttggtagaaatatacttaaatttcctgggtcctgtaatcaggataaaagttgtctctctctctctctctctttttttttttttttttttgatggagtcttgttctgtcgccaggctggagtgcagtggcacaatctccgctcactgcaacctctgcctcccaggttcaag

SEQ ID NO: 64491 - DNA, 201 bp, Homo sapiens
ctataaatataagttgctgtcgagactcctttgttggtagaaatatacttaaatttcctgggtcctgtaatcaggataaaagttgtctctctctctctctctctttttttttttttttttttgatggagtcttgttctgtcgccaggctggagtgcagtggcacaatctccgctcactgcaacctctgcctcccaggttca

SEQ ID NO: 64492 - DNA, 201 bp, Homo sapiens
ccctataaatataagttgctgtcgagactcctttgttggtagaaatatacttaaatttcctgggtcctgtaatcaggataaaagttgtctctctctctctctctctttttttttttttttttttgatggagtcttgttctgtcgccaggctggagtgcagtggcacaatctccgctcactgcaacctctgcctcccaggtt

SEQ ID NO: 64493 - DNA, 201 bp, Homo sapiens
ttggccctataaatataagttgctgtcgagactcctttgttggtagaaatatacttaaatttcctgggtcctgtaatcaggataaaagttgtctctctctctctctctctttttttttttttttttttgatggagtcttgttctgtcgccaggctggagtgcagtggcacaatctccgctcactgcaacctctgcctccca

SEQ ID NO: 64494 - DNA, 201 bp, Homo sapiens
atatgtacaaacatgccatagtcatgaattggaagactcaatactgttaagatgttatatctcttcaaattaatctaaagatttattaggatccatgtcaraatcccagcaggtttttttttttttggtagaaatttacaagctgattttaaaatttatatggaaatgtcaatgttattgaagaaacaatttgaagtactc

SEQ ID NO: 64495 - DNA, 201 bp, Homo sapiens
attggtacacacacacctatatatatatatagatagatatacacacacacacatataaacacaccaattggcatatatatatatatacacacacacacacatacaatatatacatatacatatatatatataccaattggtatatacacacacactgcaattggtgtatgtgtgtgtgtgtgtgggtatatatatatatac

SEQ ID NO: 64496 - DNA, 201 bp, Homo sapiens
cttattggtattttatcacaggctggcatttatgagaatattattttcctcctggtgccatcagtgcttccatgttctaggtgcaggcatcttcgcggtcrtaagtgccagtgttctcctgaaattagcatctcatctgaatctgttaaccagattgtataagtggagagaaatataatcctttttcatgttgattttaaa

SEQ ID NO: 64497 - DNA, 201 bp, Homo sapiens
atctgtcagattacatgatttctcttgaatccttcaagttaattatggggtttacaattctggttttagtatgattgatttttctgaatgataaggtaatyttacataaaatgcatagagattccttattggtattttatcacaggctggcatttatgagaatattattttcctcctggtgccatcagtgcttccatgttc

SEQ ID NO: 64498 - DNA, 201 bp, Homo sapiens
aaacttcctaatctctcctagtctgccccctcatctgtcagattacatgatttctcttgaatccttcaagttaattatggggtttacaattctggttttartatgattgatttttctgaatgataaggtaatcttacataaaatgcatagagattccttattggtattttatcacaggctggcatttatgagaatattatt

SEQ ID NO: 64499 - DNA, 201 bp, Homo sapiens
aaccttggtgacaacagcaaaactccgtaaaaaaaaaaaaaaaaaaaaaaaaaaaaatatatatatatatatatatatatatatatatatatatatatagytttaaaaatataaaaaaatagtgatatatgtgctttttgaaattaacacattaaataaaatctagtggccaatctaagtggtgatgatcataaatatttt

SEQ ID NO: 64500 - DNA, 201 bp, Homo sapiens
atgatacaatgagtaaatctctgggctttattcagaacacctgggtcctggatctgacaaccaatacctgtgttaaaacttcctaatctctcctagtctgycccctcatctgtcagattacatgatttctcttgaatccttcaagttaattatggggtttacaattctggttttagtatgattgatttttctgaatgataa

SEQ ID NO: 64501 - DNA, 201 bp, Homo sapiens
tgactctaatggggaagaatgacatcttttcatctcttttttaatagatgaatgaacttagatataatttgaagtgcttagcagaagtcttctaactgtthagtgataaatcttttgaaatcagatatgacagtttctgggagtctttttcacatcatccttcaatttagggaattaaataataaaatttacttgttcatc

SEQ ID NO: 64502 - DNA, 201 bp, Homo sapiens
aagatgagtaaatttttgaaaaaatgacagctccagtcaagctcagatttaaagaaagaagttaatggagatttaaatcagacaaatgaagtcatccattytaagtttatcctaattttttaaaaagttaatttaatttttgtgcagtgtaaactagagtctaatatgaaattgatttttttgaagatccataggtttaga

SEQ ID NO: 64503 - DNA, 201 bp, Homo sapiens
aggaaataaactgtatttcagtgcaattattgagaagtataatttcaaacataatctgtttcctttaaagatttttgagttaaaattaaaataatagaaartttgtcaagaaaaagtttgatattatattatgggtattaattttttttatatttattacatttaacatttaagctttaagttttaaaagccatgacaaac

SEQ ID NO: 64504 - DNA, 201 bp, Homo sapiens
atatcagtacctcctaattaaactgctctgtttatttcaatgtaaaaaaatttgaacttcaaatatttcagtacaaataattatctgcaagtatttattcyataatttgttactgagagcctactaaaatagtaatatagagcacaatatagcaattattatcctataaaataatagctatatctatacaataacaatagt

SEQ ID NO: 64505 - DNA, 201 bp, Homo sapiens
tcagcaagactgctcacatttaaaggttgaagctgaagtactcattttacccatagcagaaacttcttacttataaagcaaaatataagttatttaattgsaatttctagaaagtattggcaaagatgatgtttcttaaataaaataaatcagaaagaaaaaattacactctgccctgcttcttcctgcccattcatgata

SEQ ID NO: 64506 - DNA, 201 bp, Homo sapiens
tcaaaatctaggacactgttaatgtcaaacgctggggagcaacaggaaccctcagtcattgctggttgggatgtaaaattttacagcaatttgaaagacarcttggcagtttctttcaaaactagacataatcttgccacacaatcaatccagcaatcatgtcccttggcctctatgcaaaggaattgaaaacatatgtgt

SEQ ID NO: 64507 - DNA, 201 bp, Homo sapiens
tgctgtcagcaagactgctcacatttaaaggttgaagctgaagtactcattttacccatagcagaaacttcttacttataaagcaaaatataagttatttrattggaatttctagaaagtattggcaaagatgatgtttcttaaataaaataaatcagaaagaaaaaattacactctgccctgcttcttcctgcccattca

SEQ ID NO: 64508 - DNA, 201 bp, Homo sapiens
acaaaaataatattctagaatccaagttaagttctttttctctacataaagtaatttttctgagtatgtacatgtttatcaacttatctttacatattatkttattgtaaaacataaaacgggaaaatttttgcttgaattgtgaaaaaataagttttgctgtcacactcttaatataggacacatattaaagtgagatag

SEQ ID NO: 64509 - DNA, 201 bp, Homo sapiens
agaatgctgtcagcaagactgctcacatttaaaggttgaagctgaagtactcattttacccatagcagaaacttcttacttataaagcaaaatataagttwtttaattggaatttctagaaagtattggcaaagatgatgtttcttaaataaaataaatcagaaagaaaaaattacactctgccctgcttcttcctgccca

SEQ ID NO: 64510 - DNA, 201 bp, Homo sapiens
acatttttgttgttgtagtggtttttgtttttaattctctgctgctaggtagcactaaatccccaagggactcaaagatgagaaacaggaaaaaaatttcmagctgtgaactgctgctaaagcagagaagccctgtctgtgatattagttcgtgtatcaaaatgcttgcgatttggccctagaaaaagggaccgctggcag

SEQ ID NO: 64511 - DNA, 201 bp, Homo sapiens
catttttgaaattaaaaataaacttgtaatagaaatatagttctaaagagtttcaccatcttgtagatttttcaataattttttcatataaagtcaatacrtctttatagaataaaatattttagaatctagtttataggaaatagcataaacatctgtttcgataaacttcccctaataaagacataccttgaacacgag

SEQ ID NO: 64512 - DNA, 201 bp, Homo sapiens
gtatggaaaagctgaatttttaaggagacagcaaacctcacagattcaggggatttaatttcccctcctcatatcccagaaggtctaagttactagttacsttaaacaaaagaaataattaaacaatggagaagatgctatagaaaagtttcccttttcttttctttttaaatatacttcttatatgcagtcctaaaagga

SEQ ID NO: 64513 - DNA, 201 bp, Homo sapiens
gaagacttgcgagaatatttcccaagctgataggcagtggagttgggtgctgggtctggcttttgtaattccagccccaagccctgcaccacagagaagayagttatcccgtggaggtcaggatttggaaatacttggccaaggaggccctgattaatctggacatagaaagtagagcaatagcttgaatgaccttgcagg

SEQ ID NO: 64514 - DNA, 201 bp, Homo sapiens
tctactgtggctcctccctcatgcccaaccctaccatttatatactgtagatattttatgagaaaattgacccctgtttatgtgcgtcattccagtcaccmacaaacacacctttataaaggacgcacaattacatgtgacaaattaattggtcatttcattttgtgtccagaaagtactctttgaggaaccatagggcaa

SEQ ID NO: 64515 - DNA, 201 bp, Homo sapiens
acatttccactagtgatgacatcagactatgcaggggatggggtggtgtaggggttgtggtaggcagggcttctaaaccagcaagactaccttcattcctytggccgtattaaatacctataagagctaacgaaagcattgagattgctatggatgaattggttcaagattagttcattatccctgtccgcctctagcacc

SEQ ID NO: 64516 - DNA, 201 bp, Homo sapiens
ttcatcgttaagatagttttcagctcagaggctgagataaagacccagccagttttctaggacacacatcattaattagacaacaaattcttacctccttscttgttggttttacttacaggacaggaaacatctctatggaattaaattgctcactacatgctcctaatatgttttgtttttatgcttactccagggaaa

SEQ ID NO: 64517 - DNA, 201 bp, Homo sapiens
accaagttcacagaagtgccaaaatgaaaataagtaaattaagaactgttctatctaatttctttattagaacacacatttttgtgtgtttttcatgtgtrtgcattatatttataaactgatgtgattaatatataaactgtgttaatctgcaattatttttatttcctacatagaattttatatggtgatttttaggaa

SEQ ID NO: 64518 - DNA, 201 bp, Homo sapiens
ctacatttcagtgacttaaataagcacatatctaaacagccttcccttagacacaggcaaatgcaacccatgattccacacagcccttaaaatggcaactygcaagatgtacacaattttaaaattgtattagcctattcatagcaagattcttcattaacctatgtgcatattcaatgttgaccacatgccccccaaccc

SEQ ID NO: 64519 - DNA, 201 bp, Homo sapiens
ttgatattccttttaaagagaatgtctgagcattatctcacgttttctaaaacagtttaacagtccctcctccaggcagattcattattaagtgcataatsatatgaaggttcaggatggcctgaaatctggacgatcacctatttctgtaaataaagttctgttagagcacagctgcacactttttaaagtaatattttc

SEQ ID NO: 64520 - DNA, 201 bp, Homo sapiens
gatgccaggatttgcagatttgaccttgaagtggacttctgaacagaacggaaagaattcagatggtggccttcttgggacatcttctcgcctccctgagytggtcataatcgttcatttccccatccgaacctactttttctgcctttgccattttatcagatttatacttatctttcctagacactgtctttcacctgt

SEQ ID NO: 64521 - DNA, 201 bp, Homo sapiens
gtgagggcagtagacacttctcaaatagatgtgtcagttacagcactctcctcctctaaagtattcacaaagagacagataaaacagtttttttttcatcytcctcctccccttcctctttgtcctccatgttttcttcatcttcctcttccacctttttccaggcaactttagtggggtgctttgagccatcaaactctc

SEQ ID NO: 64522 - DNA, 201 bp, Homo sapiens
ttggaaatagaataagagaaacaaggtggcgggccaagattgggtatcctacatacctcccatagttattttgatctttttatgtgatcattctacacacwctcaggtgatcacaagactgggcaaccatctctctcattgtgtctcttatacacctgcatcaagcaaggtgttcctaagtccttaatattctaaataaat

SEQ ID NO: 64523 - DNA, 201 bp, Homo sapiens
tctctctgcctgtctctgcatccagttgctaaggctggttgttttgcgagcatgtggtgtgttctgtgggggaaatgggcattgctggcttttcataaccragtggggttggtaggaaacattgaagaatctatttacgttaatgggagtatatgtttgcccagcacattacattgtcggctcccagctgtatttgtttta

SEQ ID NO: 64524 - DNA, 201 bp, Homo sapiens
gccctttggaggtgccatattgcccaggtgataagcattctttaaagacccaatacttgaccactctgagtaagcctttcatcttaacattacctctttcrtgcctttcctcctctgcctgtcatttgtttcccaggcttaatcactcactccaccctccacttcactcctcccacaccagtccagttatggtaatttacc

SEQ ID NO: 64525 - DNA, 201 bp, Homo sapiens
tagaagtctgttcttttccatgccagcagaaattctccctacccagctgttataattagaggaattgctccccgagttttcatatcagatcagaactgttwtttgttgttttgcaaggtctgcacacataaagagtttttaagcaaaacatttatggtctaggattagaaatgcttcgacatgcaaacgtagactgtgata

SEQ ID NO: 64526 - DNA, 201 bp, Homo sapiens
aattggtacacacacacctatatatatatatagatagatatacacacacacacatataaacacaccaattggcatatatatatatatacacacacacacacatacaatatatacatatacatatatatatataccaattggtatatacacacacactgcaattggtgtatgtgtgtgtgtgtgtgggtatatatatatata

SEQ ID NO: 64527 - DNA, 201 bp, Homo sapiens
tattagatctctgaggggttttgtccagggttagaccttggttttaagatttgaccactccactatattaaataaagagagatgagtcacatgttaataarcatgtcccagcccatacaaaagcaccataattggttgctatttgctgttctaattgaggtagagactgaatgggaataacgtattttttgtgaggcttag

SEQ ID NO: 64528 - DNA, 201 bp, Homo sapiens
gaatcatctttgtaattggtacacacacacctatatatatatatagatagatatacacacacacacatataaacacaccaattggcatatatatatatatacacacacacacacatacaatatatacatatacatatatatatataccaattggtatatacacacacactgcaattggtgtatgtgtgtgtgtgtgtgggt

SEQ ID NO: 64529 - DNA, 201 bp, Homo sapiens
ccaccatacctggcctcattttcttatctttaaagtgaggataataatgctacctagctcaaaaagtcgctatgcatattaaatgagttagtatttttaaraagagcacttagagtcgtttctggcccaaagtgtatgctcaggaaatgatagctattattcttactattgttatcattagcgctggatattacctttctg

SEQ ID NO: 64530 - DNA, 201 bp, Homo sapiens
agaatcatctttgtaattggtacacacacacctatatatatatatagatagatatacacacacacacatataaacacaccaattggcatatatatatatatacacacacacacacatacaatatatacatatacatatatatatataccaattggtatatacacacacactgcaattggtgtatgtgtgtgtgtgtgtggg

SEQ ID NO: 64531 - DNA, 201 bp, Homo sapiens
ggatttaaagctttgctattgtctactaatgatcttgttatatatcctccatcataaggcaacagagtaagcttgattaaaaattatttaaattaaccccktgtggaaatgtcagtaggaatcatattgaattacctaaagtcacataattttttaaaaagcctcccaattcttgagcacaagctttaaattttacacaca

SEQ ID NO: 64532 - DNA, 201 bp, Homo sapiens
tcttcctcatatcattcttgacttttgcctaatcaggcactcagaaccaccgagtttcttcttgataaagtgcttaggagaaatctacatggggtgggggrgtattatctcaatgggctacaccatcctcttccagctgcaactagttagcaccttgggtgagctaaggaggagatcccttttaagtcattgaagggagtc

SEQ ID NO: 64533 - DNA, 201 bp, Homo sapiens
gttatacacataaaagtccaggtgtcttttttttatagaataatttcttttcttttggatatagacccagtagtgggattgctggattgaatgttagttcyatttttagttctttgagatatctccgtactgttttccataaatactgtactaagttaaatccccaccaacaatgtgtaagccttttcttttcctctgcat

SEQ ID NO: 64534 - DNA, 201 bp, Homo sapiens
atgataatattatctcttccattgagattttccggggtaacatgtaactacttggctcaacaacgagacatgaatgcagtgtcttttctcaggaaactctycaatgatggatgggtatttacttgtttgttttcttcagaatccaacaattctctttcttttgaaaaagcctttaaaatagtgcgattctcattgcttaat

SEQ ID NO: 64535 - DNA, 201 bp, Homo sapiens
accctatgttgtatgaaaaagtggattttctctttagttgctagtactgtattctgtgcggaaaagaccattggagtcacccctattttttgcaggctcargggttggtattagatgaagaaacacaagatttctctgtcagttgggaaatcctttttcctcttaggagtttattaggttttttagctgccactaagttta

SEQ ID NO: 64536 - DNA, 201 bp, Homo sapiens
acaactctgatctgtaacttaaatgaatgtcaaattgcctcacaggaatttcagatcttcagtctgaagttctggtagataatattgaacatattcctcarcaacagcatgcatgcttctaaatagccactagaattcattggaaaagagcaatatacaaacaaacaaaaaaccccagaaaactggcaagctgatctagat

SEQ ID NO: 64537 - DNA, 201 bp, Homo sapiens
actttagatatttatttttcaattattcattgggaatctgtattgtaagactttgggatacatcagtatttaaaacaaaaatacttgtcttgtaggccttrtatttaacgtttactagaaaaatatcatgcaagccttcttattctatcagtttattgaaaaaaatgagcatttttttacatattacatgtatttttacat

SEQ ID NO: 64538 - DNA, 201 bp, Homo sapiens
agatttgtttaagaagtaaaaggctggccaggcacagtggctcatgcctgtaatcccagcactttgggaggccaaggtgggcagatcacctgaggtcaggrgtttgagaccagcctggccaacatggcaaaaccccgtctctactaaaagtacaaaaattagctgggtatggtggcaggtgcctgtaatcccagctactca

SEQ ID NO: 64539 - DNA, 201 bp, Homo sapiens
aaaattgggccacatgagtgataataatctactaatgctttaatcctgatttttagcctagccataatgaggagaaatcttttctcaggtcaatacttgggtgggggggcatttttcacattgacgattaaagccttgtaacatgttaaattaacctttcatcatgtgtctcattagcctcaatgtatttgccaaagcttt

SEQ ID NO: 64540 - DNA, 201 bp, Homo sapiens
tatagtagagatggagtttcaccatgtaggccaagctggtgttgaactcctgacctcaggtgatccgccagcctctgcctcccaaagtgctgggattacargtgtgagccaccatacctggcctcattttcttatctttaaagtgaggataataatgctacctagctcaaaaagtcgctatgcatattaaatgagttagta

SEQ ID NO: 64541 - DNA, 201 bp, Homo sapiens
caaaattgggccacatgagtgataataatctactaatgctttaatcctgatttttagcctagccataatgaggagaaatcttttctcaggtcaatacttgggtgggggggcatttttcacattgacgattaaagccttgtaacatgttaaattaacctttcatcatgtgtctcattagcctcaatgtatttgccaaagctt

SEQ ID NO: 64542 - DNA, 201 bp, Homo sapiens
atttatcataatgtgatccaagatcaagttgcatcaaaatcaccaggatccttacataaaatactcattctccaacataagcccagaactatttaaccaayacctttatggtggactcaggtataaggcattaaaaattttccaaaaagggacaatgaggcatgctgaagtgtgaagaatgcacctagctttatggaaatt

SEQ ID NO: 64543 - DNA, 201 bp, Homo sapiens
tattgatagaacaaaagaaaacacagcatgcactttcaaatgcaagcacctatatctttggcacaaatatcgataccaaattcacgttatagttggtacayataaaaacaaatataatgaattgcaaggttctgcagatttacggctaattactcttttctacttcttcatctatatttatcataatgtgatccaagatca

SEQ ID NO: 64544 - DNA, 201 bp, Homo sapiens
agaaataactctcctaattggttttattgattactgttgatgcagcattgcatcattgtagataaagcacacacacagatatacatgtctgcctgcgtgcrtgtaggtacacatatgccctccaaaaaattgcttatctgaggctgtaggaaaggatctattatatttttcaactcttccttcatccctaagtgacaggaa

SEQ ID NO: 64545 - DNA, 201 bp, Homo sapiens
catgatataggaagttgtaaattacattatgcactaaattactatattttatgattgttttctatattaatagtaaagtatttcaaagtaacataatttamagatatttctgttttatatctagacactgccaacctcattcaatatatgcttaaagtctttacctgaaaaaaatgtctgaagtaataggttagctcaatc

SEQ ID NO: 64546 - DNA, 201 bp, Homo sapiens
atgagtagcctctctgacatttgcatgccattcagttttgattagttctttctaaatttagctccttggcaggtgcacatcttttcctggcttcgctggcrtatcatattggttctaccaccgtcatttagttttggaatcacctgtttaacttctggcctgacctcattgcaatgacaaatcacaccttctgtgcgaagg

SEQ ID NO: 64547 - DNA, 201 bp, Homo sapiens
taggaagactaaaattatgataacagcaataagcatttatatttatgcataaatgcatatacatacttgttataatctcaaataaagaaaagattccatcmaaacacatgattcttctaaattgtacgcacacagtttgagtacctgtaagatatctgcaaatggagttaaatgtaataatttctaacattgtgtttgcct

SEQ ID NO: 64548 - DNA, 201 bp, Homo sapiens
aaccacagagctaaactctgtgtgggataacaatatatagtatatttcttgcttattagctattatttgcatctcttcaactgctccaacctttcaaccaytgcattatccactcagacacaaataatttctggtgtctaccagtattatgcagaataatatcatttctgtactatataaaacccttttgagggcctgaga

SEQ ID NO: 64549 - DNA, 201 bp, Homo sapiens
ataaaatgcttttaacattttatcaacagagaagaaacaaaacatggaaacataaatgagtagcctctctgacatttgcatgccattcagttttgattagktctttctaaatttagctccttggcaggtgcacatcttttcctggcttcgctggcgtatcatattggttctaccaccgtcatttagttttggaatcacctg

SEQ ID NO: 64550 - DNA, 201 bp, Homo sapiens
aattctactcagcagaattagcagcttgaggagcattgatgagtttgtggatttgctcaagaaataagttaaagtactgatgcaactctaattcttttcartgatcaaaatgggaatgagtagtgattatgtccagaaactgatagataaaagaatataatttatgctcagcattggtggctagtccactaagagtgatgt

SEQ ID NO: 64551 - DNA, 201 bp, Homo sapiens
gtctcatgaatcttatgaaaaatgtaagcactgaaaaattctttaaaaataggaatgtgctttagaaaggctgtcaggtcctacttagagtacagctcttytgttgtgaggacagaggtgatgtaataatcatatagtttcctagttatgaataaccaacccatggtttgtattcagggagttataaaaaatggaaacatg

SEQ ID NO: 64552 - DNA, 201 bp, Homo sapiens
aggatcccctttgtaaaagcaaatcagaagaaaatcataatgcccacactcgaggggctcaaattcctgtgcaaagttctggtccacagcttttctgagayattatattgcatttcaagtgcactgtaagccagttagtttagttttgttactatttcaacatttgcaaagaaataaagaaaaacagtgggtaaaatcaat

SEQ ID NO: 64553 - DNA, 201 bp, Homo sapiens
tctgttccttggagataagggtcaagtattaagcaggattcttacagtctcccttccctttaatgatctcttcaaacattttcccctagaaaaagtctttrcccatagtcattctcttaatatactttacctagaggaaatgttttagctacagtagttaaaaagcttaaaattatttgtgtttccgtttcaaaacccaca

SEQ ID NO: 64554 - DNA, 201 bp, Homo sapiens
cctcagacagagcatacagcttctttgctggtgcgcttgtgttctgggaaggagcaaatgaaatcattcacaaatcaggaattcctggcacaatatagaawcaggaaagctttttctagatgtgattgtaagtgatggattgacttggatcccaaatgttatcaccaaaagatacgtgcttttctttcttttcttacttaa

SEQ ID NO: 64555 - DNA, 201 bp, Homo sapiens
ctacgtatgatcttgccactgcctgctttaatctactgacctcaaatattcttaggatgcaattcattttttgtataattaacagacctcccaagatttgracacttggccatcttttccatcctcattccgtggtgatgctactttcttatctaaaataacatttgagattcatacagcatcctgtgctgttatttggcc

SEQ ID NO: 64556 - DNA, 201 bp, Homo sapiens
tatgaatacccttggagaaccaagcagtacatgggtatgagaacccataggtatatctttgtgcagtatcaattttaattatggttaagtaatttaaaatrcttgatatcaaaccaaacaggtatttagtagattataattgttaggatattcaagtagaatacaagattccaaagaaattcctgattaccagatgctttg

SEQ ID NO: 64557 - DNA, 201 bp, Homo sapiens
tttagtgtgctatgttatgctggatagaagtccgcagtgaaagttataaggagattttattccagagaaatgaaaaaaagtcactctgagtaggtattaamtctagttatgttgaattcggaagctctatcactgtgagggaaccccaggattcttttcaggaacaatagtctttactccccaaacatgacatcattaggt

SEQ ID NO: 64558 - DNA, 201 bp, Homo sapiens
gtgtgggggactatcttcttgtgtgtaggagtgtctgtgagttttgtatgctaaataccagcagtacttacctttacacaccaacaaatttccagaattcytttgggatgcattgtgatccctcttcattaccattgctgtagtttttttgtttctccatttcattccatcactttctatctactctgggacccactttaa

SEQ ID NO: 64559 - DNA, 201 bp, Homo sapiens
tatgcactaaattactatattttatgattgttttctatattaatagtaaagtatttcaaagtaacataatttacagatatttctgttttatatctagacaytgccaacctcattcaatatatgcttaaagtctttacctgaaaaaaatgtctgaagtaataggttagctcaatctcttatcttctgggactcctatctctc

SEQ ID NO: 64560 - DNA, 201 bp, Homo sapiens
atttgaaagcatgcattcaaatgttgtctgcatcctgggaactaattagagtggaagagagtaaaatgaattcaacagcggtgtatccaggagctgcacaygaggacttatatttcccacatgatataggaagttgtaaattacattatgcactaaattactatattttatgattgttttctatattaatagtaaagtatt

SEQ ID NO: 64561 - DNA, 201 bp, Homo sapiens
ctgcacaaaggcaagataagagagggcttaagtgatgtggaagactggcaaggacagggtcatccagtcctgcatgtcagcgaagcaggaggtctctaagmagcatgacatgtagcagtgatatggtcgtcagcattagattgcccactaagcaggcttcatctaatgcatcaaatagagtataatgtgaattatggtatt

SEQ ID NO: 64562 - DNA, 201 bp, Homo sapiens
gagccaacccacccgctcaagcccttttactagagccccatttctatccatgagggctcagtcctcagtaacctcctcctaaagcccccaccttttaaaaytatcacattggtcattaagtttcaacatgggaactttggaggacacactcagaccatagcagtgagttggagagaaggcatggcctggtggaaaggacac

SEQ ID NO: 64563 - DNA, 201 bp, Homo sapiens
gaaaaagagggaatcatttcttaagcaatgattatataaaataaagaagatgtagcctgagctttgctagtattctgatgctcactgagaaaccaggcccygtgatcctgggagatgataacagtagattcacttatgtacctttttggaaattacttaagttctcagaacaatccaacaagtgtgctctgttagtccttt

SEQ ID NO: 64564 - DNA, 201 bp, Homo sapiens
aatccaactttttggattaacatggctacatggtaatcacccactaaatatttacaacatgaatttatctgtgactcacttgatgtaccgtgattgtgtgygcatcctaagacgtgattcctgtactatggttgagtaattgtcatggcaggtttgcccctctagtgttggcttctcgttttgctttgtgctgcttttctc

SEQ ID NO: 64565 - DNA, 201 bp, Homo sapiens
cagagcgccttcacccagaacaccagaggctgaatgtaacctctttatttctccaacttttcaccagttaaagggaaaaagtgaattaaagtgaaaaataraagattagttgaagtaccttttcaaagactatattgcaaaaccaagtaatagcattagagatgatgaaattgtgtacctgcaggtatattggacagaaag

SEQ ID NO: 64566 - DNA, 201 bp, Homo sapiens
ttatcgtctttgaggaggattttttttctttttattacagttggggcagaagattccagtttactgtagtatgaaatatatttgaaattggctttcacatytatgtgtgtgctagcttgtctatttctagtttgatttttggctaacgtatagtttataggggctccaactgaaaacctggatgtttaccaaggctactct

SEQ ID NO: 64567 - DNA, 201 bp, Homo sapiens
gcccctctagtgttggcttctcgttttgctttgtgctgcttttctctgctatccaggctgccattgctatttttattttctacttctgatggttcaggaayatgaaggcaagataaaaagaaagtatgtgttgccttactgccactattctatgatatgagtcaggggtatggaaaagctgaatttttaaggagacagcaa

SEQ ID NO: 64568 - DNA, 201 bp, Homo sapiens
tacgtgttgttgccatccagggagtgaaaacagggttgtatatagccatgaatggagaaggttacctctacccatcagtaagtaagacgccaaagatctcrgccattcgttcaatgcatgtaaaataacaatggcagcaacaacaaaaagaaagttctatgtctgttgtttctgccagtttttgccttagtatttgatctt

SEQ ID NO: 64569 - DNA, 201 bp, Homo sapiens
tgtcttagctttatttcctgttgtttcagcaatccaaagcaatggtggtgtttgggtgtggaccacggctcttttcctcaaatctaaggatttcatctgamaataggaaaatagctacagttcactgtagttgttaatctttataccactcttgccaattttgtttttctttcttcacttattctacttgcattttcctta

SEQ ID NO: 64570 - DNA, 201 bp, Homo sapiens
atgacgatgctggaaatgggttttaaatagggtaaattcttatttgttctcaatacctccggaatagctgaagagtgaacactttaaagactgattggcartgctgactggctagtgtattcttaggtggtacaaaagcagtataattcactactttttaaccactattaaaactcctgttttcaggctttcaatgtttgt

SEQ ID NO: 64571 - DNA, 201 bp, Homo sapiens
accctgctatattggcaataacaagatatagtcgaccaataaaattggaaaaatataagagcaagacactgcaaacggcatataaacatattcagggaaawgaaaactaaaacaacaataagataacttgatttttgtccttgaggtaggcaaaaattagcaattgaaaaaatgtgcaactgtccagtttcatcaagtttg

SEQ ID NO: 64572 - DNA, 201 bp, Homo sapiens
aattgtaatacacatcgccccctaaatgcatgtctcctacttcttctgaaatacagtgaggtaggggcaggggttgattggtttaatgctagaggaaaaaytagatctgttacctgtgttaaaatgatacattaatcttcaaaaaattcataggtttaagaagtgctcaagaatacttttgatacatttaacttctgcctt

SEQ ID NO: 64573 - DNA, 201 bp, Homo sapiens
ggattaaactcatccatttgggagatcatggttattactgatttaatctaaacatcagtgctagccgtgtgcatatgtggaactcagtgctgtatgaatgsgaagaatacaggatgccttttcagtcttcaatttggaaacttcatcatgataacactgattatcaggtaaactcaaacagtacaagacatgctttctctc

SEQ ID NO: 64574 - DNA, 201 bp, Homo sapiens
agacatgctttctctcatcttgcaaaaaaaaaaaaaagtcttttatttttaaagtatttgaaatagttctatcaattgtttgacaattaatgattatcatktggtcatagaaacagttaccagggacgagtatgttcattttaagtgacttggaggcaggatccagtgtgcatattcaattctcgatgagcagtcttacag

SEQ ID NO: 64575 - DNA, 201 bp, Homo sapiens
ttctcgatgagcagtcttacagaaatgattttcctgcactttgcttgacttagtcatgtagacaaaacttattggcattttggacatattggcgtctgcarattgacttgtaataggtagttcaactattgcattacaagaactgcaaatcatctattcgtggctgttgttctttttaaaagagtcagaacaatatctgta

SEQ ID NO: 64576 - DNA, 201 bp, Homo sapiens
ttgctgaggagtgatctaatagccagggagtgatggtaggtgagaggtgaaatgtacagagtggggggcatagaagagggagctatggagttcaggcaaaygcaatgcaaaagccacagcaccttagtgtgagtgccatcatctgaaactgtccttggtggtatgggaagcgttgatttggggcaagaaaaaggcaagata

SEQ ID NO: 64577 - DNA, 201 bp, Homo sapiens
aattggatattgaaaaagggaaatataaatcaatctctctctttccctctctctctctctatttcagtctctctctcacacacacacccacatacacaacsttgaaaggctgtgcagaagcagcactattactttatcttcaaaggttatttccaactccaatgtatcaatctaaagagtaaatttgaaaccttgttttga

SEQ ID NO: 64578 - DNA, 201 bp, Homo sapiens
acacaaaaacagatcagccattcttcccgagtgaaattgattttattttctcctagctcggttctcctagctcagagagtaggttctagccttatttctgyaggcagaaagatccttggagtgaagatagacttctaatttggttttcaaagcatagagcatacattacattttcttcattttgagtctgtacacatgatg

SEQ ID NO: 64579 - DNA, 201 bp, Homo sapiens
aaaagattccatcaaaacacatgattcttctaaattgtacgcacacagtttgagtacctgtaagatatctgcaaatggagttaaatgtaataatttctaayattgtgtttgcctgcgttaggaacatatctcaacagtactgcaatgtagaatagatagtttaaatgagcatttttatctcatcatataatagtgattcag

SEQ ID NO: 64580 - DNA, 201 bp, Homo sapiens
gaagaaacaaaccatttcttctcttagtatactctcaagaatctttacttctgatgccagatgtgattttcttcacacacttcaactctccattggatacmaacgggagtcctatgattcaattcaattcagacactatctgcctggagttagtgtcagatctcacaggttaagggttcagtcccacaagactccctccca

SEQ ID NO: 64581 - DNA, 201 bp, Homo sapiens
catggtggctcacacctgtaatcccagtgctttgggaggccgaggcaggaggatcacttgaggataggagcttcagatcagcctcggcaatatagtgagamcctgtctctacaaaaaataaaattttaaaatattatccaggtgtggtagtgtgcacctgtagtcctagctatttgggaggctgaggaggatcataggagc

SEQ ID NO: 64582 - DNA, 201 bp, Homo sapiens
atttttctcttgttttcatcatcagaaccatacttgacaatcctctatgagacaaaagggtagaaatgtttctcagactgttactaatgctaggaaaattycattcattttctctgttttgtataaactcatgcagcagccagatcctagtggcaccctgagtgctgttgaggtccggagaagaaaggcagtgtcacttag

SEQ ID NO: 64583 - DNA, 201 bp, Homo sapiens
taaagattattgagttggagccctacacccacactctttcctatctccatcacccctacccctatagaagagtgatgtttataccagttgacttactcttrtgaaggacagaaatttgcaagatggctattaatggtgtggtaggcagcatgactgcaacccacctttccagattcagctccatctaccctccaccgacct

SEQ ID NO: 64584 - DNA, 201 bp, Homo sapiens
ctaacacattctagagcttagagaaaaatagtgatgacaaagatagacgcagatgcagtcttgtgggacctaagagtttctacagatgtgagttccatgckcactacattttaagtttgacttcactacattatggaaagacatattgtgctctgtgctatttagggtttcactaaatgttggttgttggtgttcagataa

SEQ ID NO: 64585 - DNA, 201 bp, Homo sapiens
ttgaagatgtattaacaagaattggagtttctctgaaagggttaaatgtttatttcattcatttcacagagtatggtatgaagtcttcaacagaaacttgrtttccatcaatcaccccaatacttggctaattatcatgtttttgtctatacagacatgcttaatcacaaacatgcacacgatcatgttcataacaaaaag

SEQ ID NO: 64586 - DNA, 201 bp, Homo sapiens
ggaaaatgtcttaatgtttttaataggctttaaatttcattggatttcttcagtctgagatcaactgtattctgctttttattatatgggactacattaamgagattcttcttaaggcaaagcctatgatattcttcaataactgtagatttgaagatgtattaacaagaattggagtttctctgaaagggttaaatgttt

SEQ ID NO: 64587 - DNA, 201 bp, Homo sapiens
gaaaacttctggttgtggtcactcctcttagtctgtgggaagaaaaggacaagaaatgtctcctcgagcaccaagatggtatagagaaagacaagacttckgctgagacttcagaaaatgaaataagaaatgatagaaacaaagcaagacattaaattttcaaccaataatggctggtttgcaatcttgaaaaagagatgt

SEQ ID NO: 64588 - DNA, 201 bp, Homo sapiens
tttttctttcttcacttattctacttgcattttccttaaactctacactgttaagaaggtagtctcttgtttggatattatttcctgttaacaattatagrtctttttattgtaatcatttagatttacatatattttctcacttgtcacaaaggccaaataaggcttcagtaataatttctatttatgttcattgggtag

SEQ ID NO: 64589 - DNA, 201 bp, Homo sapiens
tcaagtagtgacagctatgtagggagtttttaatctgtacttcttgattaattattgttaaggtgaaaccaattttcacagtacattttattaatttattyctcgagtggcttcatgttcatgaaatgtactgtgcacatcacttgtcttttttccccgctgaaaaaattcagtgtcagcaaagaagatatgtcaatttct

SEQ ID NO: 64590 - DNA, 201 bp, Homo sapiens
agtaagcagaatgacatgaccatacatagagctcaccttttccattaaccagatgagttggcctttggggagtgcatagagaaaacttctggttgtggtcrctcctcttagtctgtgggaagaaaaggacaagaaatgtctcctcgagcaccaagatggtatagagaaagacaagacttctgctgagacttcagaaaatga

SEQ ID NO: 64591 - DNA, 201 bp, Homo sapiens
taaggtgaaaccaattttcacagtacattttattaatttattcctcgagtggcttcatgttcatgaaatgtactgtgcacatcacttgtcttttttccccrctgaaaaaattcagtgtcagcaaagaagatatgtcaatttctcaagttaaaattgcagaaaagtacttatttacacgctgctttgctgaaagagcatgat

SEQ ID NO: 64592 - DNA, 201 bp, Homo sapiens
catccaagtggattatagtcatggaatgactattggatgatgatgaagctcattgatcctagaaggatcacatctcagggctgtcttgggaaagctgtgcmgatagaatcaattctgtgacagatggtaattgtttttctattcttcctgcatgtgagacaaagatgaatatgctgggtcagtgacatcagcataaagtta

SEQ ID NO: 64593 - DNA, 201 bp, Homo sapiens
aatcaacagtttgtaagggtcaccctccctcacttctgccggttattctaaagttactatttcaactgtggacaatcacacaacaagcattgctgcaatgstatctgggggagacggtgataacgttagaccaaggtgatggtaacagagttggtgaaaatcagtaaatggactactcaggcattgaaactaaatatttgg

SEQ ID NO: 64594 - DNA, 201 bp, Homo sapiens
agactgtgaggaaatacatttctgttgtttaactccccgtcctccacccctccaaccatggtattttgttatggcagccctagaaaactaatacaaaaagyattttctcttcatcatcaagaatcatcagaaatctctaagcaaataattaagtctttccctatgtaaaaattcctgttctcagagaaatgggagaaaaca

SEQ ID NO: 64595 - DNA, 201 bp, Homo sapiens
atattagggctcacgcgaatcacctggaaagccaagaaaagtacagattccttggatcaccatctagatattttagttcagtgggtctaatgggaggcccragaatcaacagtttgtaagggtcaccctccctcacttctgccggttattctaaagttactatttcaactgtggacaatcacacaacaagcattgctgcaa

SEQ ID NO: 64596 - DNA, 201 bp, Homo sapiens
gattgtataagtggagagaaatataatcctttttcatgttgattttaaaaataaaccaggaaaattcaaggttaccatgttttgcaaatattagggctcaygcgaatcacctggaaagccaagaaaagtacagattccttggatcaccatctagatattttagttcagtgggtctaatgggaggcccgagaatcaacagtt

SEQ ID NO: 64597 - DNA, 201 bp, Homo sapiens
atgaagagatacataaggtgaggttcagaaggcatccaagtgcaggagcttctgtccctgtggagctggggcagctaccctcctggcaaggggatgtattyagcaacccggaagctctccaaaccttgtccttttaagttttcatggaggcttcatttagtaggcatgattgattaaaattattggtgatcaacttaacct

SEQ ID NO: 64598 - DNA, 201 bp, Homo sapiens
ctactttgataatagaatacggttacaatatataaggtatcctactttaaagatagatattgataatagataatagataaatagatagataggtgatagayagataatgtagtttagtttaaacttaaagtttaacttgtagtacccagttagtaatatcaagaatggcttaaaatgacacagctgcaaaccctacataca

SEQ ID NO: 64599 - DNA, 201 bp, Homo sapiens
caccatagacataatcaataaggaaactctgtatttgaattacgatacctcattttccatgatgtggttataatgcattgcatgcctgtatcaaaacatcycctgtactccataaatatatacatctactatttacccacaaaaattacaaatcaaaaaatacatatatatgttttctgaggctatcctaaacctcccttc

SEQ ID NO: 64600 - DNA, 201 bp, Homo sapiens
catcttcgcggtcgtaagtgccagtgttctcctgaaattagcatctcatctgaatctgttaaccagattgtataagtggagagaaatataatcctttttcrtgttgattttaaaaataaaccaggaaaattcaaggttaccatgttttgcaaatattagggctcacgcgaatcacctggaaagccaagaaaagtacagatt

SEQ ID NO: 64601 - DNA, 201 bp, Homo sapiens
tcctggcaaggggatgtatttagcaacccggaagctctccaaaccttgtccttttaagttttcatggaggcttcatttagtaggcatgattgattaaaatyattggtgatcaacttaaccttcagcccctctcctcagttggaggttaggaatgaggccgaaagctggaatcctcaaatcacgtggtcggttcctctggca

SEQ ID NO: 64602 - DNA, 201 bp, Homo sapiens
gcatttatgagaatattattttcctcctggtgccatcagtgcttccatgttctaggtgcaggcatcttcgcggtcgtaagtgccagtgttctcctgaaatwagcatctcatctgaatctgttaaccagattgtataagtggagagaaatataatcctttttcatgttgattttaaaaataaaccaggaaaattcaaggtta

SEQ ID NO: 64603 - DNA, 201 bp, Homo sapiens
acgcaaatggtgttactgtttcacactgtcttgtcattgacttttgtcagcaagtaacttgggattgtttttttcctccttcaagaaaaggataaaatagkgttatgtataagaaaaaccccatattcttcagtatagaaggttgtttgaaaattctaccattagaaatattgtcatgcttgtgggtaattaggaattatg

SEQ ID NO: 64604 - DNA, 201 bp, Homo sapiens
aaatgatctttcccaaacagtcattaggaatttaatgacttaggtaagatctctgaagcatatacccacattaacatgacaagaaaaggatgtacacttaracctttatttaaggaagtccagagatggatattaatattaacagaatttcaaaagttgaattactgaggatatattcagcaaataatttaagagttccag

SEQ ID NO: 64605 - DNA, 201 bp, Homo sapiens
atattttaaatgtgtgcataaatattataattgattattgattaagaaaaataacagtaacaatgccatataggatttttaatatatttctgaaaattatwtatactaaatatagatactattttatatatataaaagatatatgtacatataatatgtatctttatagatactatacatagtatatcttgtataagatat

SEQ ID NO: 64606 - DNA, 201 bp, Homo sapiens
aagaaaaggacaagaaatgtctcctcgagcaccaagatggtatagagaaagacaagacttctgctgagacttcagaaaatgaaataagaaatgatagaaasaaagcaagacattaaattttcaaccaataatggctggtttgcaatcttgaaaaagagatgtagtctgcaccacgtaaagctcaaaggagaaatcagcctg

SEQ ID NO: 64607 - DNA, 201 bp, Homo sapiens
cagcctgggcaacagagtgagactccatttctaaaaatcaaaaaaggaatcataattttgaatatatatcccaggcatgtctagtgctggtgaccaaggtstaaactactttcccacaaatcagacttttcaactgcctgcttttatatctaccattgattattgtcattactattattataatttataaattcctagttc

SEQ ID NO: 64608 - DNA, 201 bp, Homo sapiens
cctgccagaggcaatcatggacagagaggtgatgacagggtgaataggaactagccatttgaaaagatgcagagactggctttcaatagcaggcagcccaygcagagaacaagcctctattaaaatcctaccatcctgcctcccacattactctcacaattaagtccttgtcactgtccagcctctgagaaaggatctggc

SEQ ID NO: 64609 - DNA, 201 bp, Homo sapiens
atttacaagctgattttaaaatttatatggaaatgtcaatgttattgaagaaacaatttgaagtactcacactaacagatctcaagatttactaagagccratgtcacaataagacagtttgtgcttttggtacaagtataggaaaatttaatattggaatagactagtatattttcctgaattatggtaaagtctccact

SEQ ID NO: 64610 - DNA, 201 bp, Homo sapiens
agaatgttttgatcttaattagcttttactaggcctttctgatgcccaaataatatatgtggctaaatggtaaacaataaggatgaggcctatttttttgyttgtttctaaaacacttttcaaagaatgtacagtgggaacctacatggaaatcttcataacaaaaattttttaggtaatataaggcacttttccttaggg

SEQ ID NO: 64611 - DNA, 201 bp, Homo sapiens
ggccaatgagcaagtcccataggcttgtcccttgataactttatatcggtgtaattaattctcatcttaaatctttttacctgctgtcagccaagaaatarctaggaaagctgattttccaaaagcttgtggatcttagatgagaaaaatgatgagtataatgttgaggctcatgtaccatccttttttctaattacacag

SEQ ID NO: 64612 - DNA, 201 bp, Homo sapiens
aattaacactgcaaatcacttgagctatgagtttctatttgctacttttttggaaatattcattagttttctcattccataaacatatattgtacctcctrgacacaaaccacagagctaaactctgtgtgggataacaatatatagtatatttcttgcttattagctattatttgcatctcttcaactgctccaaccttt

SEQ ID NO: 64613 - DNA, 201 bp, Homo sapiens
ggtaacagtgataatccttctgctgtagaaataaagtgataattattttaaaatttactttcatatggttttattttctgataaaaataaatattatgaayaatattttagatatctccttcagttaacctagaattttataatcagatacctatatgatagaattaaacttatgcatgagggcataagagctttaataaa

SEQ ID NO: 64614 - DNA, 201 bp, Homo sapiens
attagttcattatccctgtccgcctctagcaccaaggctgctctaggctttaagcctcccagtgaaagactctggatctcgactggtttccaagggtagasagaaaattacaggatacattctaattattaatattacagatgttgtccttacattgagacacatctgcctggacagtggtcaccatctgctcctctggaa

SEQ ID NO: 64615 - DNA, 201 bp, Homo sapiens
taagaatctgcccaaagtcactcaggtggtagatagaaaagataagattggagcatagttagtatgactcattagcttacatttttaactgttttattatyactgcttttatgtgccagacattttttcataatatggtctgacaccttttctaacaagaagttataaacacattatgatgtaatgaaaaacttttaggga

SEQ ID NO: 64616 - DNA, 201 bp, Homo sapiens
acatcagagggagaagtgcatggctgtgcaaaagtgaggatttaaagtcccaagacagaagacaccaggacatgttttctctcttatcataagacatgtayttgatttatcatgtatcttcaaaactattctaaaattccatattataataactttgggaatgaatgagtatcattgctagaaaataggagataccttctt

SEQ ID NO: 64617 - DNA, 201 bp, Homo sapiens
aaaatgatacattaatcttcaaaaaattcataggtttaagaagtgctcaagaatacttttgatacatttaacttctgccttgcttgctaattttagaactyggtcacccctaattagagatgcaactgtattatacacccagccacactacaggtgcttaatacatatttgttgttgaaagcctcaatcgtgtgtatgttt

SEQ ID NO: 64618 - DNA, 201 bp, Homo sapiens
aggatttaaagtcccaagacagaagacaccaggacatgttttctctcttatcataagacatgtacttgatttatcatgtatcttcaaaactattctaaaawtccatattataataactttgggaatgaatgagtatcattgctagaaaataggagataccttcttgtctgatgctggaaataaaactaagctgacgattgc

SEQ ID NO: 64619 - DNA, 201 bp, Homo sapiens
ccccgcgccccgcggagagggcgatgggtcccggtcaggactgagccccccttcccctctccccagtcccgcctggcaccccctcctctgccccgagggcragccacggtctgcgccgccgccttcccctccggtgcccccggctcgccgtcctcccgcgccctccctccccggacccgttcccggggccaccatggccgc

SEQ ID NO: 64620 - DNA, 201 bp, Homo sapiens
ctgataggtagaatataatggaagatagctatccccttactaaagtgcccatttctctcctattcacattgagtctgtgaacccaattttggggcaagatkccccactgctaaccgggttatcacaggatctctggattaattcatgccacattctgggactttcagttgagtatattttatttttcataagagaaataac

SEQ ID NO: 64621 - DNA, 201 bp, Homo sapiens
cacaattttgagaagtgtgatttccatagatttgtttaagaagtaaaaggctggccaggcacagtggctcatgcctgtaatcccagcactttgggaggccmaggtgggcagatcacctgaggtcaggagtttgagaccagcctggccaacatggcaaaaccccgtctctactaaaagtacaaaaattagctgggtatggtg

SEQ ID NO: 64622 - DNA, 201 bp, Homo sapiens
ctaaccacctggattaaaatgaccagatgttaacaatttgtatctatagcaagcatttttattgttaattttttgatacataaagattgtgcatatttctrgggcatgtgatatttagatacataactacaatgtgtaatgatcaaatcagggtaactaggatatccattgcctcaaacatttatcatttctttgtgtggg

SEQ ID NO: 64623 - DNA, 201 bp, Homo sapiens
ttctgtgtgatctgaatgcctttaggtgaggcatgcactccactactgtggccacatggtaaccactccttaattttagaaaggaagacacaacacacacrggctccctttgtttctgtacatatgttgactttgtttatgtgccttgcagacactagtgtctgcaacttctgaattaaaggggtggaaaaaatcagagat

SEQ ID NO: 64624 - DNA, 201 bp, Homo sapiens
ggattgcaaattttggtaactactgtggcaaaaacagaggaccatggtgcaaagaaacaggaagagccctatttaagatggggtcgtcagaaagcccttaycagcgacagccagtgaggccaagcctctgaacagtgcttctcagactgtccatcttttcaatttccggtcagttgcaggaaattaaatatgtgatcctac

SEQ ID NO: 64625 - DNA, 201 bp, Homo sapiens
cacttcctcccatttctttgggtcaggaatctggcttttgttttccatatttctttttcccaagacattgggaggcatctggtgaacaacaccaataaaayagttctctccccacggtcatccaggtcacttctctaactcattcctgcacacacagcacacgtggaatttgcctgtttagtctatgttcttgacttgatc

SEQ ID NO: 64626 - DNA, 201 bp, Homo sapiens
acacgtggaatttgcctgtttagtctatgttcttgacttgatcacagacgcctgtacaataaagccccttttcaacaaggtgctgcagaatgataatgctytccccaaaatctgaaactgatttgtatcattgaagtttttttctgtattaaaaataaagcaaaattaaaaataaactttatgtggaggaatttttatctc

SEQ ID NO: 64627 - DNA, 201 bp, Homo sapiens
aagctttacatgaagtcacatgtgttgatataggcacatagacatcttctagcaccaacagaatacatacgtaacacataccgaatgatcttgatggatawatttgctccaccaggtaattctatttagtaaaattcagttaatgcagaatcccatttttaaaatttacatctttattacacatttttttatttttaaaaa

SEQ ID NO: 64628 - DNA, 201 bp, Homo sapiens
gtattgtttttatttggttaatagaattactcacacaatttatagccggaacaaaaacctctagcctctctgaatggccttccactcaaaacagcgatgawaataaatgtctaaaatgtatctggggtctgccccaacttgatatcaccaaacgtgtttccaagtttttgtttttggttttttgggttttttttgagacga

SEQ ID NO: 64629 - DNA, 201 bp, Homo sapiens
taaagcaaaattaaaaataaactttatgtggaggaatttttatctcagatatgttagagttgaaaatattttataatggagattgcaactttcagttatgwgttatttgaaaaaaatatatattcacttggtaacctttaggggaaaaaatagtataaattgttcaatatgctactaatattgggttttttaaataattaa

SEQ ID NO: 64630 - DNA, 201 bp, Homo sapiens
tgttagagttgaaaatattttataatggagattgcaactttcagttatgtgttatttgaaaaaaatatatattcacttggtaacctttaggggaaaaaatwgtataaattgttcaatatgctactaatattgggttttttaaataattaaactctatttttattaccagaatctgtctttaactgtttaaaaagacaaaga

SEQ ID NO: 64631 - DNA, 201 bp, Homo sapiens
caggtttcaccatgttggccaggatggtcttgatctcctgacctcgtgatccacctgcctcagcctcccagtcaactcttgtggatacctccaggtacaamgtatatcagaacattcaccaacaagttaacatgttttgaaactatggatggtgcttttttgatatttttactgcctctgttggtgattgatagtgctcac

SEQ ID NO: 64632 - DNA, 201 bp, Homo sapiens
gcagcctgattaaccacagatccccagatagaacccatgccaaaaagagcccgagtgggttatgaggtaaggtaggtcccatgatgccacagctgtgccartgagaaggagaggatgctgttggagttaggaatggatggcagagccatggagttgggaggtattcgatttgaaaagacagaagaatatgagctcaggctg

SEQ ID NO: 64633 - DNA, 201 bp, Homo sapiens
taatcaaatttgggatgtgagaggaagaagaaaaaaaaaggaagactctgcagtttggagcctgagcagctgggagaatggagaatacggcttcctgaatraggaaagctcggccaagagcaagtttgaggaaaagctcaagagtccagcctggacccatcagtgccttcctgtacccccgtggagatgcccagtgacctg

SEQ ID NO: 64634 - DNA, 201 bp, Homo sapiens
atgggccaggacattccaaaaagattggacatggtgggagaggtacttgtttctggagcttctgatggcgctgtcacctcccctgttcctgccccgcagcrcaggccttgatccgaagctctggctttctacacctctctctcccacggaagtgggaaatatcaggagtttaaaaaaagaactgttaaactgtacaggatt

SEQ ID NO: 64635 - DNA, 201 bp, Homo sapiens
ggaggtcatttggaagacaagagcgggcgtctctggaaagcagggggagcactttttcacaggggttgtgaggcggtgggagaagagaaagcagactgggwgcacagatgactcttcagagacttgctttaagggaaaaagagaggcgggatgtaatagctacaggaagggtctttttgtttttctgaagtgtgggataaa

SEQ ID NO: 64636 - DNA, 201 bp, Homo sapiens
agaggtgaactcgtcaaggtcttgtggctactaagcagcagggccagggtttgcatcgggtgctctcttgactccagcacccacaattttaaccactgtcrctattctacattttgctgtttctcaggtattaatgaaatcagcctcaacccagggtatccagcctcagttggcctagtttggattaggtggcagggtagg

SEQ ID NO: 64637 - DNA, 201 bp, Homo sapiens
gaggaagggatcccctgactgtccatcctggtgactgccattgtgctaagtcacgaacagcccatctcaaaactatatacgctgtgatgataaaattaackgtaacaccttttgttattatcctaagggctctgtgaatttcaagtttggggttctttttgccaaagatgggcagctcactgatgatgagatgttcagcaa

SEQ ID NO: 64638 - DNA, 201 bp, Homo sapiens
gagaatacggcttcctgaatgaggaaagctcggccaagagcaagtttgaggaaaagctcaagagtccagcctggacccatcagtgccttcctgtacccccrtggagatgcccagtgacctggatgtgcaagtccaaggcactcaagaaagagctgtgcctggaactctttcattagcatataaatgatgtttaaagtcatg

SEQ ID NO: 64639 - DNA, 201 bp, Homo sapiens
gctaaaatctctgccttgtctcactgaattcccattacaatccagcagggtcagtgttctcatgatgcctgctttacagacgaagacctaaggccagaggytaagccatttgccacacaccacagaggcagtaagtggcctagacagggcttgatctcccatctgtctgcccagtctgtgcccctccaaccaccccacccc

SEQ ID NO: 64640 - DNA, 201 bp, Homo sapiens
gtcctcagatgtaattaacctaatcctgggagctttgatttccttaatgctgtaaagagtactttccctaatgtacagctctggcaacatcatctttatgmattcaagcaaacaaattcctgctgtaataacaacagcaaaccttcagcatctcttttttgcttatgaaataaagtaggtagtcttcagcttgacagttaa

SEQ ID NO: 64641 - DNA, 201 bp, Homo sapiens
ctcaaactcctgacatcaggtgatccacccacttcagcctcccaaagcactaggattacaggcatgagccaccacgcccggcctgcttccaggttttcttrgaaaatatggtttttaactctatgcataatactctaccacgtgatacaccatcacttctttatttcccagttgttcatttctaccattttatacttgtaa

SEQ ID NO: 64642 - DNA, 201 bp, Homo sapiens
attttccatgcctttgaatccccttggaaatctgctaaaacccctagaccccttctcagaataatgtttttaaatacatgaaattaaatactaggattacraaggaaaacagttgtattgaaataattatcaacatgatttttgaaacctaatttatgatacagtaatatatatgattttaaaatacattaaataggccag

SEQ ID NO: 64643 - DNA, 201 bp, Homo sapiens
tcctgatttctctctccctctcttatgagtatcactaggagccagttatataagtcaagtacatgtggtgttggttactttcatctgtttgttcattgatmactcatttgttgatttgtatcttctgagtgtcaggccctttagggaaaacagctgtgattttctagaagctcctttttagcttctctgatgctgcagctc

SEQ ID NO: 64644 - DNA, 201 bp, Homo sapiens
caattgtttgcatttctctatggtacctgtcatattttacattgtcattatttgtgggcattttttacctgtcctagtaggcagagattatggtgcttttsttattgtatccccagcagtacttggctcagtgccagacatccacaaatcagctagaagatgagttttgccaaaaatctctctaataaattcttttttctt

SEQ ID NO: 64645 - DNA, 201 bp, Homo sapiens
ctaagatctgttgctgctacctgaaagaagcttgtctgtgccatccacgcatctcttggaggccccagaagtttaaacgtcctgatgacagcttaggagtktactctctaggcgagagagaaagacgttcatgacagtgttgcttttagtagaacaaagaaaaataactgtgataggcaactgatcaagcacaataatgtg

SEQ ID NO: 64646 - DNA, 201 bp, Homo sapiens
cctgtccccacctgcaactcctccccactacagtctttgcctaagtctgtcactgttgccgtgcagctctgagacatctagaatgcccctctcttcactckgtccgtcctggtcacctggcctcaaggaagcattgactgagcccaaagcctcactgagtcctacgtggacaagtgttacccaacctccaatcttaatcct

SEQ ID NO: 64647 - DNA, 201 bp, Homo sapiens
gtcccctgttcttttgtctgttgttatggcatttaaccaggttgtgttgtgatttatctgattatatgtatgtgtgtctcttactccctctaggatttgcmgtcctctagggcagggatcatgttggatttatctttgtccagcagttagtacaggccctgaaaaaaatggtttcagtaatgtttgctaaatggacaaata

SEQ ID NO: 64648 - DNA, 201 bp, Homo sapiens
tcctcttttcttagcattagtgatgttacacatacatgttaatacccttttcctaaacatatccatcaaaatgaatgcaaaagatctggtgtctcttctcraaggaaactgccccacttttctgtgagtgtgtggctcttatgtggctctcatgtggctctcgtgtagctccggtgtggagcatcagatccttcacctcct

SEQ ID NO: 64649 - DNA, 201 bp, Homo sapiens
acattactaagtatgcactaggcactgtgcgaagtaccttacatgcattgcctcatttaaacctcataacacacctaggagacaggtattaaccacacaargacactgagattcggaaattaactaatttgctcaaggcgacccacaaggctgcagatttgcacagctctaggggtactgttctcatagaattcagtttgt

SEQ ID NO: 64650 - DNA, 201 bp, Homo sapiens
agagagatcagggtccatcccaagctggctttgggattattgttccctgagcatgtgggaagggctggacaccacctgcagtgtcctctaccatctgtggytggcaggatcagttgcattctcactgttctaaacctttcttttccagtccatcagaactacattggaaacgatgccgagaagagccctttcttcttgtcc

SEQ ID NO: 64651 - DNA, 201 bp, Homo sapiens
ctactgcagagtcctcagggaaagccctagataaaactgagtggccatttagtgagagcctctgtgttgccatggtatgcacatgccttcacctgcttcartggagcagagctgctggaggaccgacctggtcaggcaggccaggccccacagggcctctcaagctttatgtgcatacacatcacttggacaccttgacca

SEQ ID NO: 64652 - DNA, 201 bp, Homo sapiens
cttggcatgggggcatcaagagccctggcatccacctcttggctggcctttcttccttcaccccttccttcctccctccctccccctccttcaccctcccsctccctccctccctccaaggcaggagagggtgggtttcccccttcttctacttttctggaatggactttctcaatgtccatatcttcttcctccaggaag

SEQ ID NO: 64653 - DNA, 201 bp, Homo sapiens
atccacacatgttggggtggagagatcctggaagttgctatcaaacctgagcaagattgttttcagtcatagaatgtgtttattcatatacattccccttraggagaaagaagaaagactgggcatggctttcttttgaatgacccgagaggctcttttggagaaggaagttgtagaacttgtcactgatttgatgtttgg

SEQ ID NO: 64654 - DNA, 201 bp, Homo sapiens
aatctacagttcactcagccagccaaaaaattctttggctatttatctacatcctgttccactttccatgggggtaaaaactaggtgatcatcaaaaataraacagacaaaaatacacaaattatattatgaatatgattttgtattgtagaacagtaccccatgtacttaattatatctccattcagaatacataaaagt

SEQ ID NO: 64655 - DNA, 201 bp, Homo sapiens
caggcatcacttctagactccaccaggtccagaggaagaagaagacggtatttaggagtgaggaagcctctctagaagccccttggcagatttctccagtstcattggccagaatttggtcacatgttcattcctgaaccagtcactagcaaggggcagaggaatacatgatcccccgagagagatcagggtccatcccaa

SEQ ID NO: 64656 - DNA, 201 bp, Homo sapiens
atgcttctcctgagaagctggtttgttgttaaccttataagcagtgggaatcctgtaaatgaaagggcttttcctctttgcattggctcctaggaagctcygaactccatttgtggcttatctctaacagtcttaaaggactttataacatgcatcctcatcttattctcttgttttcagtttatttacctacacttgatt

SEQ ID NO: 64657 - DNA, 201 bp, Homo sapiens
taagacacataaaatatctgaagaatgaatttagccacataaaagatacctcagttgattcagtcaacacctgttctgtctgtcactggtgacaccacacyacttagaccaccacctcccctgaaggagcaggtgcatagctataagtcagagtaggaattggtactgtgaaagagatgcatgtagagcaccacgggggtt

SEQ ID NO: 64658 - DNA, 201 bp, Homo sapiens
ttctttttgccaaagatgggcagctcactgatgatgagatgttcagcaatggtgagtgatctcctcccgctctctgctgccagagaccctgtcctgccttkttgcattcttgccagttggagcttaacttgtctgttgagttggagtctttaatacgaggagatagttttacacaatttcagcgtgaattttgtagggcag

SEQ ID NO: 64659 - DNA, 201 bp, Homo sapiens
ggcccagctctctggcccggaccccaggacccagctggcacagtgcttgtgtccataaactttgctggactgagccaaacctgtgccctgtatcagagagmcatatcagaggcagatctatccaaggagacttttctgtccccacctttctgacattgctgtccactctccttttcagacttccttctctcccagcttctg

SEQ ID NO: 64660 - DNA, 201 bp, Homo sapiens
ctcaagagtccagcctggacccatcagtgccttcctgtacccccgtggagatgcccagtgacctggatgtgcaagtccaaggcactcaagaaagagctgtkcctggaactctttcattagcatataaatgatgtttaaagtcatgaaactaaagaaattaccaaagggaagggagagacagaggcaccagcaaagtagact

SEQ ID NO: 64661 - DNA, 201 bp, Homo sapiens
ggttatcttttcactttcttggttgtgtcctttgaagcacaaaagctttaagattagatcatgtctagtttgtctgttttttttctttcattgctggcacktccgttgtcatgtccgagaaaccattgcctaatccaaggttgcttggtcactttttatagtttactgttcccttgagataatgtcaaatttgtcttttat

SEQ ID NO: 64662 - DNA, 201 bp, Homo sapiens
tctaccacataacagtgagggtttggtgagccaaactcatgagctcagatgagcaggaaattgccagaaaaaaataggcccagttctgtggtactcccaargatcctcttacagtgacttttctcttctaggatcccatcaggctccttggaaagtgcttctacttccgaagccaaccctgaggggcactcagccagctct

SEQ ID NO: 64663 - DNA, 201 bp, Homo sapiens
tcttggggcttctcacggctgatctcagcttaaataccatcttctcagaggggcctcccctgaccatcccatcaacattagttccttcctctgctattctstaactcaacatcctatttgttttcttagcagtgcttatcacaatctatattcatttcatttaccacttacttactactctgtattgttcattgttttatt

SEQ ID NO: 64664 - DNA, 201 bp, Homo sapiens
cacggctgatctcagcttaaataccatcttctcagaggggcctcccctgaccatcccatcaacattagttccttcctctgctattctgtaactcaacatcytatttgttttcttagcagtgcttatcacaatctatattcatttcatttaccacttacttactactctgtattgttcattgttttatttctagaacatggc

SEQ ID NO: 64665 - DNA, 201 bp, Homo sapiens
ctatccctgattcaaacacttgtgctcagggtagtggggtcatagactataaacctggcttttgaggcccatcccctcagcaatgcttgtggacagggcakattttctctggagatgatatagacaagtcagtttcaaagaagggcatgagctgagctggaactcccaaatgtgtccattaacattccttcatatagcgag

SEQ ID NO: 64666 - DNA, 201 bp, Homo sapiens
tttaaaagctcaaactaaaagcacttagtgaaaatgtcttcctctgctgatggactcccttatctctgtacttttttaaataccataaataaagatatagrttatgaactccctaaaaataggaataatgtttatttgccactgtatctctagaaccaagcacaatgcttagcattagttacttagtaactattgattgaa

SEQ ID NO: 64667 - DNA, 201 bp, Homo sapiens
attaaagtgccttccaaccttccataattaccacagatttgttctgttccaagcaacaaagccagacaccaaatacgtttctcgattcttctccattggcygtatagtaagtagaaaatgtcttgatattttggacgtagaattgccaatcattccttcttaatattcaaaggagttgtcatcatttgtggtgaattttca

SEQ ID NO: 64668 - DNA, 201 bp, Homo sapiens
ctttgaacacagaaaaagagtgagagttcagttggcagggtgtgagcgagtgacttgacttggtggcacgaggaggagtgagcagcatgccagatatgtgsggtggtaagtgcagcctgattaaccacagatccccagatagaacccatgccaaaaagagcccgagtgggttatgaggtaaggtaggtcccatgatgccac

SEQ ID NO: 64669 - DNA, 201 bp, Homo sapiens; identical to SEQ ID NO: 41320

SEQ ID NO: 64670 - DNA, 201 bp, Homo sapiens
agagaatttgaggcttcatcaaagtctctcttggtgccttaagatgaaacccttgtctttcagctttctcctgtctcagggcaagtttctgttttcgtagsgcacatatccattccatgggttagaagagcttttggccctgtttgttaaggaggggaacatctgtgggttctgaaatttgcttcccttttatatcactaa

SEQ ID NO: 64671 - DNA, 201 bp, Homo sapiens
gttacatgacaactctgtagccctgttaaaattttctcctctcttgacatctccatactatcagcttttcctcttgcctccctgcttcaccttctcagcatttttttttttttgattccttcttgtctggctggcccttaaattttggtgctcttctagattctgcctccagcattgttcttactatatatgctctttctg

SEQ ID NO: 64672 - DNA, 201 bp, Homo sapiens
gttatatttacttgaaagatccatgatcttgctgctgttacaggctgctccagtgcccctcaaacttgattatgcataaaaatcacttgagcagtttgttyaaaacccgtgttctgatttggcatatctggagtgggctgagtagtgtgcattttttacaagcttacattttgaaagtgacttttaattccttatgtgttt

SEQ ID NO: 64673 - DNA, 201 bp, Homo sapiens
catagtatttttgtgtgtatgtgcatgtgatgctgatatactttttaatatatttttccgattatgaaaggaatacatagtcattatagaaaatttgaaayatactgaaaagcacagagaagaaaattaaattcatgtgtaatcctacaaataatcactattacgatttagtacacatcgatttagtaattaaatttgtat

SEQ ID NO: 64674 - DNA, 201 bp, Homo sapiens
tctcctgtgcttggctttttgctgctctgtaccagcggctctagaatttatacataacaggggcttaggaactaccagtagcagtctggttgaaagaggcrtattgaagtaatgtttgcttagctctttacataagcctgagaaaatgccagctgtctagatcaaaaaacaggatgcagattgtgaagaggttaaatctcc

SEQ ID NO: 64675 - DNA, 201 bp, Homo sapiens
gaagtttgctggagagcggagagagcgcctgaggaaagacaggtgggaaccaaataatcatgcagagaaatgtaaatcacaactctgcagagtgccccaaraactgacaacagggtcatcttcccaggcagtgggtcagggaaggtatacagaaggagggggactttggtagaactgaaggatgagtagtagggtttttta

SEQ ID NO: 64676 - DNA, 201 bp, Homo sapiens
tctttttaccatcaaatcgttaaatttgttcttcctttttttcttgaactttttaagcaagacaagcaatatgcttcctgttctaaactcaacaaatgaaragagcattattacgtatgcctgtgtctaaaatatagtgttttatgatgtttaatttatatttttatatgaatgaatgactatcagctcttctcccaagcc

SEQ ID NO: 64677 - DNA, 201 bp, Homo sapiens
acttcagcccagcctgaaatggacaaaccaaactggactttgccaccctacgtaagcacaactctggcccctgccgcatccagtgtctggaggaaatacayacctcccaggaaagacatcaatggggccttcatgtgatccttaatcaccatacacttggcagtcaaacactgctcacctggccctgccatacaccagagg

SEQ ID NO: 64678 - DNA, 201 bp, Homo sapiens
tacattccacatttcttaccaacttggctacaaagtcaggtagccgttaccacagcctcctcctcagcttccataactccctaaaatcactcacagaattmatgaaagcacttttttttttttactattactgatatattataaagcatcagtccccaacctttttagcaccagggaccagttttgtggaagacaagtttt

SEQ ID NO: 64679 - DNA, 201 bp, Homo sapiens
tactacatgccaggcaatgtgcagagcaatggggatacaggggcaaagacactcatgatatgggtttggatcctgatcctgccattattaatcaaaggacsttacactagctactctccatttctctgagacgcagttttcctttctgtaaagtggagatattacgagtgcatatctagtaggtttgaatggaagtttcaa

SEQ ID NO: 64680 - DNA, 201 bp, Homo sapiens
cctccttagaacaaaagatgttcctgtcacccttatcactcaggagctctgtgctaggaaccactaacaaagaccaaatacgtattcccattataccacamccctaaagcagttaattccatttttcagaatctcttaatttctagaaaggtctttttattgaacataattcacctgtctactgtattttctttttctttt

SEQ ID NO: 64681 - DNA, 201 bp, Homo sapiens
tcttccccagagagtcttgggccagaaggaggatgagggtccctccagcctccgtgcctccatcctgaccctcgtcgcctctgcactgtccccatggctcwcctgggccattccttcccactccgttcagccacagggtccctgtcagagccttggctttggtgtccgcttatcaaccagaatctacttttttagaagttc

SEQ ID NO: 64682 - DNA, 201 bp, Homo sapiens
tttacagagtgtaaatagtgcttcgaggagaataaacaaggttctccgatggagaataacagcaggaaggagggtggctttatatggggagatcaggaaasgccactctggaaattgacacttgagctgaaacctacgtgatgggagagagccagtcatccccggaactgtggaagagttccaggtggaggggtcagtttg

SEQ ID NO: 64683 - DNA, 201 bp, Homo sapiens
ctcccagtctggcagagcagacacggtgcagcacaaagcctctagctgagatagtgaagtaaaactaacatgtacagggacatctgaggaggaagggattytaagtcaaagtggtggggccaggaaggctcctttctggggtcagaggagactccaggaccatccttcatgtaatatacccattggtgctggttccttatc

SEQ ID NO: 64684 - DNA, 201 bp, Homo sapiens
tttggcggtctgtattggaactttctacaaatcttaggaagagctattctcactggtgctgtcaccttagagaaataaggggtcagagataataatgtgcrtgcgtgtgtatgtgtaaacatgtataggtatttgtatgtgtgtgagtgtggtttcatagactcttttttgtctctctctttttttttaatatatttgatt

SEQ ID NO: 64685 - DNA, 201 bp, Homo sapiens
tttcaagtaggggagtggtgagattagatctgtacctttgagcagacaggggaggcagaggagaagcctgctctcagaggctgtggcaacagtccaaacargagacagggttgccttgggagagggccataggtcagaagggagacaggggaactaattcaagagccattttcatggtagaattggcaagtggaggttgaa

SEQ ID NO: 64686 - DNA, 201 bp, Homo sapiens
agtaggggagtggtgagattagatctgtacctttgagcagacaggggaggcagaggagaagcctgctctcagaggctgtggcaacagtccaaacaagagayagggttgccttgggagagggccataggtcagaagggagacaggggaactaattcaagagccattttcatggtagaattggcaagtggaggttgaaagagg

SEQ ID NO: 64687 - DNA, 201 bp, Homo sapiens
agatggcccatgtgcaaagactttgtttgcctgctgctgtaggagctctgtaatttctgttaggattgttgtggcaaccacgagtgagatttttgagaacygagtaggtgcagttctctgcaggcatcactgagagagcaacactctgcagaggtaggaatgctactgcctcaaggcaagtagccacagggcccagctctg

SEQ ID NO: 64688 - DNA, 201 bp, Homo sapiens
tgtgtcacacactcggcctttaatcctcaaaaccccctgaggtgatgggggtggcattccagcacttccccacctctaccacataacagtgagggtttggkgagccaaactcatgagctcagatgagcaggaaattgccagaaaaaaataggcccagttctgtggtactcccaaagatcctcttacagtgacttttctctt

SEQ ID NO: 64689 - DNA, 201 bp, Homo sapiens
aaatccattgtgagaggggatgctccatcaagcttggcagcttcagggatctgtaaaaaagaggtgagttcatgatactttcaatttgaactttgaattcyccttttccttaatgaaaatgattgagattattggaaaaaggtttgagagcagaaggaagaagagcatgtctactgcagagtcctcagggaaagccctaga

SEQ ID NO: 64690 - DNA, 201 bp, Homo sapiens
aaacctgtgaattcactcttttcctattgcatacgtatttgaaaggagacttttcttcctaagaaaggtaattgagtccagaccccagggtttggagtgaytccgctcccacgggggtatctgtgttactgtttcaggtgtggtactgtacatttccatttggtgggctgcagtgtattttttctggtgcacttatcttcc

SEQ ID NO: 64691 - DNA, 201 bp, Homo sapiens
taacagaaaagctggttctaaaagattgttcttcataaagagattacaggaaggaaagcattgtcatcaatcagtcattaaatccacctgtcactctgtcrggtccttgcctcctcctccttcttgtgttgtatacaaacctgttcagccatctgagaaagactggatggagattaagtgctaattcactctgtacacagc

SEQ ID NO: 64692 - DNA, 201 bp, Homo sapiens
ataaagctatgatggctggcataaagaaatactaaaattaaacatagaggagggccagggaacaaaggataatggagcagggagttgggagattctgtttwgaaagaatgtcccaggaagccctctctgaataggttacctgtgagcagagatccaaaagaagtatgggagtgagtgatgagggtatctagggaaaggata

SEQ ID NO: 64693 - DNA, 201 bp, Homo sapiens
tgcgtgtacattagttgattgtaaatagcttacaatttacaaataataaatatacaatgctgtttatcataaaaatccacttagccaattggttcttacaraatgtttttgttaatatttgctgaactcttgtatccatagccaacctacagttgcagttcaaccatgattttacacttggagttatatctcaatccactc

SEQ ID NO: 64694 - DNA, 201 bp, Homo sapiens
ggagggatgcaggaacaaagatgccttccaagatgtcttttgtcgctggcatataatctggggggtcttgttctagtcccctcccctgagtcaggcccacraagtcctccccagccctgccagactgggctggctcccccgctgtgtcccctgttcccttccctggtcctgacatccatcacatttggtggtaggtgactg

SEQ ID NO: 64695 - DNA, 201 bp, Homo sapiens
gtagtagtaatattattctggctcagaatgcctttgaccctaagtatccagcatcatggcggtattcatactggctatttataaagaactagcagataggrtactattcttgttgcctgtttttcatttctttaattacagtcatctaagtgttgtctctaacaaaaatgagttgctgttgttttcattgcagacagttgc

SEQ ID NO: 64696 - DNA, 201 bp, Homo sapiens
gagaccagcctggccaacatggtgaaaccccatctctaccaaaaataaaaaaattagccaggcgtggtggggcacgccttagtcccagctactcgggaggmtgaggcaggagaattgcttgaacccaagaggcagaacccaagaggcataggttgcagtgagccaaaatcgcgccaccgcactccagcctgggtgatagag

SEQ ID NO: 64697 - DNA, 201 bp, Homo sapiens
ccaccactcacctcctgctgtgtagcccagttcctaagaggctatggaccaataccaggggttggtctgttataaagagtacaactcaggaagaaccaaakggaagagatgcatagggcaaggtatgggggtggtggcatggagcttcaataccttctccagttgtatccatattttcagtacctcaatatgttccccaac

SEQ ID NO: 64698 - DNA, 201 bp, Homo sapiens
ggatcacttgtggtcaggagttcgagaccagcctggccaacatggtgaaaccccatctctaccaaaaataaaaaaattagccaggcgtggtggggcacgcyttagtcccagctactcgggaggctgaggcaggagaattgcttgaacccaagaggcagaacccaagaggcataggttgcagtgagccaaaatcgcgccacc

SEQ ID NO: 64699 - DNA, 201 bp, Homo sapiens
cgtaggaaatctctatgtgatttccagagattcctggagacaggagaaggtgtgccctgattctgtgggaagcacggaaggaactggtgcaggctgtgtgygtcacagtgttgggtgacaacgggagcagctcaccagtcttgttctgagcaagaggctgaagattgagggatacattccccatctgtttacctgccagct

SEQ ID NO: 64700 - DNA, 201 bp, Homo sapiens
tcaggttacttctctgaacctcagtaatgctgaagaacatgtgatctgaagtcattcttgtttcatcattcactaattgtatgatcttggacttcctttarcatcagttttctcatctataaaatggggatatttctgttatctaccttagagggttgttatgaggattaaatgagatcatgtacataaagtacttagcac

SEQ ID NO: 64701 - DNA, 201 bp, Homo sapiens
ctctttaaatcatttatctcccaaccaagttgtcttgaagcagactctgtccttccacccagagtttgttacccactgaggttgtcccactgtttagtagmcaactagggaaaccctcatctctggtgcccttgtttcccccagaagactaaagctaaagctcattcattccagtgaacatctacgggtgctgttctaggt

SEQ ID NO: 64702 - DNA, 201 bp, Homo sapiens
caaggcaaattttatgtagaatataaaatgctattacagaaaaagtgtcataagactttattcaagattttcaatgtcatagtttttggtttcataatgayaaatatattttaaatgttttttaatcaagtgagtcacataataacatatcattaatgtgttatatattttgttatcacatataattacataaacaaattg

SEQ ID NO: 64703 - DNA, 201 bp, Homo sapiens
tccttcagcctagcccactgaggagcagcctctattaccaggccagggactggttgcaaaacatcccagtcctaatgcttgcagggctagtggcaattgaraagctgagaggtgcgatccttttcttattcaccacagttagcaaggaaggagcactggcgtgggtgttaaaaggactgggcgtgagattcagagctgaca

SEQ ID NO: 64704 - DNA, 201 bp, Homo sapiens
aatatcaaagaagtggcttactggttcaaacagtacatgtggttttaaggcttttaatataatttactgaataatctccagagtagctcaaaaaagtcctrccgacagtatgttattatgcctccagagtcgacttgctaacagtgaagcaaattcaaccacaaatttattagattctcacctatctcaagattatcacat

SEQ ID NO: 64705 - DNA, 201 bp, Homo sapiens
cactgttggaggatatgaaaattaccacaatcttttgggaaggcaattagcaataattaaaaatgtgtataccatttggcaagaccttctattgctaggaygtatattgtagcattatttaaaataggaaaaaaactggaaacagcatcaatttctttcagtagaggaattatcatgtaaactatggtccatttacacaat

SEQ ID NO: 64706 - DNA, 201 bp, Homo sapiens
aagttccagaatgacttgtttaatatcatgccatttttcttaaaaacaaaaaaatgggaaatatgctcgtcaagatgcgagaaaatttctgaaaagatacwgaagaatataatagtaattgtttctggagaatggaaatgggagctcagtaaagaagctggagctggaggaccttaactttccacttgatgccctcatata

SEQ ID NO: 64707 - DNA, 201 bp, Homo sapiens
gcatgcctgtaatcgcaggagactgaggcaggagaatcgctcgaactcgggaggcagaggttgcagtgagttgagatcacgccattgcactccagcctggrcaacaagagtgaaactcgcttttctttcttttcaatattaggtcggtttttttaaagtttactagatatttttaaaggtgtgtattctctgtaccttgat

SEQ ID NO: 64708 - DNA, 201 bp, Homo sapiens
aaaaatgggaaatatgctcgtcaagatgcgagaaaatttctgaaaagatactgaagaatataatagtaattgtttctggagaatggaaatgggagctcagkaaagaagctggagctggaggaccttaactttccacttgatgccctcatatactgtttacatattttacaagcttatattcattcaactgaagagttgaat

SEQ ID NO: 64709 - DNA, 201 bp, Homo sapiens
tctctgtgcctcaatttcctaatgggtaaaaagggaggggaaatccttccttataccatctgagcttgtccttcagtaatttgtattttgtatctaagtgwaggatcttgcattgtctacattgaatttaatctcattagtgtgtctcataattcctaattgtcaagactttttggtgacatcttgattctgtcacctgtc

SEQ ID NO: 64710 - DNA, 201 bp, Homo sapiens
aagatactgaagaatataatagtaattgtttctggagaatggaaatgggagctcagtaaagaagctggagctggaggaccttaactttccacttgatgccytcatatactgtttacatattttacaagcttatattcattcaactgaagagttgaattttttaaaagaagaatctatgtagttgttaaaaagaacaaaata

SEQ ID NO: 64711 - DNA, 201 bp, Homo sapiens
aacattttaaaaagtcttgttaaggatggtcttttgccctatgtggcatagaaatttcagttaaatcttaattacattcattacttttagtaaataaaaakaagaatctagaagaatagccaaggttacctgaaacagatgttcctgatttctctctccctctcttatgagtatcactaggagccagttatataagtcaag

SEQ ID NO: 64712 - DNA, 201 bp, Homo sapiens
gaggcatgtcaaagtcagagagtatgttccagtagtctgtcttacatacgtggcacgatggagatatcaacaaagctgcaatagagtgacatcagtcatgygggaaaactgacatctaacacagtctcagcccagaccatgcaagattcagacatttactgtaaacagtaatttaatgccttataaggattgagaatgata

SEQ ID NO: 64713 - DNA, 201 bp, Homo sapiens
catccctgtctgatttttctaggagaggaaaagaaaaaaaaaaaagatatagcagcattctgcctatttatatcacaactctgtgcctgtttttaccaaayaaaaggtacttttatgctttcctacatttgtattttggcttttttccccttaacaaaaggaaccatttgtgaactttccccttgtcctctgtgtgtgtga

SEQ ID NO: 64714 - DNA, 201 bp, Homo sapiens
tccttaccaaaatggctcttacagtgacaaacttgactctatctgttggggactgcatctggctgactgaaaggcaccaaggccgggcgcaatggtgcacrcctgtaatctcagcactttgggaggccaagtcaggcagatcatgaggtcaggagttcgagaccagcctggccaatatagtgaaaccccgtctctactaaa

SEQ ID NO: 64715 - DNA, 201 bp, Homo sapiens
tagattgcacatttgtaccagctactgcttgcttggcttgggcttgctttttttttttttttttttttttttttttcacatctgttttgtgacttcttcarattgaatatctttaggaattggggaaaatgagcttttagtataaattgcctataattttcatttctgtgtctaaaagagtccacaatatatcagcctgag

SEQ ID NO: 64716 - DNA, 201 bp, Homo sapiens
caatacttattatcactccaacattttactttaaatcaacaaggatacattatttagaaccactgtctctgggacattccctctctcgaagtcttaaaaawaaaaaaaagatttctgattcaaaaagtactgatgtccaaaacaaacaataagaatcttagataacccatttttgatggatatagaaacaaaaagattttg

SEQ ID NO: 64717 - DNA, 201 bp, Homo sapiens
aatctcctgacctcgtgatcccgcccaccttggcctcccaaagtgctaggattacaggtgtgagccaccgcacccggccaagaaaaaaaagtttttaaggraaaaaaaacccttccctatttcctggctctgagaggatcagcgtgtacagccctcccgtggtagaatggcggctgcacagctcccagcaggcacggtgca

SEQ ID NO: 64718 - DNA, 201 bp, Homo sapiens
tgagcagcacagacaggcctttgcgtcatgagccttagatctcatggggaggggagccacagggaacaaacagacaagagagcaccagagggtgagggacrctctgcagagagcctaaaacacagggcatgataggagccatggggattattttggatttgacaacccccgggtctgtccaatgccagtgctggagctctt

SEQ ID NO: 64719 - DNA, 201 bp, Homo sapiens
agagaagggtcagccagtgcagggccagtgggaggagcacagtgtggacggaagggctgggacagaggagccagcaggagcccacaacatggtgctcctgygaggaggtcagggcttagcctagaacagcagcaggggcacaaaaaaacacctgagaaactgtatgaagaggctgctgctggacttgggttggaggtggcc

SEQ ID NO: 64720 - DNA, 201 bp, Homo sapiens
agccttcactgagtgctcatcatgcatgaggccctgtgctaaaatctctgccttgtctcactgaattcccattacaatccagcagggtcagtgttctcatkatgcctgctttacagacgaagacctaaggccagaggctaagccatttgccacacaccacagaggcagtaagtggcctagacagggcttgatctcccatct

SEQ ID NO: 64721 - DNA, 201 bp, Homo sapiens
tcagttggcctagtttggattaggtggcagggtaggtgttgggcagaccaaaggtatcaaatgggatctttaaggattttcagcatttcaaaagctaataytataatacattttcataaaaatgatgttttaagggtaaaagaaaagaagtaagctattttcctagataaagctgcccagtctaacaagacataaaacatg

SEQ ID NO: 64722 - DNA, 201 bp, Homo sapiens
ctctctggagcatttgttctctcgggaagtaagggctctcttgactgtggttagctttttgtcttaattcactctgtcagatacacaactgtaagacactragataactgttttacaaggcacagtggtcgcatcaaaggagtccctaagcccgatgggccaggacattccaaaaagattggacatggtgggagaggtact

SEQ ID NO: 64723 - DNA, 201 bp, Homo sapiens
tgtcacactccttactgtacagcccacttcagcagctcaagggcacctcggactcaacctgtccaccctgaactcgagatctttcctcctcacatgtgctyctcctctgatgtgccccaccccagtgcaagggcagcaccttccacccatcacccaagccagagacacagttggcacaatggacttctccctgcctttact

SEQ ID NO: 64724 - DNA, 201 bp, Homo sapiens
tttggaatgtgtttatcaaattaagagacaaaaacacaaaatgctacagttcaaaactggctttttattagatctgctactttgcttcaaactttaaactmtacccagataatgcaagaaacagagaagtaccagttgcagaaaaccctctgtgttgattgccttttgggaattttaacatttgaatatacttcccagtgt

SEQ ID NO: 64725 - DNA, 201 bp, Homo sapiens
ctagtcttttttcctgtgcagtcacgagtgcattttacctaatttacacatgaaaatgctcttagaaaacgcaaagccatcaggcaccctcaaatcagtgstcctggccagccctcccagtgggacattacagatcagtgtgtgacataacgtcttccttcatgctatgttaaggaacaagaaattactctcttgtaaata

SEQ ID NO: 64726 - DNA, 201 bp, Homo sapiens
gatgataaattttatttacaataacaaaaattggaagcagcctaattgtccagtattattagttgtatctatataataaaagagtatagagccaataacayaggattatatttattgacatgtaaaatagttattggcaaagcaagccacaaaactgtatattcaatataatttcatcttattaagaaaaatacgtatgta

SEQ ID NO: 64727 - DNA, 201 bp, Homo sapiens
gctcatgggttgattggaagatggtgccaggcctgtgagttcctgtggccatttgttggaaccctgttttgccacagaacagaactggtatcctagagatkccattagtaatgaaattacaaatgaacgaattcataaaagcatacagtctcatctgtaagctataaatacctatcaaaatgaaggaatgattgttgttaa

SEQ ID NO: 64728 - DNA, 201 bp, Homo sapiens
ctaagagtgataggtgccctaagcacagaagcgctggtcgagaatgactctgcacaagggattttcagagcgcaagctgtcagtcgtgagcatcagtgttrtgattagttcccttaaccatcaccacagatatttttgccttagtgagatacaatcaacaaaatgacaattacaggtaggtaatgactttgtctcgattgc

SEQ ID NO: 64729 - DNA, 201 bp, Homo sapiens
gcagcttggcccttgggctggccctgttcagggtcacaagatggattcaggaattccaggcatcacttctagactccaccaggtccagaggaagaagaagrcggtatttaggagtgaggaagcctctctagaagccccttggcagatttctccagtctcattggccagaatttggtcacatgttcattcctgaaccagtca

SEQ ID NO: 64730 - DNA, 201 bp, Homo sapiens
ggctcaggtcctcatcttgacgtctgcccagaatccagtggttctcagctgggggctgagcccagaatcacagggaaggctgaaggcagagccagctaggrgaggtacagttcctacttcacttgttacaagtctgtgttttgaatttttacaaccaccatacattatttgttatcattttaaagtaccaatagaatgaac

SEQ ID NO: 64731 - DNA, 201 bp, Homo sapiens
tcttggctcactgcaacctccacctcccaggttcaagcgattctcctgcctcagcctcccaagtaactgggattaggtgcccaccaccacacccgactaatttttttttttttttgtatttttagtagagacagggttttgccatgctagccaggcttgtcctgaactcctgacttcaggcccacctcggcctcccaaagt

SEQ ID NO: 64732 - DNA, 201 bp, Homo sapiens
cttcagcagctcaagggcacctcggactcaacctgtccaccctgaactcgagatctttcctcctcacatgtgctcctcctctgatgtgccccaccccagtrcaagggcagcaccttccacccatcacccaagccagagacacagttggcacaatggacttctccctgcctttactccccatctccaagctgtcttcccaca

SEQ ID NO: 64733 - DNA, 201 bp, Homo sapiens
cagcctcccaagtaactgggattaggtgcccaccaccacacccgactaatttttttttttttttgtatttttagtagagacagggttttgccatgctagcyaggcttgtcctgaactcctgacttcaggcccacctcggcctcccaaagtgctgggattacaggcatgagccaccatgcctggcacatttctccattttta

SEQ ID NO: 64734 - DNA, 201 bp, Homo sapiens
aggcagaaggatgcctcgctggaggtacgagagcggtaaggttgaaagagaaccagaacattagttcagatgttggctgtggcgtgtaccagtcaagggayttaagtgacttcaccctgagcctcactttcatcttctgtaaaatgataattataccataatgtcaataatattaggttgatgcaaaagtaattgcagttt

SEQ ID NO: 64735 - DNA, 201 bp, Homo sapiens
aaggtgctgcagaatgataatgctttccccaaaatctgaaactgatttgtatcattgaagtttttttctgtattaaaaataaagcaaaattaaaaataaaytttatgtggaggaatttttatctcagatatgttagagttgaaaatattttataatggagattgcaactttcagttatgtgttatttgaaaaaaatatata

SEQ ID NO: 64736 - DNA, 201 bp, Homo sapiens
actactgcttttttattaaatggtgttcagttaaaaaaaaaaaaaaaaaagaaccaagctaatttgctgattaatcaaatttgggatgtgagaggaagaakaaaaaaaaaggaagactctgcagtttggagcctgagcagctgggagaatggagaatacggcttcctgaatgaggaaagctcggccaagagcaagtttgag

SEQ ID NO: 64737 - DNA, 201 bp, Homo sapiens
ctactgcttttttattaaatggtgttcagttaaaaaaaaaaaaaaaaaagaaccaagctaatttgctgattaatcaaatttgggatgtgagaggaagaagwaaaaaaaaggaagactctgcagtttggagcctgagcagctgggagaatggagaatacggcttcctgaatgaggaaagctcggccaagagcaagtttgagg

SEQ ID NO: 64738 - DNA, 201 bp, Homo sapiens
acatggtaaaacctcgcctctactaaatacaaaaaattagccaggcgtggtggctcatgcctgtaatcccagctaattgggaggctgaggcaggagaatcmcttgaacccaggaggcggaggctgcagtgagctgagattgcgccattgcgctccagcctgggcaacaagagcaaaactctgtctcaaaaaaacaaaaaga

SEQ ID NO: 64739 - DNA, 201 bp, Homo sapiens
tcaatgaaatatggtaagttttgaaatctaggtaagaagaacaattttgtagttgaaaataaattcttaaaattgtcctaaaaaatggcagaaaacctgaytgagtcagtaagtatagaagatattggaaagttttttaaaaactagcctccacaaaagggttccaaccctcgtggaatttgggacaaggacaatccaaca

SEQ ID NO: 64740 - DNA, 201 bp, Homo sapiens
gcataagttctgccagctgtttcctttcctgatgctcagtgcttgggatccctcagtggcccctttgttctctggggagggaagccgttgggggaaagggktgcatacgtaattgcattgtcaggttaaagtggtgtggggtgcctcctgaattccagaacacctccaatcctagtttttctacacagtctgcccctggag

SEQ ID NO: 64741 - DNA, 201 bp, Homo sapiens
  misc_feature (1)...(201): n = A,T,C or G, or insertion/deletion polymorphism (see Tables 1-2)
gacagatcacttgagctcaggagttcgagaccagtctggccaacatggtaaacccagtctctactaaaaatacaaaaaattagccaggcatggtggcacangcttgtaatcccagctactcaggaggccaaggcacaagaattgcttgaaccagggaggcacaggatgcaatgagccaagattctcgtgccactgcactcc

SEQ ID NO: 64742 - DNA, 201 bp, Homo sapiens
ttctagagaagtgagtgtgactatgacacagtcacagccccttcgcggccaccaagccagcagctgggaggtgacactcccgttcccttgcagtctgtgcyttcccgtatctcctggccttcaccaccgactccatggagatccgcctggtggtgaacgggaacctggtccacactgcagtcgtgccgcagctgcagctgg

SEQ ID NO: 64743 - DNA, 201 bp, Homo sapiens
cggatgtgacccctggcactcctctcttgtcccttcttccctgtagcacggggctctgcaggagcctggagagggtgccttctctgtaaggagggaatggrcagtggggcttggcatggagctggctgctctgttctcacccctgtctcttgtatcctcaccaaccacacaggagatctgtctgtctgactctcccatggt

SEQ ID NO: 64744 - DNA, 201 bp, Homo sapiens
ggcacaagaattgcttgaaccagggaggcacaggatgcaatgagccaagattctcgtgccactgcactccagcctgggcaacaaagcaagactctgtctcaaaaaaaaaaaaaaaaaaatcattaacataaaaagagatcttacatatcaaaaagataaagacggctgggcaccatggtcacgcctgtaatcccagcactt

SEQ ID NO: 64745 - DNA, 201 bp, Homo sapiens
cccaagaggcagaacccaagaggcataggttgcagtgagccaaaatcgcgccaccgcactccagcctgggtgatagagcaagactctgtctcaaaaaatatgtgtgtgtgtgtgtgtgtgtgtgtgtgtgtgtgtgtgtgtgtcagtatttctccctgggacataaggttgcagatgatttttaaaattttcttctttatg

SEQ ID NO: 64746 - DNA, 201 bp, Homo sapiens
ccaagaggcagaacccaagaggcataggttgcagtgagccaaaatcgcgccaccgcactccagcctgggtgatagagcaagactctgtctcaaaaaatatgtgtgtgtgtgtgtgtgtgtgtgtgtgtgtgtgtgtgtgtgtcagtatttctccctgggacataaggttgcagatgatttttaaaattttcttctttatgt

SEQ ID NO: 64747 - DNA, 201 bp, Homo sapiens
caagaggcagaacccaagaggcataggttgcagtgagccaaaatcgcgccaccgcactccagcctgggtgatagagcaagactctgtctcaaaaaatatgkgtgtgtgtgtgtgtgtgtgtgtgtgtgtgtgtgtgtgtgtcagtatttctccctgggacataaggttgcagatgatttttaaaattttcttctttatgtt

SEQ ID NO: 64748 - DNA, 201 bp, Homo sapiens
aaggtgactgtgtggggtttgaaccttggcgcccactggacagtggtgagcactcaccaccctgaggcctggcagcctgtctgtcactggagagcgttcarcactgacactgacattagcagatcacagagcttttcagcccacgtatgtatctctgtgaggcaggacaaggcctgcttgtcagtgagccattgaggtttg

SEQ ID NO: 64749 - DNA, 201 bp, Homo sapiens
aggctcactttagcctgggatggggaggctgcagtcagctgtaatcatgccactgcactccagcctgtgtgacagaacaagactctgtctccaaaaaaaawtttttttaatttaaattttaaaaatgtgatggacctctgtaataaatggggcctttgtttctccactgactttctcactctaagagggtctgaaccacgt

SEQ ID NO: 64750 - DNA, 201 bp, Homo sapiens
agctaatttgctgattaatcaaatttgggatgtgagaggaagaagaaaaaaaaaggaagactctgcagtttggagcctgagcagctgggagaatggagaayacggcttcctgaatgaggaaagctcggccaagagcaagtttgaggaaaagctcaagagtccagcctggacccatcagtgccttcctgtacccccgtggag

SEQ ID NO: 64751 - DNA, 201 bp, Homo sapiens
gccagggtctgactgcataagttctgccagctgtttcctttcctgatgctcagtgcttgggatccctcagtggcccctttgttctctggggagggaagccrttgggggaaaggggtgcatacgtaattgcattgtcaggttaaagtggtgtggggtgcctcctgaattccagaacacctccaatcctagtttttctacaca

SEQ ID NO: 64752 - DNA, 201 bp, Homo sapiens
tgatttctgtgggctttcagaacactcctcagctttgttaatagtcattaactggtgctggtggcagctggggagcacttagctgaaaagagatatccccrctcagagactgggtcagttattcatgtcactgctgccctggaggacagtccaagtctagaaaagtcagagcttgcaatctttcttcctttcccaccctct

SEQ ID NO: 64753 - DNA, 201 bp, Homo sapiens
tgaggtgggaggatcacttgagcctgggaggtcaaggctgcagtaagtcatgattgcatcattgcactccagcctgagcgacagaacaagaccttgtctcaaaaaaaaaaaaaaaaaaagtttcagtggggaggagggagttaaaggctatagagtttccaacttgcaacagcagttatttttccttcagggctgttaaca

SEQ ID NO: 64754 - DNA, 201 bp, Homo sapiens
aaggaaaacagttgccttctgcggcccacaccacaggtcgccagggtctgactgcataagttctgccagctgtttcctttcctgatgctcagtgcttgggrtccctcagtggcccctttgttctctggggagggaagccgttgggggaaaggggtgcatacgtaattgcattgtcaggttaaagtggtgtggggtgcctcc

SEQ ID NO: 64755 - DNA, 201 bp, Homo sapiens
aatcccaacactttgggaggatgagaagagaaggtcacatgagcccaagagttcaatcccagcctgggcaacacagcaagacccatctctacaaaaaaaawatatatatatatatatataggctgggtctggtggcatgagcctgtagtcccagttacttgggaggctaaggtagaaagatcaccttccttctgggaggtc

SEQ ID NO: 64756 - DNA, 201 bp, Homo sapiens
gcatttgcagaataaatgcaggtaaagaatgagccagccacttctcctgccccaaatgtctccaccatcccggacacctctgccttgccctgattctgccrtccatctcagaacagacccttttgcttacagaactgaatggaacagccttagtaattattttagccccctgtgtcctcggagccctcaggagcaaagtaa

SEQ ID NO: 64757 - DNA, 201 bp, Homo sapiens
gagattaagtgctaattcactctgtacacagctcggcagctgtacaatgtatacctctgttcctatgtaaaatgaagggcctctgtcatttattaattccytggagtgctgttgctgctgtggtcgcatctctatccactgggatatggggctgctccaacatcccattttatgttccaacactggtgaagagagcatggc

SEQ ID NO: 64758 - DNA, 201 bp, Homo sapiens
catcctgaaatacaaaaggtaacagaaaattttatgcttcataattgtacaaaattgattacagtgttaggatagaactgacaggtcatcataatccttakcctgggatgcaaagccaaatcacctatgcaactttaaaaaaatcatcatgggagaacctcacacctaaggttctgatttgatgggtctatggtagggcct

SEQ ID NO: 64759 - DNA, 201 bp, Homo sapiens
attctgcagttttcctttccttggagtcctgggaattgtggggcttcctcatggtgctcaagaagaaggaaatgtgacttacccatgctgtttaccatgcrtgaatcggcagagcccagttaattttccagcgattccggtccatagttagaaaatgaggacttgttgatgcccatactttcctcatactctacttcttcc

SEQ ID NO: 64760 - DNA, 201 bp, Homo sapiens
ttgagtgaatgaaacagaaggtagaaataggaccatttggataaatagttttgtgcactatgagaagccaaaagatgagacttaacaactgtttgtggaaktcataacttgtttttcttttttagaacatgcttaatagacgatcttttagtgatgtcttaccagagtcacccaagtcagcgcggaagaaagaggaggccc

SEQ ID NO: 64761 - DNA, 201 bp, Homo sapiens
gggctttcctccagaaggctctctccatccctcgccccggcatcccgcactgcactgtatgctccaaggatggggaccagttggagggtttgcagtgatgrcaggagggccagtggatgcaaggcctagaacaccaggcagcccggtaatgctctctcttcctttctagtcggatatatacttcacagcaactgcagctgt

SEQ ID NO: 64762 - DNA, 201 bp, Homo sapiens
cattgcagacagttgcatctataaaaaggtttgcccctttaatggtggctcttttttggttcaaccttctgcgtcagatttccagttctgttggaaccagkctccctatgcaattggtaagaaaagtctttatcataatgcttttctccttcatggatatgtctgaactattgtaagcaaatcctatgtaagcaaatcact

SEQ ID NO: 64763 - DNA, 201 bp, Homo sapiens
gtgccctcacataagtctccctgggctgtctcttggaaagaagtatgggttctgtcccaacctaagagtgataggtgccctaagcacagaagcgctggtcragaatgactctgcacaagggattttcagagcgcaagctgtcagtcgtgagcatcagtgttgtgattagttcccttaaccatcaccacagatatttttgcc

SEQ ID NO: 64764 - DNA, 201 bp, Homo sapiens
aagaacaaaatagatctatatgtattgacatagaaatattcccgggctgggcatggtggctcacgcctgtaatcccagcactttgggaggccgaggtgggyggatcacgaggtcaggagatcgagaccatcctggctaacatggtgaaaccccgtctcaactaaaaatagaaaaaattagccaggcgtggtagtgggtgcc

SEQ ID NO: 64765 - DNA, 201 bp, Homo sapiens
ccccggaactgtggaagagttccaggtggaggggtcagtttgggagtgtcctctctcttcctgtatagaaaaccactgttagtgatgagtgtgcatctcargtgtgttggggacagaaaaatgttcggatgcacagccttagaacttggattttcggatttttaatactctcagatccagctatcctgaatcctggcaatc

SEQ ID NO: 64766 - DNA, 201 bp, Homo sapiens
attctcttccaacatttgattttgtgtttattatgaaatacttcaggtatacaaaaaaaagtatagggaataacataatgaagacctacaaaaccactacyggccgggcatggtggctcacacctgtaatcccagcactttgggaggctgaggcaggtggattgcctgaggtcaggagttcaagaccagtctggccaacat

SEQ ID NO: 64767 - DNA, 201 bp, Homo sapiens
gtccacaatatatcagcctgagattatgttaagctttgaattacaacgaactcttcttcgctgactgggatttggacggttgctcatgggttgattggaaratggtgccaggcctgtgagttcctgtggccatttgttggaaccctgttttgccacagaacagaactggtatcctagagatgccattagtaatgaaattac

SEQ ID NO: 64768 - DNA, 201 bp, Homo sapiens
ggttatacataataagcaaaaggcaacaaatcagcattttcagaataaattctagtcgagttactcatttccctggaggctccaagtaaacatgtttggakacaggcccacggtgactcatggcatctggagacttggacttgttccttgtgacataaaaatagaggatggaagtaagtgtttaaaagttaacagtttcca

SEQ ID NO: 64769 - DNA, 201 bp, Homo sapiens
cacaactttgtcctggagaacagagacatgaaagacacctttgctgaggctccctctgctttccagctgggctgcctctcttcccagctggaccaccagcrttgttacctcccatactccaacctataccagggtccatgggtgatgtctccctcgacacattagaggcagcagacactgcaaaccatgtgcaacagatga

SEQ ID NO: 64770 - DNA, 201 bp, Homo sapiens
aagaacacacctacatgtgcacatgcaggctctactacagccccaggtgggacacatcaggccctgatgcctgattgagagtaaaagtgaagatgtaagayttcaacttgggcctgagaatctccacaaactgaggcttatccagtgctttggagggaagctaagaattctgttgaaaatgtccacaattctggtgtgact

SEQ ID NO: 64771 - DNA, 201 bp, Homo sapiens
aaggactgggcgtgagattcagagctgacacttacaggccacgtgaccttaactggggatccaattcctccacctgtgattcaggaacaattaaactgcacccccccataaatatatatatatacacctactgatgtacccataaaaattaaaaataaaaaaattaataaaaaccacaaggtgttgaggaagatcaaagta

SEQ ID NO: 64772 - DNA, 201 bp, Homo sapiens
gtggctgtggtttgttatattgggttatgtttttttaactctgtgaatgtgccatgtttgagagtctttctcagtgatgttatttatgctcactacaggtrgaaaggaaacgccacattggaaacgatatcgtcaccattgtgttccaagaaggagaggaatcttctcctgcctttaagccttccatgatccgctcccact

SEQ ID NO: 64773 - DNA, 201 bp, Homo sapiens
tatagatatgtcatgcggaaacctgactagctctgtttacagctcttgccaaacagatgttattttttctttaagattttgtatcttatgtgggtcaatargcattttcacgtgaaaacaatatcaaccttttagtgcatcatgtatgttttactaatttgctgaatcagcaacacaggaatctgacttttttatagaatt

SEQ ID NO: 64774 - DNA, 201 bp, Homo sapiens
gttaccgtagtgacattttgtgagaatcccaaagccaccactgtgagaatgacataatggcctaaaactgtggcatcttcccatccttcagtacaacctayacgtcctccctccgacgcttactgggcacatttaccgaacacctgctgtgtgccggggccccacgccaggtgccttctgaagcatgataggagatgtggg

SEQ ID NO: 64775 - DNA, 201 bp, Homo sapiens
aaatccaaaccaaaattaccaggttcctttctgaaatttttatcttaaggatccaaaatttaatggaaatgtcagatgtaaggagtattgtgatttgccargaaattctttcttccaaatttgaaggaagtcgccttcaacaggatggtgggtgtagctgtttacacccaccattgctttggtttatgatttaaactagtt

SEQ ID NO: 64776 - DNA, 201 bp, Homo sapiens
ttgcaaaaccagtctttctggagtctccacctgaagcagaagaggtcctcagcaggggtatggtagcatggtgccagtctcagagcaatcctataaaaccttttaaaagcattggccagtgatcaggtggtagtaggccccatctctgcttgtacatctcagtttcacttgaaacttttcagagaagattatgccatgata

SEQ ID NO: 64777 - DNA, 201 bp, Homo sapiens; identical to SEQ ID NO: 41305

SEQ ID NO: 64778 - DNA, 201 bp, Homo sapiens
gcaatttagttaatatttctctttatttatgtttttgtctaaaaaggagatttcctattcctttgggaaaaaatactgaaaatgtataggcaaactactaytgctacaaacacgggacatattagggtagagtgtgtttatatttatcttaagtccaaaaggaaattttaattttgctttcttgaggtatgtacaatatga

SEQ ID NO: 64779 - DNA, 201 bp, Homo sapiens
ttttttttttcctcaggctgcccaggttttactgaaaataaaaatgagtaggaatttgatcttattagtttgttttttgtttggaaacatcacaaaaatarcatcactgtttccagaaggagcttgaaagctagacaaacacattgaggactagaagaaattctaggccttgcataacaggttctagagatgcattaaact

SEQ ID NO: 64780 - DNA, 201 bp, Homo sapiens
taaggaaaaaaaaacccttccctatttcctggctctgagaggatcagcgtgtacagccctcccgtggtagaatggcggctgcacagctcccagcaggcacrgtgcagtgcacagctcccagcagtgcttagtcagatgcactcactcatctttcaaggagggtactgtctgtctggggagatgagccctaagaaaatgaaa

SEQ ID NO: 64781 - DNA, 201 bp, Homo sapiens
ccactggtcctcactgtcactccctgctgagctcctgcaacttttggttgaggcatttgccccattataccttgttttatgtacttatgtgcttttctggktttttttcttaaggggtcaacctcaccttattcttttctgtatcctagtggcactgaatacagtgctagataatgacagatgggagagagctggggattc

SEQ ID NO: 64782 - DNA, 201 bp, Homo sapiens
cagctattgatgtgtacgaagatggagaagctggtttgctgttgtgttacaactgtaagttaaggatgtgcttttatctttatttgcttaaatggactgctttttttttttctgggcaatttaaaaagattgtccttagatttacccagtgtatcattcctgggtttgtaattgccttccaggaaggaactgaaaaatacc

SEQ ID NO: 64783 - DNA, 201 bp, Homo sapiens
cgccaaaggccaaatcaaaaccccggaagcggttagaagaaagccaaggaggccccaagccaggggcagtgaggtcatctagcagtgacaggtaaagagarggagaggcccctgcttggggtggtggacctatgagtcacagcactgcccaggaggccccttctggggattgataatgccactagtggcccctggcagcta

SEQ ID NO: 64784 - DNA, 201 bp, Homo sapiens
caagccaggggcagtgaggtcatctagcagtgacaggtaaagagagggagaggcccctgcttggggtggtggacctatgagtcacagcactgcccaggagrccccttctggggattgataatgccactagtggcccctggcagctacagcagagggccagcagcctgttcctctctgagggtccccagaccctcaggcctg

SEQ ID NO: 64785 - DNA, 201 bp, Homo sapiens
cttggtggtgtgttgcttgtaggatgctgctaagaattttatgttcgtcatatacagagtctcatttaaaaagacctatgagaaaaaatttttctcaggascaaaaagtgccatgcttctcctgagaagctggtttgttgttaaccttataagcagtgggaatcctgtaaatgaaagggcttttcctctttgcattggctc

SEQ ID NO: 64786 - DNA, 201 bp, Homo sapiens
tattaaatttatgatttgattccgctataaatccatactcatttttgccttgacctatcagagagaaatgtactaaaatttcccattacaattataatttyataaactcttctttctagttataatagtttttgttttatagtgatatgttgttactcattacataaatgtttatagttatattttggagatgggtggttc

SEQ ID NO: 64787 - DNA, 201 bp, Homo sapiens
ttttttcccccaaacaaagctcctataaccaacttttaaaattattttcaaaatgtcagtgtgagcaaaccaaagcttggctttcacagcaagtcaaaatkaaataattactgttatgcctggatgtaacttttaaaactttatttgacaggacttgctggttcttgaagaacaagaggtgagtaattctatggagatatt

SEQ ID NO: 64788 - DNA, 201 bp, Homo sapiens
tctcacttgattctcacaatgaatgcccgcagcaggctcggttattatccccagtttagagatgaggcaactgaggcctagagaggtgaactcgtcaaggycttgtggctactaagcagcagggccagggtttgcatcgggtgctctcttgactccagcacccacaattttaaccactgtcgctattctacattttgctgt

SEQ ID NO: 64789 - DNA, 201 bp, Homo sapiens
gtctcacggaacccttccttgggagttccatttctcatggctttgctcatcttccggcttcaggctctgacttcatctcaggatgggatcggtgtgtgtctgttttcatagatccactacatcagaagtatctttacatctctgtatctttacatcccaaggtcaaggccctggcaacctcagaggttcccatagcttcag

SEQ ID NO: 64790 - DNA, 201 bp, Homo sapiens
tgaagcacaggcgctttctccgatggtagtagagccttgagttcttgccagccactaattgttctttaggctttcctgtgaaggaggctgaacttgagagytggcttttggtcttgccatctgtgaactgccacttgtccacatgtggtgtgtattaagattgtttttgctgggagcatcagtattggaatgtgttccaat

SEQ ID NO: 64791 - DNA, 201 bp, Homo sapiens
tgcattggaccctaggggcctcctgggcttcaaggacggacagttgttttcctctggttactgatgaaggcatacatcagttgggtccattgctcattcaygttctgtctgttttttgcatcttctccaggaaagaaagaaatctcgttttgggaatgctttccacctgtgtcgggaagttctgcgtttgactaagctggt

SEQ ID NO: 64792 - DNA, 201 bp, Homo sapiens
gcccggcagtttgaaggtgagtggttttctctgtgtccaacttctcctgttattgcttcaaaagtacctgcccctgtttgagtctgttccctgctcttgtrtgagcactcttcctactggattgcctttaggtccagttctgaaatgagtctgacctagtattctatttcttgggcttccttctggggccttgagaggcag

SEQ ID NO: 64793 - DNA, 201 bp, Homo sapiens
cctacattcctctgtatgtatattatacatatatgccccacctctgcccaggtttctattgttgtttaaatgcattgctaacttgtattcttaacttctgyttgggatcgtagggccctgtagggaagggtcctggctgtggcttctgggctgccggttggcgagtctggctctttttcatgcgtggcattacccctttat

SEQ ID NO: 64794 - DNA, 201 bp, Homo sapiens
cttttcttttcccttttagacagggaaaagaagcaccatgttgcttaggctggcctcaagctcctgagctcaagcgatcctccttagcctcctgagtagcygggactacagatgtgtgccacagtgcctggctggatcctggcttgattgtgctttttggacttttaggtccctgggctgccgacgcccatagagaatatg

SEQ ID NO: 64795 - DNA, 201 bp, Homo sapiens
tgacaacatcctagatgttgagccactggaggccattcagctagagctggaccctgaggaggacgcccctgtgttggactggttctatgaccaccagccgytgagggacagcaggaagtgagtgatagatggagatactacacctgggaggagttctggaaatgcagaaggagtcctgggagatcagtaggtggtatgggt

SEQ ID NO: 64796 - DNA, 201 bp, Homo sapiens
caccaagttgctcatcttggcattggagcggctcaaggaagcttataggtgagtagtagggtagataggttcctgctgggaaggtgacagcagggaatggygtcatcctcagagtccaaagaaagaaggtgtagccccagtctttcctggttttacttcctcctagttttcccattcacccttcccattgcttttgtcagt

SEQ ID NO: 64797 - DNA, 201 bp, Homo sapiens
ctgagcgatgctgacactccctgcctgtttttagggccatctctgctgccaacctgcacctaaggaccaatcacatctatgtttcatctgacgacatcaargagactggctacacctacatccttcccaagaatgtgcttaagaagttcatctgcatatctgaccttcgggcccaagtgagtaagtggactcagctaggcc

SEQ ID NO: 64798 - DNA, 201 bp, Homo sapiens
aagagggtggggatggaaaggccggctgcactacctaaggtgctgggctgagcgatgctgacactccctgcctgtttttagggccatctctgctgccaacytgcacctaaggaccaatcacatctatgtttcatctgacgacatcaaggagactggctacacctacatccttcccaagaatgtgcttaagaagttcatctg

SEQ ID NO: 64799 - DNA, 201 bp, Homo sapiens
aagggaattggcaaggggtgcttcttcctgctggtgcctgcttctccctcacactcactgacaggagcttaccctagggcaagaggtgaagaggattaggsggagggtgtgcaggcctttaaactgaggtgcctttccagctcgaaaatggcagcaattgcaggccaagcgctatgcagaaaagcggaagtttgggtttgt

SEQ ID NO: 64800 - DNA, 201 bp, Homo sapiens; identical to SEQ ID NO: 41346

SEQ ID NO: 64801 - DNA, 201 bp, Homo sapiens
gccctaggcagccaggacactttcgttttcctgttcttctagccctgcaactttaggaattgtcctgtctgcctttgtttcaaacttggagccagtgctaygcttggagcctgtcaacacccttagtcagatctgctgattctctggggtcctgctgacctggaacaagttggtggagtgggtgggatggttttgggattt

SEQ ID NO: 64802 - DNA, 201 bp, Homo sapiens
acccgggaggcggagcttgcagtgaaccgagattgcgccactgcactccagcctgggcgacagagtgagactccatctcaaagaaaaataataataataawaaataaataaataatccgtgtattttccattagctccatactttaacgtagtcatacttttttactttacctaagtgagaggaagtggcccattcctcct

SEQ ID NO: 64803 - DNA, 201 bp, Homo sapiens
tgtgaataagtggaatacagctctcattggccttatgacatactttcgggaggctgtggtgaacacccaagagctcttggacttactggtgaagtgtgagmacaaaatccagacacgtatcaagattggactcaactccaagatgccaagtcggttccccccggttgtgttctacacccctaaggagttgggtggactcgg

SEQ ID NO: 64804 - DNA, 201 bp, Homo sapiens
catggctcacattcttaagaattgtagttctttctttctaggacatgaaccatacgaattcatatgggatcatcagaggcctgcagtttgcctcattcatmgtgcagtattatggcctggtgatggatttgcttgtattgggattgcaccgggccagtgagatggctgggccccctcagatgccaaatgactttctcagtt

SEQ ID NO: 64805 - DNA, 201 bp, Homo sapiens
aggtcaggggtttgagaccagcctgaccaatatggtgaaaccctgtctctactaaaaatacaaaaaattagccaggcatggtggcatgcgcccgtagttgyagctactagggaggttgagacaggagaattgcttgaacccgggaggtgaggtggagcttgcagtgagccaagattgcatcactgcactccagcctgggca

SEQ ID NO: 64806 - DNA, 201 bp, Homo sapiens
gaggtcaggagtttgagatcaggctggccaacatgacgagaccccatctctactaaaaatacaacaaaattagccgagtgtgctgggatgcacctgtagtyccagctactcgggaggctgaggcaccagaatcactggaacccaggaggcagaggttgcagtgagccgagatggcaccattgcactccagcctgggcgaca

SEQ ID NO: 64807 - DNA, 201 bp, Homo sapiens
agccccagatggttctcttcaacctctatgacgactggctcaagactatttcatcttacacggtatgaacctcgggaagagaagatcgctggaggaggagygggtttagggttaggagaagatcctgtgtcaggtttttgccattttcacatttttagcctatagattgggtgggaactctgttgactttcatgagagttt

SEQ ID NO: 64808 - DNA, 201 bp, Homo sapiens
tgttttgtgactttatctccacttttcacttatttggctacatggtttttttcttattgtttgctctaaggtttacagtatatacatagctcacttactgkgatctactttgaccattagtctactacggatcacttcacatatagtacaagaaccttagaataatacactttaagttccactcccactcttagtagtatt

SEQ ID NO: 64809 - DNA, 201 bp, Homo sapiens
gatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttca

SEQ ID NO: 64810 - DNA, 201 bp, Homo sapiens
ttcatggatgagtaattatacaaggatagccaaaacaacgaggtgggttttggccccatgagatagcaaaagctgtggcagctgagagaaggtagtaattrtagtattggcctgatagtatttggaagagaacagatatggtcagaaacaaattcctgaccaggtgtgcgtgctggctcatgcctgtaatcccaacactcg

SEQ ID NO: 64811 - DNA, 201 bp, Homo sapiens; identical to SEQ ID NO: 41360

SEQ ID NO: 64812 - DNA, 201 bp, Homo sapiens
aagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttt

SEQ ID NO: 64813 - DNA, 201 bp, Homo sapiens
ttcccattcacccttcccattgcttttgtcagtgtgaagtctcggttgaaccagtctcagagggaggagctaggtctgatcgagcaggcctacgataaccyccacgaggcgctgtcccgcatcaagcgtcacctcctcacacagagagccttcaaagaggtgagtgaggcctcccaagttttctttttggttctaccaaag

SEQ ID NO: 64814 - DNA, 201 bp, Homo sapiens
cccttcccattgcttttgtcagtgtgaagtctcggttgaaccagtctcagagggaggagctaggtctgatcgagcaggcctacgataacccccacgaggcrctgtcccgcatcaagcgtcacctcctcacacagagagccttcaaagaggtgagtgaggcctcccaagttttctttttggttctaccaaaggtagcagttg

SEQ ID NO: 64815 - DNA, 201 bp, Homo sapiens
ggataaatagtggagagccatatcatggagggcatcgcacaccttaggaagaatcatataagggtcttaagcacagagtgactttgtcagatgtgtttttyttcttttttttttttggcttcccacactacagatgcagactttgtcaaatttctgtgttagatgattcactcttgcagctgtgagaaagatggacctgaa

SEQ ID NO: 64816 - DNA, 201 bp, Homo sapiens
gcagacacagaaccacctccgctgcttgtttacaagtggtgtcaaggtagaactttcatgagatcgccctgtgaggaacggggcaggaatttagttctacrtcaaaaatctcatctgggtagcatgattggtttactctcttgatgcgtggtagtaaagggaagtagtgttcgtgttaaactgaggaaaagcccatagtca

SEQ ID NO: 64817 - DNA, 201 bp, Homo sapiens
ccatgcctggctgatttttctttgtattttggatacagacagtttcgccatgttgcccaggctggtcttgaattcctgagctcaggtaatccacccccctsggctcccaaagtgctgggattgtaggtgtgagccaccacgcctggccttgttgcattgatttcttctcttatcattgccatccctttgctagtttgttaa

SEQ ID NO: 64818 - DNA, 201 bp, Homo sapiens
ctgcgggaggcgtggtcgggtcgggccgagtgaccgaaggggttaggccgggcggggctggatgcactgtgtggcgggactgcaggccggggtccccggaygcctttctgctgcgcttcttgtgggcccgggcctgtggttagtgaatttttctatcccgccgctccccagattctccggatatggccggagtgtttcctt

SEQ ID NO: 64819 - DNA, 201 bp, Homo sapiens
agggatgaagactggaatgaattcaatgatattaacaagattatcatccggcagcctatccgcactgagtacaagattgcttttccttacttgtacaacamtcttccacaccatgtccacctcacctggtaagagacctggaacacaacatttggaaaggagaaggctgctgtttaggttgggccagggcgggaaaacttt

SEQ ID NO: 64820 - DNA, 201 bp, Homo sapiens
aaggagcccagtagcagttgagtgtacaagagaaaagtgtggaattggctggacacagtggctcacgcccgtaatcccagcactttgggaggccaaggtgkgtgaatcaccaagtcaggagttcgagaccagcctggccaacatggtgaaaccccgtctctactaaaaatacaaaaattagccaggcgcggtggcgggtgc

SEQ ID NO: 64821 - DNA, 201 bp, Homo sapiens
aaaaaaaaaaagtctgcttattcttgatgttgtaccctagggatgaagactggaatgaattcaatgatattaacaagattatcatccggcagcctatccgsactgagtacaagattgcttttccttacttgtacaacaatcttccacaccatgtccacctcacctggtaagagacctggaacacaacatttggaaaggaga

SEQ ID NO: 64822 - DNA, 201 bp, Homo sapiens
tgttgaactcaaatctttctttagtagtagggataaaactaactgcatcaagtagtctccaccctccccgcccctggctcatctgtaatttactttttttyctactacctttagattgtgaataagtggaatacagctctcattggccttatgacatactttcgggaggctgtggtgaacacccaagagctcttggactta

SEQ ID NO: 64823 - DNA, 201 bp, Homo sapiens
aatacaaaaaattagctgggcgtggtggtccacgcctgtagtcccagctactcagaaggttgaggtgggagaattacttgaacccgggaggcggagcttgyagtgaaccgagattgcgccactgcactccagcctgggcgacagagtgagactccatctcaaagaaaaataataataataataaataaataaataatccgt

SEQ ID NO: 64824 - DNA, 201 bp, Homo sapiens
tctttttctaatgtgccagtgccctaaagtacatgccccacgcagtcctcaaactcctggagaacatgcctatgccttgggagcagattcgggatgtgccygtgctgtaccacatcactggagccatttccttcgtcaatgagattccctgggtcattgaacctgtctacatctcccagtgggggtgagaaaggctgaaat

SEQ ID NO: 64825 - DNA, 201 bp, Homo sapiens
tttaacgtagtcatacttttttactttacctaagtgagaggaagtggcccattcctcctatgggtcactgattctcttctccagcctgtatgtacacatgrgcagagtgttgtcagcctggcgaacagtctttcttcctctgtagagttggcagcttgtcttgtttctggggctgtcattctcgtcttaacttttcttgac

SEQ ID NO: 64826 - DNA, 201 bp, Homo sapiens
tcttctccaaccagattatctggtttgtggatgacaccaacgtctacagagtgactattcacaaggtgagtgttagcagcagtgtataggtgcgggactcygtacatggctgtgggagagtaatgggctaagtgtgtacacatgctgggaagaaggcaggatggggatgtgttgtgtaggccatgctaacgaatgccgtcc

SEQ ID NO: 64827 - DNA, 201 bp, Homo sapiens
ttctacgtcaaaaatctcatctgggtagcatgattggtttactctcttgatgcgtggtagtaaagggaagtagtgttcgtgttaaactgaggaaaagcccrtagtcaaagcaatccaaatgaatacgtggaatcatagtgggattggttatggaaggtaatgatagttcctgtggggctagtcttgcaagaggatttctaa

SEQ ID NO: 64828 - DNA, 201 bp, Homo sapiens
gactaatgatgttgaactcaaatctttctttagtagtagggataaaactaactgcatcaagtagtctccaccctccccgcccctggctcatctgtaatttrcttttttttctactacctttagattgtgaataagtggaatacagctctcattggccttatgacatactttcgggaggctgtggtgaacacccaagagctc

SEQ ID NO: 64829 - DNA, 201 bp, Homo sapiens
agtgtttcctgcgtgtggacgatgagtcaatgcagcgcttccacaaccgcgtgcgtcagattctcatggcctctgggtccaccaccttcaccaaggtacarggccgtcatgcccagcttccctcttgtcctctgctgtcctctgctcatttcacacccctttcacttcgtcccctgctggctgcttccttctcttctttgc

SEQ ID NO: 64830 - DNA, 201 bp, Homo sapiens
atctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcac

SEQ ID NO: 64831 - DNA, 201 bp, Homo sapiens
ctacgtcaaaaatctcatctgggtagcatgattggtttactctcttgatgcgtggtagtaaagggaagtagtgttcgtgttaaactgaggaaaagcccatrgtcaaagcaatccaaatgaatacgtggaatcatagtgggattggttatggaaggtaatgatagttcctgtggggctagtcttgcaagaggatttctaacc

SEQ ID NO: 64832 - DNA, 201 bp, Homo sapiens
ctgcagaatgaggtacagcctgggcggggctgggagtgacatgaacgcgcctgcacttcctgggtcagtcaccggagtcttgttgggtggaaagacttgartggtgggcacagttggctcttgcttctgtgggagttcctcggacatgttaaccttgactttgtggtttaggttactaaggagcgcacagctcagtgtttc

SEQ ID NO: 64833 - DNA, 201 bp, Homo sapiens
tctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacg

SEQ ID NO: 64834 - DNA, 201 bp, Homo sapiens
ctcgggagtggaaaaaagtagaatttgctgaggggagaacaaaagaggttaactctggagaatcctggggcatggctcacattcttaagaattgtagttckttctttctaggacatgaaccatacgaattcatatgggatcatcagaggcctgcagtttgcctcattcatcgtgcagtattatggcctggtgatggatttg

SEQ ID NO: 64835 - DNA, 201 bp, Homo sapiens
gttgcagctactagggaggttgagacaggagaattgcttgaacccgggaggtgaggtggagcttgcagtgagccaagattgcatcactgcactccagcctsggcaacagagcaagaccccgtctaaaaaaacaaaaccaaaaaaaacgtggctgtagtcccagctactcaggaggatgaggttgcttgaacgcaagcagtg

SEQ ID NO: 64836 - DNA, 201 bp, Homo sapiens
catgtattttcaggccaggcgcagtggctcacacctgtaatcccagcactttgggaggccgcggtgggcagattgtctgagctcaggagtttgagaccagkctgggcaacatggtgaaaccctgtctctaccaaaatacaaaaaattagctgggcgtggtggtccacgcctgtagtcccagctactcagaaggttgaggtg

SEQ ID NO: 64837 - DNA, 201 bp, Homo sapiens
gattgcgccagtgcactctcagcctgggtgactgagcacaactccgcctcgggagtggaaaaaagtagaatttgctgaggggagaacaaaagaggttaacyctggagaatcctggggcatggctcacattcttaagaattgtagttctttctttctaggacatgaaccatacgaattcatatgggatcatcagaggcctgc

SEQ ID NO: 64838 - DNA, 201 bp, Homo sapiens
gtggtggtgggcgcctgtaatcccagctacttgggaggctgaggcaggagaatcacttgaacccgggaagtggaggttgcagtgagctgagattgcgccastgcactctcagcctgggtgactgagcacaactccgcctcgggagtggaaaaaagtagaatttgctgaggggagaacaaaagaggttaactctggagaatc

SEQ ID NO: 64839 - DNA, 201 bp, Homo sapiens
ttcgagaccagtctggccaacatggtgaaaccccgtctctacttaaaaaaatacaaaaattagttgggtgtggtggtgggcgcctgtaatcccagctactygggaggctgaggcaggagaatcacttgaacccgggaagtggaggttgcagtgagctgagattgcgccagtgcactctcagcctgggtgactgagcacaac

SEQ ID NO: 64840 - DNA, 201 bp, Homo sapiens
catctgggtagcatgattggtttactctcttgatgcgtggtagtaaagggaagtagtgttcgtgttaaactgaggaaaagcccatagtcaaagcaatccaratgaatacgtggaatcatagtgggattggttatggaaggtaatgatagttcctgtggggctagtcttgcaagaggatttctaacctgctggagacctgcc

SEQ ID NO: 64841 - DNA, 201 bp, Homo sapiens
cagcccaagcagatcattgtcaccaggaagggcatgctggacccactggaggtaagagggtggggtggggtaggagaaaagagaccttgagaccttcaggstgtttctcatcttggacttgatcttgtcttaggtgcacttactggacttccccaatattgtcatcaaaggatcggagctccaactccctttccaggcgtg

SEQ ID NO: 64842 - DNA, 201 bp, Homo sapiens
tcatcaaaggatcggagctccaactccctttccaggcgtgtctcaaggtggaaaaattcggggatctcatccttaaagccactgagccccagatggttctyttcaacctctatgacgactggctcaagactatttcatcttacacggtatgaacctcgggaagagaagatcgctggaggaggagcgggtttagggttagga

SEQ ID NO: 64843 - DNA, 201 bp, Homo sapiens
tgaggccatcgccctttgcacttggggcctggctggcttggaggtggcgcaggctgcatgaggcaggagccctgttaacattggctgtttccttctccccraaggtgttcggcatgaccccaacatgaaatatgagctacagctggcgaaccccaaagagttctaccacgaggtgcacaggccctctcacttcctcaactt

SEQ ID NO: 64844 - DNA, 201 bp, Homo sapiens
cttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccgaaggtgttc

SEQ ID NO: 64845 - DNA, 201 bp, Homo sapiens; identical to SEQ ID NO: 41341

SEQ ID NO: 64846 - DNA, 201 bp, Homo sapiens
tcgaaaatggcagcaattgcaggccaagcgctatgcagaaaagcggaagtttgggtttgtggatgcccagaaggaagacatgcccccagaacatgtcaggragatcattcgagaccatggagacatgaccaacaggaagttccgccatgacaaaagggtttacttggggtaaggaacatcctgaaataatttcatttggaa

SEQ ID NO: 64847 - DNA, 201 bp, Homo sapiens
gaggcaggagaatcacttgaacccgggaagtggaggttgcagtgagctgagattgcgccagtgcactctcagcctgggtgactgagcacaactccgcctcrggagtggaaaaaagtagaatttgctgaggggagaacaaaagaggttaactctggagaatcctggggcatggctcacattcttaagaattgtagttctttc

SEQ ID NO: 64848 - DNA, 201 bp, Homo sapiens
acaactaccgtacagacatgatccaggccctgggcggtgtggaaggcattctggaacacacactctttaagggcacttacttccctacctgggaggggctyttctggtgaggattctcctctcttagagggacctgtcacaaccctttgagctcatctcttgtatgcctctgtgatttcctgtggtgtttcccagacagcc

SEQ ID NO: 64849 - DNA, 201 bp, Homo sapiens
ccatggagacatgaccaacaggaagttccgccatgacaaaagggtttacttggggtaaggaacatcctgaaataatttcatttggaatttggcccttttcycttctccctgtcccacagtcttggattgatgctttgacagctcatcttggtggatataagagaaaggagaaaaccagtaggagtctctgataatttctac

SEQ ID NO: 64850 - DNA, 201 bp, Homo sapiens
cttgtttacaagtggtgtcaaggtagaactttcatgagatcgccctgtgaggaacggggcaggaatttagttctacgtcaaaaatctcatctgggtagcaygattggtttactctcttgatgcgtggtagtaaagggaagtagtgttcgtgttaaactgaggaaaagcccatagtcaaagcaatccaaatgaatacgtgga

SEQ ID NO: 64851 - DNA, 201 bp, Homo sapiens
agataactgatgcttacctggaccagtacctgtggtatgaagccgacaagcgccgcctgttcccaccctggattaagcctgcagacacagaaccacctccrctgcttgtttacaagtggtgtcaaggtagaactttcatgagatcgccctgtgaggaacggggcaggaatttagttctacgtcaaaaatctcatctgggta

SEQ ID NO: 64852 - DNA, 201 bp, Homo sapiens
cattgctaacttgtattcttaacttctgcttgggatcgtagggccctgtagggaagggtcctggctgtggcttctgggctgccggttggcgagtctggctstttttcatgcgtggcattacccctttattagagcgatggcttggcaacctcctggcccggcagtttgaaggtgagtggttttctctgtgtccaacttctc

SEQ ID NO: 64853 - DNA, 201 bp, Homo sapiens
cccaccccatccgtctcttctgcagatacattgatcgcatccatatttttttcaggtgagggctttcctggattcctagccttgcagggtactgaggcatrtgctttgcctctgaaatcagctattgtacctgagttgacttaactgctgttggggctttaaaatggaatgaagcggccgggtgcggtagctcacgcctgt

SEQ ID NO: 64854 - DNA, 201 bp, Homo sapiens
ttccagcttgggtgataagagtgagaccctgtctcaaaaaaaaaaaagtctgcttattcttgatgttgtaccctagggatgaagactggaatgaattcaaygatattaacaagattatcatccggcagcctatccgcactgagtacaagattgcttttccttacttgtacaacaatcttccacaccatgtccacctcacct

SEQ ID NO: 64855 - DNA, 201 bp, Homo sapiens
acacccaagagctcttggacttactggtgaagtgtgagaacaaaatccagacacgtatcaagattggactcaactccaagatgccaagtcggttccccccrgttgtgttctacacccctaaggagttgggtggactcggcatgctctcaatgggccatgtgctcatcccccaatccgacctcaggtacagcctggttcaac

SEQ ID NO: 64856 - DNA, 201 bp, Homo sapiens
tagccccgctaccggactacatgtcggaggagaagctgcaggagaaaggtgaggcgagagtgtggagcggcgcgcgggccggaggcggggcgggtgtgcgygcgcgcaggcgggtggggaccctccccgtttgggcagctcctgaggtgtcagctcccttgttatttccagttagtttttcatcaagtcattttaagcgcg

SEQ ID NO: 64857 - DNA, 201 bp, Homo sapiens
gtccgtgtgggcgggacagaagcgtttggggcaggtgagcaggtttaaagatgaagaggctgtagaaccatgttgcctcttattcttggggtggacttggyaatatttactggtttattagatgaaaggctgagaacatctcatttgaacttatccccaaaataccttgggaagtattctgtgggaggtccaagagtgtat

SEQ ID NO: 64858 - DNA, 201 bp, Homo sapiens
gcagctgttcctcaagataatccacacgtccgtgtgggcgggacagaagcgtttggggcaggtgagcaggtttaaagatgaagaggctgtagaaccatgtkgcctcttattcttggggtggacttggtaatatttactggtttattagatgaaaggctgagaacatctcatttgaacttatccccaaaataccttgggaag

SEQ ID NO: 64859 - DNA, 201 bp, Homo sapiens
ggaagcgtagggtttatggatgctaaacagtgggaaggtgcacacgcagtgtgctgtcccgcttggatctgacgaatcttggaagtgttagtgcacctccrtttcacacttcctgtagaagcagctcttgtggattgtctggggcgtgagtataggctgtcctgtcctaccaagttacaccctttccattgaggcagaagt

SEQ ID NO: 64860 - DNA, 201 bp, Homo sapiens
tctcagtttccaggacatagccactgaggctgcccaccccatccgtctcttctgcagatacattgatcgcatccatatttttttcaggtgagggctttccyggattcctagccttgcagggtactgaggcatgtgctttgcctctgaaatcagctattgtacctgagttgacttaactgctgttggggctttaaaatggaa

SEQ ID NO: 64861 - DNA, 201 bp, Homo sapiens
ggactggttctatgaccaccagccgttgagggacagcaggaagtgagtgatagatggagatactacacctgggaggagttctggaaatgcagaaggagtcytgggagatcagtaggtggtatgggtttgtctagctgcttacttgaggtgggcctttcattttttacctaggtatgtaaatggctccacttaccagcgctg

SEQ ID NO: 64862 - DNA, 201 bp, Homo sapiens
acctcacctggtaagagacctggaacacaacatttggaaaggagaaggctgctgtttaggttgggccagggcgggaaaactttggctgactcttcctttcrttttaggtaccatactcccaatgttgtattcatcaaaactgaggatcctgacttgccagctttctactttgaccctttgatcaacccaatctcccatagg

SEQ ID NO: 64863 - DNA, 201 bp, Homo sapiens
ttacttgtacaacaatcttccacaccatgtccacctcacctggtaagagacctggaacacaacatttggaaaggagaaggctgctgtttaggttgggccarggcgggaaaactttggctgactcttcctttcattttaggtaccatactcccaatgttgtattcatcaaaactgaggatcctgacttgccagctttctact

SEQ ID NO: 64864 - DNA, 201 bp, Homo sapiens
gctggtggtggatagtcacgtgcagtatcggctgggcaatgtggatgccttccaggtaaggttaggtattcccaacccctgcctgggtgaggacgctggargaagcctgtgctgaccgtggagctggtttaagctccaggtctgatggggcaattgtattgcagctggcagatggattgcagtatatatttgcccatgttg

SEQ ID NO: 64865 - DNA, 201 bp, Homo sapiens
ctctttgcctcctataagtggaatgtctcccggccctcattgctggctgactccaagtaagtgcctcaggacccagccctaggcagccaggacactttcgktttcctgttcttctagccctgcaactttaggaattgtcctgtctgcctttgtttcaaacttggagccagtgctacgcttggagcctgtcaacacccttag

SEQ ID NO: 64866 - DNA, 201 bp, Homo sapiens
tacagatgaccaggggctgcgagctgttacccccactggtaggagagggggctccaagcgggcacacgccttttccttgtagtccagaaggagatggccaygagccatccttccagagcccaagaggtcggcacccatggtggtatttccctcccaagtggaggctccgaggggcaagggtggctgtcgcgtcaggtaggc

SEQ ID NO: 64867 - DNA, 201 bp, Homo sapiens
tgggtggatcacctgaggccaggagttcaagaccagcctggccaacatgatgaaacccaatctgtactaaacatgcaaaaattagcctgggatggtggcaygttcctgtaattccagctactcgggaggctgaggtgggagaattgcttgaacccgggaggcggaggttgcagtgagctgagatcgcaccactgcactcca

SEQ ID NO: 64868 - DNA, 201 bp, Homo sapiens
agtcttctaaaaatgttatctggccgggcgcagtggctcacgcctgtaatcccagcactttgggaggctgaggcgggcagatcacctgaggtcaggagttygagaccagcctgaccagtatggtgaaaccccgtctctactaaaaatacaaaaattagctgggcttggtggagggcgcctgtaatcccagctacttgggag

SEQ ID NO: 64869 - DNA, 201 bp, Homo sapiens
gagggcggtgcatgcctggggtagtctcggtgcagaagggctctggctcagtagcgcctttgcatcagtttggccttggctcccagcactggttgtttccrgcggggttgtcggctgtgtgaagcaggccgtgtgcctctctggctgtggggctctgttcggtggtgtagcaggcctgagtgcttattagccatctcggga

SEQ ID NO: 64870 - DNA, 201 bp, Homo sapiens
atcccagctttttgggaggcagagttgggtgggtcacctgaggccaggagttcgagaccagcctggccaacatggtgaaaccctgtctccactaaaaataraaaaattagccacgcgtggtggtgggcgcctgtaatatcccagctacttgggaggctgaggcaggagaaatgcttgaacctgggaggcggaggttgcagt

SEQ ID NO: 64871 - DNA, 201 bp, Homo sapiens
ttgttgttgttgttttgttttgttttgttttgttttgttttagagacagggtctctctctgtcaccctggctggagtgcagtggtgcagtcacagcttacwgcaccctggacctcccaggctcaagcgatcgtcccacttcagcctccagagtagctgggactacaggcacgcacacacacagctagctaatttttttttt

SEQ ID NO: 64872 - DNA, 201 bp, Homo sapiens
aggcgctctcccgccagtgtctggattctgcctcttgccaaagcagagggggctgccatcccctgcctgccacctgcccctcggctgcatgcccacagccrtacctgcctgaggacaaaggcttgcactgtctcgcccgcgcctggcccccaccccctccccggccagcctgaggctgcctgaggaaggaaggacccgctt

SEQ ID NO: 64873 - DNA, 201 bp, Homo sapiens
tcaccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagc

SEQ ID NO: 64874 - DNA, 201 bp, Homo sapiens
cacctgggcatcgaagtggtgggagctgggactctggggccagccatcctatggacttgcagagattctcatgcccctggactggggagcatcccgaaagwtcttcctcctcctttttttgggggggaacagggtcttgctctgtcgcccaggttggagtgcagcagcacgatctcggctcactgcaacctccacctccca

SEQ ID NO: 64875 - DNA, 201 bp, Homo sapiens
tcagttacttatctcaaatagacggcgagatcagagagcagccaccccagacaggagcttccagggtatgagcaacttccatctcatcaccaaaccaagcyagtccctcactgatgccaacctgagaggcaagttctaagaaccaggccggctgcaggggcatggtcatcggtgtgtgcagaagtcacaagctgagtcccc

SEQ ID NO: 64876 - DNA, 201 bp, Homo sapiens
caccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagct

SEQ ID NO: 64877 - DNA, 201 bp, Homo sapiens
agggccccgtaggggcttctcctacctctgaccctcacactaagtaaaagcccctttcctcggtggtgtgtgtgggaatgctgttggcgaggagagggggwcacggtgtgggctggccacctgggcatcgaagtggtgggagctgggactctggggccagccatcctatggacttgcagagattctcatgcccctggactg

SEQ ID NO: 64878 - DNA, 201 bp, Homo sapiens
accaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagctt

SEQ ID NO: 64879 - DNA, 201 bp, Homo sapiens
tcgaactcctgacctcgtgatccgcccacctcgggctcccaaagtgctgggattacaggcatgagccaccgcgcccagccgttctgggctatttctagagrcagaaactaacggcccgtcacttagcctccgtcacaggagttcccaagttatagcgacttcctggagctctgggaaggccattgtgacactctgggtttc

SEQ ID NO: 64880 - DNA, 201 bp, Homo sapiens
ccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagctta

SEQ ID NO: 64881 - DNA, 201 bp, Homo sapiens
aatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgc

SEQ ID NO: 64882 - DNA, 201 bp, Homo sapiens
taaacattcagccctggagtggcggaaaccccaaagtgtgcagagagagctggtccctggccctcgaaaggctcatctccctgctgctgagtcagcgtctkttactcaagctgtctgagaaatcttttgctgcccaggaggaatgtttccaactgtttcgtatgttcaaaaagtcaatttcaagaagtagaggaagccagg

SEQ ID NO: 64883 - DNA, 201 bp, Homo sapiens
tgaggcaggagaattgtttggactggggaggcggaggttgcagtgagccgagatcgtgtcattgcactccagcccaggcgacagtgcaagactccatcttaaaaaaaaaaaaaaaaaaacagaactgcccagcaggaaggaatccgagggctggcaccccacccttctctggcaccaacggtgcagcccggggtcaccaga

SEQ ID NO: 64884 - DNA, 201 bp, Homo sapiens
cttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcacc

SEQ ID NO: 64885 - DNA, 201 bp, Homo sapiens
aggcactggttttccccctcctccttctgtgacccgttacacccaacacccatagccctagctccggccgagaggcagctgcagggtccgggtcactttcygcacactcgtgagctttgcggctccgcaggagggggtgtgccgtgctgctgaggaacggctcaaagcaccagagccatcgcctccgcgtacggccccgcg

SEQ ID NO: 64886 - DNA, 201 bp, Homo sapiens
aggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacc

SEQ ID NO: 64887 - DNA, 201 bp, Homo sapiens
ccacccgcggcagaggctcccgggtgctggttccgaatggagactccaggccttgccgctgaccggtgactctgctgcctcccagcgtttgagacccgccrtcaaacaggagttgcggattcagggaaaccctaactagccagggtgctggcagctgggaaaaggccgccttttttttttttttttttttgagttggggtc

SEQ ID NO: 64888 - DNA, 201 bp, Homo sapiens
ggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacct

SEQ ID NO: 64889 - DNA, 201 bp, Homo sapiens
ctttcttgtttttttgaggcagggtctctttctgcgttgcttaggctggagtgcagtgatgtgaacgctgcagccttgacctcttagggctccccaggtgygcgccaccacacccagctaatttttaaattctttgcagagatagggtcttgctgtgttgcccaggttggtgtcgaactcctgggctcaagggatcctccc

SEQ ID NO: 64890 - DNA, 201 bp, Homo sapiens
ccccaggtgcgcgccaccacacccagctaatttttaaattctttgcagagatagggtcttgctgtgttgcccaggttggtgtcgaactcctgggctcaagrgatcctcccctcttggcctcccaaagtgctgggattacaggcgtaaacctccacacccagcctgataaacattcagccctggagtggcggaaaccccaaa

SEQ ID NO: 64891 - DNA, 201 bp, Homo sapiens
gagaatcgcttgaacccaggaggcagaggtggcaatgagccgagatcacaccactgcactccagcccgggtgacagagcgagactccatctcaaaaaaaamcccaaagaacaaaaaaacaaaacaaaacaaaacaaaaaacagtgctgtgctatctaggtcaggtcctgcagccaagaggttatttgtgtccactccagtt

SEQ ID NO: 64892 - DNA, 201 bp, Homo sapiens
gggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagc

SEQ ID NO: 64893 - DNA, 201 bp, Homo sapiens
ggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcg

SEQ ID NO: 64894 - DNA, 201 bp, Homo sapiens
gagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcga

SEQ ID NO: 64895 - DNA, 201 bp, Homo sapiens
agtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcgat

SEQ ID NO: 64896 - DNA, 201 bp, Homo sapiens
actcctgacctcatatgatccacccacctcagcctcccaaagtgctgggactacaggtgtgagccaccattctcggcttataatttaattattattattattattattttttttttgagacagagtctcactttgtcaccaggctggagtgcaatgccgtgatctcagctcactgcaacctccacctcttggttcaagcga

SEQ ID NO: 64897 - DNA, 201 bp, Homo sapiens
tcctgacctcatatgatccacccacctcagcctcccaaagtgctgggactacaggtgtgagccaccattctcggcttataatttaattattattattattwttattttttttttgagacagagtctcactttgtcaccaggctggagtgcaatgccgtgatctcagctcactgcaacctccacctcttggttcaagcgatt

SEQ ID NO: 64898 - DNA, 201 bp, Homo sapiens
ccaacctgagaggcaagttctaagaaccaggccggctgcaggggcatggtcatcggtgtgtgcagaagtcacaagctgagtcccctccaggcagcacaggycaaagcatgaaggatggcttagaagccacctggtccccaaccctgttcaaggatttgtagagcaaacaccaaaagaggactcgagtttcaccaaaatctt

SEQ ID NO: 64899 - DNA, 201 bp, Homo sapiens
cctcaagttcctggtcagcggcgaccagaagacaggtaggtgccccgggcagcctcggtcgctgtcactccccggcctgagcccagcccactggccaccgsccggaatgtgttaagctgagccgggccagcggggccatggaaaggccgcatcccaggagctgtctgcccgtcagagctattgcatcactgccagccccaa

SEQ ID NO: 64900 - DNA, 201 bp, Homo sapiens
gtacagattttttaaagctctgtagttcagtaatctgtttctaaatttgaggccgctttgattggtttctgtttccttgccttccatgtgcctgcatgtgmctgggtgtcccaaacagtagaggggctatgggcgaggtggcctggcagggcctcctcagctgaggtccacaggcagcagggcgtggcttcacaatccctt

SEQ ID NO: 64901 - DNA, 201 bp, Homo sapiens
gccaggctggtcttgaactcctggccttaggtgatccacccaccttggcctcccgaagggctgggattacagactgagccactgtacccggcctgattctrtttgtttgtttgtttgttttttgttttttttgagacagagtctaactatttgcccaggctggagtgcagtggtgtgtgatcttggctcactgcagcctcc

SEQ ID NO: 64902 - DNA, 201 bp, Homo sapiens
catctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacctccca

SEQ ID NO: 64903 - DNA, 201 bp, Homo sapiens
aaccaacaccaactcacaaagcagctcctcctttccagaagctgccccactgtggatgggcgagtggcccaggcctgtcggctgtggcggtgtacatgacygctctgagctccaccctgacgggctcgaggaccccgtctgccatgtgtttggctgaccgtgtggtagagcttctttttggaaaaccgagagaaagtggcc

SEQ ID NO: 64904 - DNA, 201 bp, Homo sapiens
atctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacctcccag

SEQ ID NO: 64905 - DNA, 201 bp, Homo sapiens
aagaggtgaccccaccgcagcgccaaccccgttaccctcaccaggcccgtcccgagggccccctcctggcctccagcgtggagggatctgcgtgtcccccsggtggtggggacagtgtgccccggccctgagccccgcaccctctccctgcagtggccccctccttcatgcacagcgtgttcagccccatcctgctgctca

SEQ ID NO: 64906 - DNA, 201 bp, Homo sapiens
gagccaattcctttgctgctggcagagctgacatttgaaaccaacaccaactcacaaagcagctcctcctttccagaagctgccccactgtggatgggcgmgtggcccaggcctgtcggctgtggcggtgtacatgaccgctctgagctccaccctgacgggctcgaggaccccgtctgccatgtgtttggctgaccgtgt

SEQ ID NO: 64907 - DNA, 201 bp, Homo sapiens
actgcaccctggacctcccaggctcaagcgatcgtcccacttcagcctccagagtagctgggactacaggcacgcacacacacagctagctaatttttttkttgttgttgttgagacagagtctccctctgtcgcccgggctggagtgcaatggcgcaatctcagctcactgcaacctccacctcccgggttcacgccatt

SEQ ID NO: 64908 - DNA, 201 bp, Homo sapiens
ccatcctgggccctggcgtgctctctccatccatcctctctgtcacctctgtgctggtttgctcctatctgcatgtcaacctggaaatggctgttgctttktagagaccctctttccctgacttcagagccaattcctttgctgctggcagagctgacatttgaaaccaacaccaactcacaaagcagctcctcctttcca

SEQ ID NO: 64909 - DNA, 201 bp, Homo sapiens
ggcccaggctggagtgcagtggcacaatctcggctcactgcaacctctgcctcctgggttcaagcgattctcctgcctcagcctccaaagtagttggggtyacgggtacctgccaccaagcctggctaaatttttttgtatttgtagtagagatggggtttcaccatgttggccaggctggtctcaaactcctgacctcaa

SEQ ID NO: 64910 - DNA, 201 bp, Homo sapiens
gacaggagaatcacttgaacccgggaggcggagattgcagtgagctgagattgcgccactgcactccagcctgaatgacgacagcgcgagacttcgtctcaaaaaaaaaaaaaaaaaaaaaagaacacagttcctgtccccgccccacctccgagggccagatttcctcaccaggtaccaggaacttgttccaagcccaga

SEQ ID NO: 64911 - DNA, 201 bp, Homo sapiens
ggggtttcactgtgttaaccaggatggtcttgatctcctgacctcgtgatccacctgcctcagcctcccaaagtgctgggattacaggcgtgagccaccgygcctggcttcacctggctaatttttaacttttttttagaaatggggtctcactttgttgcccaggctggtcttgaacccctgggctcaagcaattctcct

SEQ ID NO: 64912 - DNA, 201 bp, Homo sapiens
tcccagctactcaggaggctgaggtgggagaatctcggctcactgcaccccgggaagttgaggctgcagtgaactgagattgcaccagtgcactccagccygggcaaccggagtgagaccttgtctcaaaaaaaaaaaaaaaaaattagccggcctggtggcacatgcctgtaatcccagctactcaggaggctgagggag

SEQ ID NO: 64913 - DNA, 201 bp, Homo sapiens
gtagaggggctatgggcgaggtggcctggcagggcctcctcagctgaggtccacaggcagcagggcgtggcttcacaatcccttgcctttttttttttttytgagacggagtcttgctctgtcgcccaggctggagtgcagtggggggatctcggctcactgcaacctccgcgtcccaggttcaagcgattctcctgcctc

SEQ ID NO: 64914 - DNA, 201 bp, Homo sapiens
gatggaaaatgcagggaacatctggtcttctgctcctcttgtttcctccgtgcccgggcacagacagtcgcctgggggagatgttttctcggggtactaarcacccccttgttgggagccccaggacatcacaaaatatgctccttcttgatgtcagggaggcagaaggaagatggggttgaaagaaagaaagtcaaaaaa

SEQ ID NO: 64915 - DNA, 201 bp, Homo sapiens
gtatggtgaaaccccgtctctactaaaaatacaaaaattagctgggcttggtggagggcgcctgtaatcccagctacttgggaggctgaggcaggagaatygcttgaacccgggaggcagaggttgcagcgagtcgagattgcgccactgcactccggcctgggcgacgagtgaaattctgtctcaaaaaaaagcctgcct

SEQ ID NO: 64916 - DNA, 201 bp, Homo sapiens
ggatcacctgaagtcaggagttcgagaccagcctggccaacatggcgaaactccatctctactcaaaatacaaaaaaaaaattagctgggcatcgtggcakgtgcctgtaatcccagctactcgggaggctgaggcaggagaatcgcttgaaccagggaggtggagcttgaagtgagctgagattgtgctgctgcactgta

SEQ ID NO: 64917 - DNA, 201 bp, Homo sapiens
ggggagtcccttgacttttctaatctttaagtttttgttttgttttgttttgttttgttttttgaggcagagtttcactcttgttgcccagactggagtgyaatggcgcgatctcaactcactgccacctctgcctcctgggttcaagcgattctcctgcctcagcctgccgagtagctgggattacaggtgcacgccacc

SEQ ID NO: 64918 - DNA, 201 bp, Homo sapiens
ttgataacaatctaggagttaaatagatactatcatctgtttacgtcatcatttatgatagatactatcatcatatacacctgaaaaacgaggcctggagygatggaggagcttgttcaaggtcagagccagcactcacatatgggtcttaagacactggagcagccaagggcctctagaccaggacattccactcggagc

SEQ ID NO: 64919 - DNA, 201 bp, Homo sapiens
agtgccagccggatgctgcaggtacccgcctgagaccgcagccgggcgacgggcagggagtgctctgtgggtatcggctcaccccattcccacctcacccmaaaaggggaggcggccccgcccgccctgttctgcagaggcgctcaggaaggcctgggggagggaaagggatttgcctgatttcacccaagaggtgacccc

SEQ ID NO: 64920 - DNA, 201 bp, Homo sapiens
cctgacctcatatgatccacccacctcagcctcccaaagtgctgggactacaggtgtgagccaccattctcggcttataatttaattattattattattattattttttttttgagacagagtctcactttgtcaccaggctggagtgcaatgccgtgatctcagctcactgcaacctccacctcttggttcaagcgattc

SEQ ID NO: 64921 - DNA, 201 bp, Homo sapiens
tgacctcatatgatccacccacctcagcctcccaaagtgctgggactacaggtgtgagccaccattctcggcttataatttaattattattattattattwttttttttttgagacagagtctcactttgtcaccaggctggagtgcaatgccgtgatctcagctcactgcaacctccacctcttggttcaagcgattctc

SEQ ID NO: 64922 - DNA, 201 bp, Homo sapiens
cttgaatccaggaggcgaagcttgcagtgagccaagatcacgccactgcactccagcctgggcgacaaagcaagacttcttctcaaacaaaacaaaaaacraaacaaacaaacaaacaaaaaatgactgtgttaacgactggcttgcaaaatttctgaaaattcacaattggctccggaggatggggttgatccaactcca

SEQ ID NO: 64923 - DNA, 201 bp, Homo sapiens
caggctggtctcgaactcctgacctcaggtgatccgcccaccttggcctcccaaagtgctgggattacaggcgtgagccacctcgcccggcctcatttcttttttttttttgagtcttgctctgtcgcccaggctggagtgcagtggcacaatcttggctcactgcaacctccaccacccgggttcaagcaattctcctgc

SEQ ID NO: 64924 - DNA, 201 bp, Homo sapiens
tgcctcagcctcccaagtagctgggattacaggtgcacgtcaccatgcctggctaatttttgcatttttttagcagggacggggtttcaccatgttcgccrggctggtcttgaactcctgatcttgtgatctgcccacctcggcctcccaaagtgctgggattacaggcgtgagccaccgtgcccagcctcttttttttaa

SEQ ID NO: 64925 - DNA, 201 bp, Homo sapiens
cttgtgatctgcccacctcggcctcccaaagtgctgggattacaggcgtgagccaccgtgcccagcctcttttttttaaaacgtagtcttgctctgttgcrcaggctggagtgcagtggcacgatctcggctcactgcaacccccgcctgggttcaagtgattctcctgcctcagcctcccgagtagctgggattacaggc

SEQ ID NO: 64926 - DNA, 201 bp, Homo sapiens
ggcctggccgacattccctgccttctgatctgggctttgatgctgcggaagcagctcactagccttgtgcccaaggaaggcagaggcaggaagacaaaacrctgccgcccactttcttttcctgttttcctcggcagctgtcatcagggtctccgggagcttcggctcatggagcagcctgaccacccgcctcccgtggaa

SEQ ID NO: 64927 - DNA, 201 bp, Homo sapiens
agagtgaccaggcaagagagtcacctgatcaccatttgaagcgtttggctaccagaggtctgtctaagggaggctgttggtttgttcttcaaggttttcattttttgatctagagcaggagtcagcaaaccgccattgccaggccaaatccagaccactgcctgtttttgtaaacaaaacttcatggggtagagctgtgcc

SEQ ID NO: 64928 - DNA, 201 bp, Homo sapiens
tctggctctagatgagaaaacccatgggtttagagacccagctgtggttcctccctggggtaactggaggtccctggtgcctttactcaggcagtgctgcytcacccactccattccttgtccccgtggctcctgcttgcagcagtagaacctgcagccccccaagccctcagttattccacggcccctgtgcagtcactg

SEQ ID NO: 64929 - DNA, 201 bp, Homo sapiens
gcagtctcggctcactgtaacctctgcctctcgggttaaagcgattttcctgcctcagcctcccaagtagctgggattacaggcgcctgccaccatacccrgctaattttttgtatttgtatttgtattttattttattttatttttttgagatggagtttcactctgtcgcccaggctggagtacaatggcatgatctca

SEQ ID NO: 64930 - DNA, 201 bp, Homo sapiens
tctgctgcctcgaggacctcttttcttgggggatggggaggagggaacggagtttcactcttgtcgcccaggctggagtgcagtggcgcagtctcggctcrctgtaacctctgcctctcgggttaaagcgattttcctgcctcagcctcccaagtagctgggattacaggcgcctgccaccatacccggctaattttttgt

SEQ ID NO: 64931 - DNA, 201 bp, Homo sapiens
ttacaggtgcgcaccatcacgcccagctaatttttgtattttcagtagagatggggttttgccatgttggccaggctagtctcgaactcctgacctcaggsgatccacccgccttggcctcccaaagtgctgggattttacaggtgtgaggcaccgtgcccagctcagatgatgactttcattcattccactcaaccgagc

SEQ ID NO: 64932 - DNA, 201 bp, Homo sapiens
agctcgaggccgtggtcagcaacctcttgctcagtgctgtgcccatacacgtctgtcagcagggccctggttctagtgtttgccgacttccacggtgcacrtgcactcaccgtggctgatttccagctgcccatgtgttgccactgactgtggaactggagagtcacagtgacacgtggtatttctacagtagatgtgaaa

SEQ ID NO: 64933 - DNA, 201 bp, Homo sapiens
gtcggggctgctgggggcggccgcaggggctgggcaagggccggccgctgacgccgagttctgtgcgcaggtggtgcagagccggagccggagccggagcygcgccgcgccgcaccatggcgcccaccctggccactgcccatcggcgccgctggtggatggcctgcacggccgtgctggagaacctcctcttctcggcag

SEQ ID NO: 64934 - DNA, 201 bp, Homo sapiens
cagtgctgtgcccatacacgtctgtcagcagggccctggttctagtgtttgccgacttccacggtgcacatgcactcaccgtggctgatttccagctgccyatgtgttgccactgactgtggaactggagagtcacagtgacacgtggtatttctacagtagatgtgaaaagcctggccgggcacggcggctcacgcctgt

SEQ ID NO: 64935 - DNA, 201 bp, Homo sapiens
agaagtcatcacggcctctgcctgaggaagtcacccacagtctgaccatgggcatgaaggccgaccccagttgtatgctcttgacctctgcagtttctccrcctgtggtggtgggagagagcctctcaccctggcacagaggtccctgcgagctcgccctggcacagagatcgctgcaagggcagaggggctgccgcccac

SEQ ID NO: 64936 - DNA, 201 bp, Homo sapiens
tgttcgttcattttgtttttttttgagacagggtctcactcccatcagccaggctcgagtgcagtggtgggatcttggctcactgcagccttgacttcccragctcaggtgatcctcccacctcagcctcctgagtagctgggactacgggcacgtaccaccaagcccagttaatttttatatttttttgcagagatgggg

SEQ ID NO: 64937 - DNA, 201 bp, Homo sapiens
ctgggattataggcgtgagccaccgctccaggcctacatgtggatcgttaatcccctctttcttgtaacctaaacattcagtaaacattgacgaaggtgcmgtgctgggtgcagaggaaacaagtcatcacacgcatacctgtgtaacccgtataattccagggggtggtcgggcccccaagaaagcagggcgccaggagc

SEQ ID NO: 64938 - DNA, 201 bp, Homo sapiens
tccctggggtaactggaggtccctggtgcctttactcaggcagtgctgcctcacccactccattccttgtccccgtggctcctgcttgcagcagtagaacstgcagccccccaagccctcagttattccacggcccctgtgcagtcactggccccacaagtcacccatcctgggccctggcgtgctctctccatccatcct

SEQ ID NO: 64939 - DNA, 201 bp, Homo sapiens
tacgggcacgtaccaccaagcccagttaatttttatatttttttgcagagatggggtcttgacatgttgcccaggctggtctggaactcctgggctcaagygatcctcccaggcctcccagagtgtggggattacaggtgtgagccactgcaccaggccaggaagtgatgagttttcagagttttgagtattcattacctt

SEQ ID NO: 64940 - DNA, 201 bp, Homo sapiens
ggagattaatgcctgtccccgaaaggcacaggttggagtgtttacttcttcctctcctttcctctctccccccttagagatcgtgacccttcctgcttgcytccctggtgggctctttcaggctggacacagggtttaaaaaaaaaaaaaaaaaagcagaaaaaaagtcatcgtccccagagaaagcttttagtgtctcac

SEQ ID NO: 64941 - DNA, 201 bp, Homo sapiens
tcctcccaggcctcccagagtgtggggattacaggtgtgagccactgcaccaggccaggaagtgatgagttttcagagttttgagtattcattacctttaytttaatataatttatttatttagtcataaatttatgtaatttttttttttttgagacagagtctagctctgtcacccaggctggagtgcagtggtgctat

SEQ ID NO: 64942 - DNA, 201 bp, Homo sapiens
agctttctgctttggccaagagttgttaggagattaatgcctgtccccgaaaggcacaggttggagtgtttacttcttcctctcctttcctctctcccccsttagagatcgtgacccttcctgcttgcctccctggtgggctctttcaggctggacacagggtttaaaaaaaaaaaaaaaaaagcagaaaaaaagtcatcg

SEQ ID NO: 64943 - DNA, 201 bp, Homo sapiens
acaagctttctgctttggccaagagttgttaggagattaatgcctgtccccgaaaggcacaggttggagtgtttacttcttcctctcctttcctctctccycccttagagatcgtgacccttcctgcttgcctccctggtgggctctttcaggctggacacagggtttaaaaaaaaaaaaaaaaaagcagaaaaaaagtca

SEQ ID NO: 64944 - DNA, 201 bp, Homo sapiens
gtccaaagagaaacactttgcagaaccacccagcagggccgggcgcggtggctcacgcctgtaatcccagaactttgggaggccgaggcaggcagatcacraggtcaggagtttgagaccagcctggccaacgtagtgaaaccccgtctctactaaaaatacaaaaaattagccagatgtggtggcgggcgcctgtaatcc

SEQ ID NO: 64945 - DNA, 201 bp, Homo sapiens
accccgtctctactaaaaatacaaaaaattagccagatgtggtggcgggcgcctgtaatcccagctactagggaggctgaggcaggagaattgtttggacyggggaggcggaggttgcagtgagccgagatcgtgtcattgcactccagcccaggcgacagtgcaagactccatcttaaaaaaaaaaaaaaaaaaacagaa

SEQ ID NO: 64946 - DNA, 201 bp, Homo sapiens
agactccatcttaaaaaaaaaaaaaaaaaaacagaactgcccagcaggaaggaatccgagggctggcaccccacccttctctggcaccaacggtgcagccyggggtcaccagacacctggggccaagcaaagcccaggaggcaggatggctgtgagctgtcgcttgccctgcaggtacccctccacccagttcggcagcct

SEQ ID NO: 64947 - DNA, 201 bp, Homo sapiens
tttctttctttctttctttgcgccggctgtgctggcatgccgggcaggaacacttccctccttccgcataagcagaacaaatatttgcattctcactgggrtagatatggccacggagatgcctttgctacagtgcagtaatggagcagcccaaatatgtgagcttgggaaccgaggcttgtcctttgaactgcaacctac

SEQ ID NO: 64948 - DNA, 201 bp, Homo sapiens
tcagagcgatctgtcttgcgcaaggccgcagagcctgggcctgccatccacccagaaccccacctgctgtccagggtgttccttccacccgctacgaacaktgctggactgctctcctctcctcccagccctggaacatagcttggctggtagtaaacatgttgctgtctgcttgtgagaaagaggaactccagattaagg

SEQ ID NO: 64949 - DNA, 201 bp, Homo sapiens
cctggggttgcgggggggctcctggagctggggctttgggagggggcgggatgggggcgaagacctagcgagccacagcaccgcattgcccagtgcctctmgggtatcagaaggcccatctgatcctcacccagccctgccgggtacttgtcattgcccctgttttgtggacgaagacatcgaggctcagagcgatctgtc

SEQ ID NO: 64950 - DNA, 201 bp, Homo sapiens
taactgcgagctgcaaggtccccctcgggggcttcagggccccgaggacatgtgggagcgttggttaggattggttaagagtccctttgtgaatggtggcyaggcaggaaaaggaacatgtcctctctggacctgatttggggagaaatagaacagagttcctgggccgggcgcggtggctcacacctgtaatcccagcac

SEQ ID NO: 64951 - DNA, 201 bp, Homo sapiens
agtggatcaatgtcagctcactgcaacctccatctcccggttcaagggattctcctgtctcagcctcccgagtagctgggattacaggcgtccaccaccaygcccggctaattttttgtatttttagtagagatagggtttccccatgttggccaggctggtgttgaactgctgacctcgtgatctgcctgcctcggcctc

SEQ ID NO: 64952 - DNA, 201 bp, Homo sapiens
ccaggaccttcgccgtctccgtgccagcgttcacgctccctcccggggccctgcctcggagctctgtggtggaaggacgggagagggccccggacacgcgmgttttctcctgccgaacgcaggggctgccctgactttgctctgccgccccccggggacccggggcctggggtctctgtggtgcctgcagcaggagccagg

SEQ ID NO: 64953 - DNA, 201 bp, Homo sapiens
gtgactgcagacaggtatgtcgccaagttcaaactccctccgctcagtaacagttaatttgcttgcaggcaggcaggtttgataaaacaaaaattatttaktttgggaggccaaggtgggagaagagcttgaggccaggagttcaagtctagcctgggcaatatagtgagaccccatctctacaaaaataattaaaggccg

SEQ ID NO: 64954 - DNA, 201 bp, Homo sapiens
ccaaagcagagggggctgccatcccctgcctgccacctgcccctcggctgcatgcccacagccgtacctgcctgaggacaaaggcttgcactgtctcgccygcgcctggcccccaccccctccccggccagcctgaggctgcctgaggaaggaaggacccgcttcctgttgtcggtgctaattcctttgtaattccagccc

SEQ ID NO: 64955 - DNA, 201 bp, Homo sapiens
ataaatccattttcctccgggtaagggatgccccttctggcatatcagttaatagctgcatgtgcctattttgagcttgagaagaaaaggcaggacaagaytctctgccaccgaccagctccagccgtgcccagctgctcttcgtctctctgggggactgctgactcgggagggacagtgggccaggaaaagaccttcctc

SEQ ID NO: 64956 - DNA, 201 bp, Homo sapiens
tgccatgtgccagctcaggcacacgctgctacttctctccccgtcgtcttagctcagccttcacagagcactgcagcatatggatggccatcttcttgtasccgagaccccctccgagagtcacactcagcttgccactgagaagggccggggagtgtccgtagtgctggtccagccccgacacagtccctaaaacgtgcc

SEQ ID NO: 64957 - DNA, 201 bp, Homo sapiens
gtgtttacttcttcctctcctttcctctctccccccttagagatcgtgacccttcctgcttgcctccctggtgggctctttcaggctggacacagggtttaaaaaaaaaaaaaaaaaagcagaaaaaaagtcatcgtccccagagaaagcttttagtgtctcacccagaccagagaactgttgtgggcaggtgtttttttg

SEQ ID NO: 64958 - DNA, 201 bp, Homo sapiens
acaggtaggtgccccgggcagcctcggtcgctgtcactccccggcctgagcccagcccactggccaccggccggaatgtgttaagctgagccgggccagcsgggccatggaaaggccgcatcccaggagctgtctgcccgtcagagctattgcatcactgccagccccaactgtttcttcgtgtccccatcagggtttcct

SEQ ID NO: 64959 - DNA, 201 bp, Homo sapiens
tggccaggctagtctcgaactcctgacctcaggcgatccacccgccttggcctcccaaagtgctgggattttacaggtgtgaggcaccgtgcccagctcasatgatgactttcattcattccactcaaccgagcagcccaccagccctttgttatttgcggagggcctgttccctgccaggctctgtgcttgctgctgcag

SEQ ID NO: 64960 - DNA, 201 bp, Homo sapiens
ggcctccctgcctccccaggtgaacgtggggctgctccttctcagcctgctgggcttctgcctcccgctctacctgatctgctaccggcgccagctggagyggcagctgcagcagaggcaggaggatgacaaactcttcctcaaaatcaacggctcgtccaaccaggaggccttcgtgtagtggctgccgcctcggaactg

SEQ ID NO: 64961 - DNA, 201 bp, Homo sapiens
tcgtggggaatatggggtgggcgtgggcacacccgttgagcatggcagctggcacacactttcattgcacacacggcagccgctgctgggaccactgctcrggggccaggccctggtcagcccaggacggcctctgcctgtccgtgccctcctgcctgttgtttgctctgtgtctgagccgacctctcacctacatctccc

SEQ ID NO: 64962 - DNA, 201 bp, Homo sapiens
attggctccggaggatggggttgatccaactccaggctgacactgcccctggggtgagggcccccaggaattggagggcgggggctgaggggacggtcccytaaggccttatgcccacagtcgccttttcctcccccagatcctctccttcatcctgcacacaatcgtgcgaggattcatccactccgctgtcgggggcct

SEQ ID NO: 64963 - DNA, 201 bp, Homo sapiens
gggacttgggccaaatggccatccaagcctgctgcggggtagcctgagccctcgagaggccgccagccagccctggcattcccagtggggggactctgaaygggcacctgcccttctgatctttgggaatccctgtcatgaccctgaggtcagggtttccttccctcttcacacagagaatgtcaccaatggcacagtggg

SEQ ID NO: 64964 - DNA, 201 bp, Homo sapiens
tccatgtccctgcagctctctccgtgctcatcttcatcgccctggctctgaatggctttggtgggatgtgtatgaccttcacctcattaacagtgagtacrgattttttaaagctctgtagttcagtaatctgtttctaaatttgaggccgctttgattggtttctgtttccttgccttccatgtgcctgcatgtgcctgg

SEQ ID NO: 64965 - DNA, 201 bp, Homo sapiens
agggctgtgcctctttgcgcggctcagcacagggacagcaggggtggccagacgcccctgcctgctgcggctctggcctccccgggctaactctgcccccycccccccccaccccgtccccgcggtgcctgtcagctcatctatgatgctggtgtctccttcatcgtcgtcctcgtggtctgggccggctgctccgggctg

SEQ ID NO: 64966 - DNA, 201 bp, Homo sapiens
caagttcctggtcagcggcgaccagaagacaggtaggtgccccgggcagcctcggtcgctgtcactccccggcctgagcccagcccactggccaccggccrgaatgtgttaagctgagccgggccagcggggccatggaaaggccgcatcccaggagctgtctgcccgtcagagctattgcatcactgccagccccaactg

SEQ ID NO: 64967 - DNA, 201 bp, Homo sapiens
tgtgcctctttgcgcggctcagcacagggacagcaggggtggccagacgcccctgcctgctgcggctctggcctccccgggctaactctgccccctccccyccccaccccgtccccgcggtgcctgtcagctcatctatgatgctggtgtctccttcatcgtcgtcctcgtggtctgggccggctgctccgggctggtttt

SEQ ID NO: 64968 - DNA, 201 bp, Homo sapiens
ccctgggtatcgtcatggacaagtatggcccgaggaagctcaggctgctgggcaggtcagtgtgggtcccttagggggcagggagtgggcaggtggacccyctgggctgagttccccacagaagggtatcctggtcgtacctgatatcaggtgtactgtggagctccctgaaggccctccagaatggagttcctaccccgt

SEQ ID NO: 64969 - DNA, 201 bp, Homo sapiens
gtggcccctctccaccacccccacccgggcaggatgcacctgggcatcacaggggcgacaaatgaaaaccgcggggcctcaggggacgggaatcacgcatktggctgcaggatctgccgcaggtgcctttgcatttcggggctggggcaggggaagggcggtgggtgagtctgtttccagttgtgagtcttgcccccgtct

SEQ ID NO: 64970 - DNA, 201 bp, Homo sapiens
acctgggcatcacaggggcgacaaatgaaaaccgcggggcctcaggggacgggaatcacgcatgtggctgcaggatctgccgcaggtgcctttgcatttcrgggctggggcaggggaagggcggtgggtgagtctgtttccagttgtgagtcttgcccccgtctcctccgtcatcctggtctcccgctgctcccctgctcc

SEQ ID NO: 64971 - DNA, 201 bp, Homo sapiens
cagggagtgctctgtgggtatcggctcaccccattcccacctcaccccaaaaggggaggcggccccgcccgccctgttctgcagaggcgctcaggaaggcytgggggagggaaagggatttgcctgatttcacccaagaggtgaccccaccgcagcgccaaccccgttaccctcaccaggcccgtcccgagggccccctcc

SEQ ID NO: 64972 - DNA, 201 bp, Homo sapiens
tcgctgtcactccccggcctgagcccagcccactggccaccggccggaatgtgttaagctgagccgggccagcggggccatggaaaggccgcatcccaggmgctgtctgcccgtcagagctattgcatcactgccagccccaactgtttcttcgtgtccccatcagggtttcctggtccaggagggagggaaggaccaaaa

SEQ ID NO: 64973 - DNA, 201 bp, Homo sapiens
tccccatcagggtttcctggtccaggagggagggaaggaccaaaatagcctcctgggtgtggggtgtggggtgtgtgttttccagtgcctgagggggaggkttgccgtgtgtgtctgtaaatgaaaacagaacagaacgctccacctgagcatggctgaaagacagcaggtcaagcccaaagtcctcccagaaagtggcac

SEQ ID NO: 64974 - DNA, 201 bp, Homo sapiens
ggacattccactcggagcagcagctcaggggccaccaggcctctgtggcaggggggccatggcccaaggaaggggagcaggcccaggcatggtccccgttycttggagtggaagggagaccagctctggccatctggaggagacccatggtgtcagatgccttggctgggcgtcaggggcaggttctttgacctttccctc

SEQ ID NO: 64975 - DNA, 201 bp, Homo sapiens
tccgcccacctcgggctcccaaagtgctgggattacaggcatgagccaccgcgcccagccgttctgggctatttctagaggcagaaactaacggcccgtcrcttagcctccgtcacaggagttcccaagttatagcgacttcctggagctctgggaaggccattgtgacactctgggtttcattagctgtttcttagaaac

SEQ ID NO: 64976 - DNA, 201 bp, Homo sapiens
actccaggggacttgggccaaatggccatccaagcctgctgcggggtagcctgagccctcgagaggccgccagccagccctggcattcccagtggggggaytctgaatgggcacctgcccttctgatctttgggaatccctgtcatgaccctgaggtcagggtttccttccctcttcacacagagaatgtcaccaatggca

SEQ ID NO: 64977 - DNA, 201 bp, Homo sapiens
gagcacctggggtccgttcttggatcatccagggtgtctgcgtgggtgtgagactgggatcggtaatcgttcattcacgagagataattgcagagggtgcytggccgggcgcggtggctcacacctgtaatcccagcactttgggaggccaaggcgggtggatcacaaggtcagaagatcgagaccatcctggccaacacg

SEQ ID NO: 64978 - DNA, 201 bp, Homo sapiens
gggtgcctggccgggcgcggtggctcacacctgtaatcccagcactttgggaggccaaggcgggtggatcacaaggtcagaagatcgagaccatcctggcyaacacggtgaaaccctgtctctacaaaaacgcaaaaattagccgggtaaggtggcgcgtgcctgtagtcccagctactcgggaggctgaggcaggagaat

SEQ ID NO: 64979 - DNA, 201 bp, Homo sapiens
cctggccgggcgcggtggctcacacctgtaatcccagcactttgggaggccaaggcgggtggatcacaaggtcagaagatcgagaccatcctggccaacayggtgaaaccctgtctctacaaaaacgcaaaaattagccgggtaaggtggcgcgtgcctgtagtcccagctactcgggaggctgaggcaggagaatcgctt

SEQ ID NO: 64980 - DNA, 201 bp, Homo sapiens
gtcaggagtttgagactagcctatccaaaatggtgaaaccccgtctctactaaaattacaaaaattagctgggcgtggtggcacatgcctgtaatcccagytactcaggagggctgaggcaggagaattgcttgaatccgggtggcagaggttgcagtgagccgagattgcgccactgcactccagcctgggcgacagagt

SEQ ID NO: 64981 - DNA, 201 bp, Homo sapiens
gaaaggggcagttccactccccagatgtcaggtactaaccccggcctgcgtttactggatttactgggagcctgcaccgcgcaggactctgggctggtccyggcttccctggagctcagctggggtctccactcacgagctttccatgtccctgcagctctctccgtgctcatcttcatcgccctggctctgaatggcttt

SEQ ID NO: 64982 - DNA, 201 bp, Homo sapiens
aacgactggcttgcaaaatttctgaaaattcacaattggctccggaggatggggttgatccaactccaggctgacactgcccctggggtgagggcccccargaattggagggcgggggctgaggggacggtcccttaaggccttatgcccacagtcgccttttcctcccccagatcctctccttcatcctgcacacaatcg

SEQ ID NO: 64983 - DNA, 201 bp, Homo sapiens
ggaagtcacacagggtcaggacgaagcaaacacctcacagtccatcagcccaagttccccagaccctgtgggtctgccagggccccgtaggggcttctccracctctgaccctcacactaagtaaaagcccctttcctcggtggtgtgtgtgggaatgctgttggcgaggagagggggtcacggtgtgggctggccacctg

SEQ ID NO: 64984 - DNA, 201 bp, Homo sapiens
gctcagtggggacagtcatctttttgttttatgtaggtctcactgaaagaaaagttgtaaaaaggcaacaaggcatttgaggtggggaggcctgcacagcktgtgtgtgtgtgtgtgtgtgtgtgtgtgtgtgtgtgggcactgggcacagccctctttcaacactgccaagagcagcccctgcccccccaccacccacat

SEQ ID NO: 64985 - DNA, 201 bp, Homo sapiens
tcagtggggacagtcatctttttgttttatgtaggtctcactgaaagaaaagttgtaaaaaggcaacaaggcatttgaggtggggaggcctgcacagcgtstgtgtgtgtgtgtgtgtgtgtgtgtgtgtgtgtgggcactgggcacagccctctttcaacactgccaagagcagcccctgcccccccaccacccacattc

SEQ ID NO: 64986 - DNA, 201 bp, Homo sapiens; identical to SEQ ID NO: 41371

SEQ ID NO: 64987 - DNA, 201 bp, Homo sapiens
tgataacaatctaggagttaaatagatactatcatctgtttacgtcatcatttatgatagatactatcatcatatacacctgaaaaacgaggcctggagckatggaggagcttgttcaaggtcagagccagcactcacatatgggtcttaagacactggagcagccaagggcctctagaccaggacattccactcggagca

SEQ ID NO: 64988 - DNA, 201 bp, Homo sapiens
aaaaatgcaaaaattagccagatgtggtggtgggcgcctgtagtccccacgactcaggaggctgaggcaggagaattgcttgaacccgggaggcagaggtygcagtgagctgagattgtgccactgcactccagcatgggtgacagagcgagactctgactcaaaaaaaaaaaagtctattgtctggccctttatggaaaa

SEQ ID NO: 64989 - DNA, 201 bp, Homo sapiens
cagtggggacagtcatctttttgttttatgtaggtctcactgaaagaaaagttgtaaaaaggcaacaaggcatttgaggtggggaggcctgcacagcgtgygtgtgtgtgtgtgtgtgtgtgtgtgtgtgtgtgggcactgggcacagccctctttcaacactgccaagagcagcccctgcccccccaccacccacattcc

SEQ ID NO: 64990 - DNA, 201 bp, Homo sapiens
ctgcttgtattctgcattacctccctccttggccccatcagcctcagtccatgaaggagaaaccttcagtgagcggtcattgcccctgaactaatgccccygtgagtcacacaggaaggggcgcaggtgaagaaggggcctcatggggcctagttctctgtcccctcctcctccccttccctggtgcatcctccccactga

SEQ ID NO: 64991 - DNA, 201 bp, Homo sapiens; identical to SEQ ID NO: 41337

SEQ ID NO: 64992 - DNA, 201 bp, Homo sapiens
gggaagttgaggctgcagtgaactgagattgcaccagtgcactccagcccgggcaaccggagtgagaccttgtctcaaaaaaaaaaaaaaaaaattagccggcctggtggcacatgcctgtaatcccagctactcaggaggctgagggagaacaatcgcttgaacccaggagacagaggttgcagtgagccgagaccacac

SEQ ID NO: 64993 - DNA, 201 bp, Homo sapiens
tgccccggctcccagcccgcagcccctgcagaaagaccccagagctgcatgtcaggcacagggtgggtgggacagagggagagagcaatgcactccagctsctcccggagcccttagagagactcactcattcagctcagcatgcgtttcaactgctcccctctttatggaaattgtttggaatgcaatggaaatgctaaa

SEQ ID NO: 64994 - DNA, 201 bp, Homo sapiens
atttccagctgcccatgtgttgccactgactgtggaactggagagtcacagtgacacgtggtatttctacagtagatgtgaaaagcctggccgggcacggyggctcacgcctgtaatcccagcactttgggaggccaacgcgggtggatcacctgaggtcaggagttcgagaccagcctagtgaaaccccgtctctacaaa

SEQ ID NO: 64995 - DNA, 201 bp, Homo sapiens
tgtgtctccacagaggcgagaagaaaaagaagaagcgggaccggcagatccagaagatcactaatgccatgcgggccttcgccttcaccaacctgctgctsgtgggctttggggtgacctgcctcattcccaacctgcctctccaggtgggtgtggggagtgggaggggcaggtgggaggtggggcagtcagaaggaacat

SEQ ID NO: 64996 - DNA, 201 bp, Homo sapiens
ccctgggccaaaaggcacgtacgtccggcatcttagagaagctcccgcgcccgcactgtcccagggccttggccctgcaggcactcctgtccggtggtcawgctctatggccagaatgccaggggaggggccgcctgcagctgctgttttcccctctgggaaggtcacacagtccggcctgtttatgctgcagccaggggg

SEQ ID NO: 64997 - DNA, 201 bp, Homo sapiens
ccggccgggaaggcacaggaggtggccgggggaggggagcacacccttcccctcccttcagcactgaagcagaaaggtgaccacaaggaccttgtcccggrcagcatgtgcttggaggtgcccggttgttgtgggtaggaaacagcccagcctggcagagtctacctgtgcagtctggttccgggatcccggcctgtgcag

SEQ ID NO: 64998 - DNA, 201 bp, Homo sapiens
ggaaatgatgctagggttgttctctcctctttgccttgtcactggaattgctgaaggcaggctgaggatgcttctctacatgacatctgcaccacccaacrcacacttaccttcacaccttcataccctgttggagggtcctgatgactacagggcagtaaattcagccccacaggagggccacagcagcccccagcctct

SEQ ID NO: 64999 - DNA, 201 bp, Homo sapiens
cctggagctgatgacgggggaggcccgtccgcctggcccaccaacccgcccaccttgactgcccccagaagtgtgtcttgagacctcctgggcgtgcttaraggggtgagttgtgtttggatttttagttattttctcttcagttttattagacttcttttttataaagcaataaatccattttcctccgggtaagggatg

SEQ ID NO: 65000 - DNA, 201 bp, Homo sapiens
tgggggcccaggccctgagggtggccacatggcctgtgaagagttgggaaccgggacgctggcatatgggacctcgtgggccttcctgtttcgttcccccytccaccccgtgaccttctcccctttcccaaacccgagtggagggcgggtctgcagcctcggcgcaccaccacgccctgtgatgcgcggcctccctgcctc

SEQ ID NO: 65001 - DNA, 201 bp, Homo sapiens
cccgtacatacacacagctgcttttgtggaggtggacgaaaggctgtggccggcagacgtggaggtccaggccggggtggggacgtgggtgggtccgaggkgtgtgtggggtcggggtgggctctaggagttagcccttatccccactgaccaggcgggagccgccaggcctgcagctgggccagtgcccaggagccatcc

SEQ ID NO: 65002 - DNA, 201 bp, Homo sapiens
tgatcttgtggttgaagaaaccagctctggggaagggtctcgggcgcgggcgggagggcacctgtcagggtccctgggagaggcagccctcggatctgccsctgcccacctcacgctgcgttccatgctggccccaggcgatgtcagtcctgctgcaggccaggactagttccacggccctgagcatgcgttagccccttc

SEQ ID NO: 65003 - DNA, 201 bp, Homo sapiens
agtcctcctgggctggggctcgctgctcatcatgctcaagtcagagggcttttactcctacctgtgtaccgagccaggtgagacaagcgcctggggttgcgggggggctcctggagctggggctttgggagggggcgggatgggggcgaagacctagcgagccacagcaccgcattgcccagtgcctctagggtatcagaa

SEQ ID NO: 65004 - DNA, 201 bp, Homo sapiens
agaacagcagcggagatgtggctcctgctgggtgggagggcctctctgcggttcaggtggaagcctggaggttgaggaggggtgattcaggagaggagggyacaccctggaggagaggagggtacaccctggaggagaggagggtacagcctggaggagaggagggtacaccctggaggaggggagggtacagcctggagg

SEQ ID NO: 65005 - DNA, 201 bp, Homo sapiens
gtgattcaggagaggagggtacaccctggaggagaggagggtacaccctggaggagaggagggtacagcctggaggagaggagggtacaccctggaggagrggagggtacagcctggaggagaggagggtacagcctggaggagaggagggtacaccctggaggagaggagggtacagcctggaggagaggagggtacagc

SEQ ID NO: 65006 - DNA, 201 bp, Homo sapiens
aggagggtacagcctggaggagaggagggtacagcctggaggagaggaggatacgccctggaggagaggagggtacgccctggaggagaggagggtacagsctggaggagaggagggtacaccctggaggagaggagagaagtgggaaggggcgggggctgcagggactgggaggccattcggggaaactgaattttattc

SEQ ID NO: 65007 - DNA, 201 bp, Homo sapiens
tctttgggaggatgtagtttgccctaggcctggatttcggtagaatgagcaagagttagccttgaagtcctgttcaggtgggccccctcttgccctgtacscagaatgagctgatgtgagatgccgagagtggcttcgttgggaagagagcccggaccttgcttcccgttggccttccaggatgctaactgctcgggccga

SEQ ID NO: 65008 - DNA, 201 bp, Homo sapiens
tcacccactccattccttgtccccgtggctcctgcttgcagcagtagaacctgcagccccccaagccctcagttattccacggcccctgtgcagtcactgkccccacaagtcacccatcctgggccctggcgtgctctctccatccatcctctctgtcacctctgtgctggtttgctcctatctgcatgtcaacctggaaa

SEQ ID NO: 65009 - DNA, 201 bp, Homo sapiens
cggcacgctcagtgtttgttcagtgcctcgcgtttgtacagccctttgcactcgcttcatcggctggagcacaaacacggccggcggctgaggccgcatcytggggtcgccaccctccaacccggagcctgggttgcttagagatgggagcagctgtagccaaaattgtgaacctgccatttccactccattactctgacc

SEQ ID NO: 65010 - DNA, 201 bp, Homo sapiens
taaaccttggtgtgcattttctggggaggtctttattggatttttcaaagggtccatggcccccacaaaagttaagaacctctacattttcactccagggkacttgggccaaatggccatccaagcctgctgcggggtagcctgagccctcgagaggccgccagccagccctggcattcccagtggggggactctgaatgg

SEQ ID NO: 65011 - DNA, 201 bp, Homo sapiens
aagctcaggctgctgggcaggtcagtgtgggtcccttagggggcagggagtgggcaggtggaccccctgggctgagttccccacagaagggtatcctggtygtacctgatatcaggtgtactgtggagctccctgaaggccctccagaatggagttcctaccccgtccgccaccgaatcagcaggtactgtggtcctcgcc

SEQ ID NO: 65012 - DNA, 201 bp, Homo sapiens
aggtgtactgtggagctccctgaaggccctccagaatggagttcctaccccgtccgccaccgaatcagcaggtactgtggtcctcgccgtgctccagtacygaataagaaaagctccaggctccaggccgcccagggaccggagctgcttgtcactaagaacatgtgtttcccatccctttgtagttcataagcatgataa

SEQ ID NO: 65013 - DNA, 201 bp, Homo sapiens
gtatgtgaccacgttcagacggaaagggcagcggtattggcaggactggacccggccgggaaggcacaggaggtggccgggggaggggagcacacccttcycctcccttcagcactgaagcagaaaggtgaccacaaggaccttgtcccgggcagcatgtgcttggaggtgcccggttgttgtgggtaggaaacagcccag

SEQ ID NO: 65014 - DNA, 201 bp, Homo sapiens
agagtttgtatgttggggaaaggggaaaggcaagagtgtggggagggaggaagggccctggctggtccttctcaggatcccctttcccgcttctctgcccrtcaccctgctgtgcttggctctaagcacaccgtcccctcctgcttctctggccctggcccccatcaccttcacactccctcaggctgccctttcttcccc

SEQ ID NO: 65015 - DNA, 201 bp, Homo sapiens; identical to SEQ ID NO: 41368

SEQ ID NO: 65016 - DNA, 201 bp, Homo sapiens; identical to SEQ ID NO: 41356

SEQ ID NO: 65017 - DNA, 201 bp, Homo sapiens; identical to SEQ ID NO: 41369

SEQ ID NO: 65018 - DNA, 201 bp, Homo sapiens; identical to SEQ ID NO: 41347

SEQ ID NO: 65019 - DNA, 201 bp, Homo sapiens
ctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttga

SEQ ID NO: 65020 - DNA, 201 bp, Homo sapiens; identical to SEQ ID NO: 41349

SEQ ID NO: 65021 - DNA, 201 bp, Homo sapiens
gctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgcagacg

SEQ ID NO: 65022 - DNA, 201 bp, Homo sapiens; identical to SEQ ID NO: 41350

SEQ ID NO: 65023 - DNA, 201 bp, Homo sapiens
cacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggcc

SEQ ID NO: 65024 - DNA, 201 bp, Homo sapiens
tctaagcacaccgtcccctcctgcttctctggccctggcccccatcaccttcacactccctcaggctgccctttcttccccctctccccttttctcaccaycccctgccctcacccatatccttgacctctctggcttcctggctcaaagtgcctctggctgtctctctccagctttggcctatggtatcggggtaaagct

SEQ ID NO: 65025 - DNA, 201 bp, Homo sapiens
tgtaccgagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccagga

SEQ ID NO: 65026 - DNA, 201 bp, Homo sapiens
gggtttaggaggtggccaagggtgatagggacaggaaacctggaaccaactggtcttgtggtacttaggggaactaggggtgggaataagggactttgggktagcctaatggtgctcggggacagcctcaagataacttctttgctcaccaaggtctcccaccacccccctatctcggcctgccatgcagagtctgagaac

SEQ ID NO: 65027 - DNA, 201 bp, Homo sapiens
cctctgggcctcagttcctcaggtgcttgctagctccattagaagatctgggctgcttcccccacctcaaaccagcctcgcccctccagtcccctcccccrtctcacacatgcagagcctcatgcattattgatctcccggtggagccaggatggccagggccagtgccaagggtgcctgtgggcactgctgcaggacctg

SEQ ID NO: 65028 - DNA, 201 bp, Homo sapiens
tgcagtgagccgagatcacgccattccactctagcctgggcaacaagagcaaaactccgtctcaaaaaaaaaatgaatggtgttcttgttcttgttctttytccccgcagagctctctgagtgtcaggggaagctccaggaactacacaggctcctccagagcctggagtccctgcaccgaatcccctcagcccctgttat

SEQ ID NO: 65029 - DNA, 201 bp, Homo sapiens
ctgcagcgcagcttctgggccctggcccagaagggtaagtgcctgctgggaggggctggtggggagcggacaggagcgagcgaggactctgatggtctgcyccactccctgtagtgcacagctccctcagcagcgtcctggccgccctcaccatggaacgggaccaactgagggacatgcaccagggctcagagttgtcaa

SEQ ID NO: 65030 - DNA, 201 bp, Homo sapiens
aatccaattccagatatgaagtggaagaacaagttctggggcaaatccctggagattgtgcctgtgggaacagtcaacgtcagcctgcccaggtgggattmttagactctcagcagccaggccaagccacaggcaatccttcaggctggagggggcgtggccttagggacaggataaggacgggataggaaggtctggcct

SEQ ID NO: 65031 - DNA, 201 bp, Homo sapiens
ctgagggacagtgatgggctggaccgctgctctcatggtgaggggccctaggcgcagcacctccaagggtaggccccaagctggcaggtctaggaggggawaatgttacctccatccctgcctcagggagccccagtttaatgagacagcctctgcctccaaggagatccagtctacctgggccctgtctaggggagtccc

SEQ ID NO: 65032 - DNA, 201 bp, Homo sapiens
gtgttgccttccacaaccctgcagacccctgagggtgggaatagtttttcttgatctgtgacttcttagagaccaagatgtgacttgacgtaggggagcgytctgcacatgggaggatgattgacaagtctctactgatagtgtgacttggacatgagggtgaacctgccacctggcccttgagcctagaatggcatcagg

SEQ ID NO: 65033 - DNA, 201 bp, Homo sapiens
agagtctgcctgggcacatagacagacgtggatgcagggacaggagttgtgacaaagcagatactgagtgcccacacagggcaggggcctgaggagtagcrccagggaaggggtgtgctctaggaaagggttcctgcagtagggtctgtgaagttggcctggagggagaagtgtaaaccaagtagagagagagagagggtg

SEQ ID NO: 65034 - DNA, 201 bp, Homo sapiens
cggctgtcggtcatgtccatcaacaaaaaggcccagcgcattgaccttgacactgaagacaacatctaccacctcaaggtgacatccctgggaggcaggaygtgtgttggcccccaacctgacagaggcattggaacacacaggggcaggggctgagggtctgtggaactcagggtctgtctctgagtttgacaaaaagta

SEQ ID NO: 65035 - DNA, 201 bp, Homo sapiens
caggacgtgtgttggcccccaacctgacagaggcattggaacacacaggggcaggggctgagggtctgtggaactcagggtctgtctctgagtttgacaaraagtaagtttccatcctgtaaaaacagccaagggcaaacctgcacttcttggttgttgtatggacaggcacagagctaagggctcagacacctgggcgcc

SEQ ID NO: 65036 - DNA, 201 bp, Homo sapiens; identical to SEQ ID NO: 41380

SEQ ID NO: 65037 - DNA, 201 bp, Homo sapiens; identical to SEQ ID NO: 41381

SEQ ID NO: 65038 - DNA, 201 bp, Homo sapiens
gccaggaagtgtaaacagttataatggagcctgcgtcccctcactcccaggccagggctcattttactatgcctttgtcccgctctcactcctctctgcckcttctgctcagaaggtgtctgactcagcaaaagtgcccggttatgcctccctctcaagggaactgtcaggcaagcgggtgccctgcttgatccccccggc

SEQ ID NO: 65039 - DNA, 201 bp, Homo sapiens; identical to SEQ ID NO: 41382

SEQ ID NO: 65040 - DNA, 201 bp, Homo sapiens; identical to SEQ ID NO: 41383

SEQ ID NO: 65041 - DNA, 201 bp, Homo sapiens; identical to SEQ ID NO: 41384

SEQ ID NO: 65042 - DNA, 201 bp, Homo sapiens
ttccagctccttcgtccctgatcctcaagcggttccctcccgtctcagctcagcggatcccccagagtggaggaggcctctccatgaggaggggagcagcycaaggcacctgtcctctgacccaccggcagcgagtgcgcaggtgtgagtgtaagttcatgtaggagagtgtatgcgtgtgcgcctgtgccctgcttgcag

SEQ ID NO: 65043 - DNA, 201 bp, Homo sapiens
cctcagccctacctgggcttggaccgcgggagaaagtgtcttcctggctgagggacagtgatgggctggaccgctgctctcatggtgaggggccctaggcrcagcacctccaagggtaggccccaagctggcaggtctaggaggggataatgttacctccatccctgcctcagggagccccagtttaatgagacagcctct

SEQ ID NO: 65044 - DNA, 201 bp, Homo sapiens
aaaatgcctgcagcttccagctccttcgtccctgatcctcaagcggttccctcccgtctcagctcagcggatcccccagagtggaggaggcctctccatgrggaggggagcagcccaaggcacctgtcctctgacccaccggcagcgagtgcgcaggtgtgagtgtaagttcatgtaggagagtgtatgcgtgtgcgcctg

SEQ ID NO: 65045 - DNA, 201 bp, Homo sapiens
gaagtatctcctttagcccaatgtcctgccctctctgggtgggtggcacttctcagagccccaaggactgtgagggtagacaggggatggtgaggctttakggggtactgagggtccaaaaagggcatcctaggggcatgtttggtgggaggagacatgggaaaatgggggctatctcaggcctcagtttctccaagcact

SEQ ID NO: 65046 - DNA, 201 bp, Homo sapiens
aggctgaggcaggagaatcacttgaacctgggaggcagaggttgcagtgagccgagatcacgccattccactctagcctgggcaacaagagcaaaactccrtctcaaaaaaaaaatgaatggtgttcttgttcttgttctttttccccgcagagctctctgagtgtcaggggaagctccaggaactacacaggctcctcca

SEQ ID NO: 65047 - DNA, 201 bp, Homo sapiens
gtcaggagttcgaggccagcctgaccaacatagtggaaccccatctctactaaaaatacaacaaattagccaggcatggtggtgcgcacctgtaatcctarctactcgggaggctgaggcaggagaatcacttgaacctgggaggcagaggttgcagtgagccgagatcacgccattccactctagcctgggcaacaagag

SEQ ID NO: 65048 - DNA, 201 bp, Homo sapiens
gcgtactctcccgtgtaggggatggggaggcttttgttgagagggagaagtctgggcggcctggtctggggaattcagtgggtgcatggtggtgccagttagtgaggtggacaatgtgtgtgggaacacactatgtgggcttgacttccacaggagatggccaggaggctctggagtcgctggcctggagctcctccaaga

SEQ ID NO: 65049 - DNA, 201 bp, Homo sapiens; identical to SEQ ID NO: 41387

SEQ ID NO: 65050 - DNA, 201 bp, Homo sapiens
cgtactctcccgtgtaggggatggggaggcttttgttgagagggagaagtctgggcggcctggtctggggaattcagtgggtgcatggtggtgccagttagtgaggtggacaatgtgtgtgggaacacactatgtgggcttgacttccacaggagatggccaggaggctctggagtcgctggcctggagctcctccaagag

SEQ ID NO: 65051 - DNA, 201 bp, Homo sapiens; identical to SEQ ID NO: 41388

SEQ ID NO: 65052 - DNA, 201 bp, Homo sapiens
caccagggctcagagttgtcaagaatgggggtgaggcctgggggacagggtgactggtgcggggagagggcttcaagctgaggactgccagcctggggtcygatagcagatctgggtcagggtggggggttggcagaggcagtctctgcagagatgcggcaaggtggggaggacctcatcctcctggcaccgtgtccctca

SEQ ID NO: 65053 - DNA, 201 bp, Homo sapiens
gtcccgctctcactcctctctgcctcttctgctcagaaggtgtctgactcagcaaaagtgcccggttatgcctccctctcaagggaactgtcaggcaagcrggtgccctgcttgatccccccggcttggccccggagcctgacatccatctggctgctcccacagcaagaagctctgtacatgaaggggcgcgagctcacc

SEQ ID NO: 65054 - DNA, 201 bp, Homo sapiens
attcccacacggagttcttcgatgcctgcgaggttctcctctccgccagctcttctgagaatgaggtgagggaggagagaagctggcagtgaggcggggtrggggggaccttgggaacagaagggtggggtccacagagaccatagattcctcagccccttctcaccacctcagctgctatctctgggactatgtccagat

SEQ ID NO: 65055 - DNA, 201 bp, Homo sapiens
gggggataaaggtcgaggcagtttgtgtgtttgtttgtttgtttggatttgaagtgtttttggaaacatggtgaagattgacacagtacactcgtgcgtayaacagaaaataagcctccctcccatcccaacactccgaagggactactgctaccagcttttgggattcctcccagaaatgttttacgcatatgtgaacaa

SEQ ID NO: 65056 - DNA, 201 bp, Homo sapiens
cctcctggaccaggccagccgcatcgccgacccctgcgagcgcatggtacctgcttcctgtcctcacgcccagcccaaggctgcttccttctccctgggaycttttctcccagaaaatcctggctgggctgttccttattgctgaagttccaccccaagatcccatactttgcttgcttggggtggcggccccgtcctcag

SEQ ID NO: 65057 - DNA, 201 bp, Homo sapiens
gtgaacctgccacctggcccttgagcctagaatggcatcagggagatggtggctctatggctctgagagcctaaaacaggtcccctctccctctaccaacrcttcacccccagatcaccaaggggaagctccatggctccatcgatgtccggctgtcggtcatgtccatcaacaaaaaggcccagcgcattgaccttgaca

SEQ ID NO: 65058 - DNA, 201 bp, Homo sapiens
agggagaagtctgggcggcctggtctggggaattcagtgggtgcatggtggtgccagttagtgaggtggacaatgtgtgtgggaacacactatgtgggctygacttccacaggagatggccaggaggctctggagtcgctggcctggagctcctccaagagcaccaggtggcactaacaggtcaaagagtggccagcttag

SEQ ID NO: 65059 - DNA, 201 bp, Homo sapiens
aacagaaaataagcctccctcccatcccaacactccgaagggactactgctaccagcttttgggattcctcccagaaatgttttacgcatatgtgaacaaygaagtgtgtgtctagaagagaaagatttactattttttaaggtggaagaaacagacaatctttatattcagagagaaagagaaataaagagggaaagact

SEQ ID NO: 65060 - DNA, 201 bp, Homo sapiens; identical to SEQ ID NO: 41395

SEQ ID NO: 65061 - DNA, 201 bp, Homo sapiens
tatattcagagagaaagagaaataaagagggaaagactgaaggtgcagaaggaggaggagtgggcagcctggggggcatcagtgggagcaggctgactgcygccagacagaaggaatcgcccccctgacccacttctgttctgccacagactgtgggaggcgaatgaggttcgaagggcctggcttgtgcctgggtcctca

SEQ ID NO: 65062 - DNA, 201 bp, Homo sapiens
tgtgggatgttggaattgaaggctccagatgtggagccattccaagtgggaacaaggccaagtgtttccaagggtgtggggtggaggttgcagggcgatgrtcagctttggggtggggtggggggagatggtggggaagagggtcatcagcaagggctgggtttcaggcagggcatggggtggaggccccacccatcactg

SEQ ID NO: 65063 - DNA, 201 bp, Homo sapiens
agagggacccgcccttcctgcctgagagcgctcagtcctcaaagcccagcagtgctcagcaggtcagagagtgggaaagcggtggtgggtgggccaagctkgaaccagacagggaggggccaaggcggacgtctcaccagtgctcccctccctctgtcctggactgcaggcctctgagctgtgggaggtggtggaggagcc

SEQ ID NO: 65064 - DNA, 201 bp, Homo sapiens
tttaggaggtggccaagggtgatagggacaggaaacctggaaccaactggtcttgtggtacttaggggaactaggggtgggaataagggactttggggtascctaatggtgctcggggacagcctcaagataacttctttgctcaccaaggtctcccaccacccccctatctcggcctgccatgcagagtctgagaacttc

SEQ ID NO: 65065 - DNA, 201 bp, Homo sapiens; identical to SEQ ID NO: 41398

SEQ ID NO: 65066 - DNA, 201 bp, Homo sapiens
agcagcaaaaagacttgacacttcagagccttgagcctgcttgcctgtgacatgacagtaagaagtaatacccaagagaggtgaggattaagcaggataayggatgtgaacgtacacacggttcctggtgcccaggggcaggacactttgtgtattttcatccctgttgctcaggcactcaggggctttgtagatgagtgg

SEQ ID NO: 65067 - DNA, 201 bp, Homo sapiens
ccgtcctcagtaccctgcaccttccttgccccccacaggtgtacatcgcagcctttgctgtctcggcctactcctccacataccaccgagccggctgcaarcccttcaaccctgtcctgggggagacctacgagtgtgagcggcctgaccgaggcttccgcttcatcagtgagcaggtatggccttgggagaagagggctg

SEQ ID NO: 65068 - DNA, 201 bp, Homo sapiens
tggagcagggcaggtgtgggaggcagcaccttaggaccctagcctgccttctagatgttcacccctcactgccaccgccttctcccaccaggcggcagacrgatagcagcgggaaagagtggtgggtgaccaacaatacctactggaggctgcgggccgagccaggctatgggaacatggatggggccgtgctctggtagc

SEQ ID NO: 65069 - DNA, 201 bp, Homo sapiens
gtactctcccgtgtaggggatggggaggcttttgttgagagggagaagtctgggcggcctggtctggggaattcagtgggtgcatggtggtgccagttagtgaggtggacaatgtgtgtgggaacacactatgtgggcttgacttccacaggagatggccaggaggctctggagtcgctggcctggagctcctccaagagc

SEQ ID NO: 65070 - DNA, 201 bp, Homo sapiens
tactctcccgtgtaggggatggggaggcttttgttgagagggagaagtctgggcggcctggtctggggaattcagtgggtgcatggtggtgccagttagtgaggtggacaatgtgtgtgggaacacactatgtgggcttgacttccacaggagatggccaggaggctctggagtcgctggcctggagctcctccaagagca

SEQ ID NO: 65071 - DNA, 201 bp, Homo sapiens
gggaggcggaggtagtggtgagctgagattgcaccactgcactgcactccagcctgcctgggcaacagagcaagactctgtctcaaaaaaaaaaaaaaaagaaaagaaaagaaaagaaaagaaaatagtgatgcaagcagcaaaaagacttgacacttcagagccttgagcctgcttgcctgtgacatgacagtaagaagt

SEQ ID NO: 65072 - DNA, 201 bp, Homo sapiens
gcagcgagtgcgcaggtgtgagtgtaagttcatgtaggagagtgtatgcgtgtgcgcctgtgccctgcttgcaggcaagcagggctccctcatgtagcccsgccttccccctgctgggggtccaccacatcgctgctctttctcacagtctgcctctgatgagggcgaattgctatgacattccaagctccaataaagact

SEQ ID NO: 65073 - DNA, 201 bp, Homo sapiens
gggtgccggcctagaaccatctagttcactccctccacagagtacagagctggggctttgtccttccttcactgagtggcctcagagaagtggggcttgtytagaggacagagttgggcagagacagaggccttgggtttgggggcccctgcagatgggcagttcccctgagtttgatctggatcctcaggtacctggagg

SEQ ID NO: 65074 - DNA, 201 bp, Homo sapiens
ggaccgcgggagaaagtgtcttcctggctgagggacagtgatgggctggaccgctgctctcatggtgaggggccctaggcgcagcacctccaagggtaggscccaagctggcaggtctaggaggggataatgttacctccatccctgcctcagggagccccagtttaatgagacagcctctgcctccaaggagatccagtc

SEQ ID NO: 65075 - DNA, 201 bp, Homo sapiens; identical to SEQ ID NO: 41409

SEQ ID NO: 65076 - DNA, 201 bp, Homo sapiens; identical to SEQ ID NO: 41410

SEQ ID NO: 65077 - DNA, 201 bp, Homo sapiens
tcccttgtggtgactgatgggctagtggctttggatgctgaccccaggagctaaggaaggccaggtcatgaactgggaaatgttccaggagcagctctgcyggggtgggccaggctcaggccttggggctggcctctgttgcagcaggcttgcctagggccttggagggaggcaagagatcccactttgctgcttgttagc

SEQ ID NO: 65078 - DNA, 201 bp, Homo sapiens
ggtcttgaactcctgacctcaggcaatccacccacctcgacctcccaaagtgctgggattacagtgagccacctcgcccagcctcttttttttttttttttatgacatagggtcttgctctgtcacccaggctgaagtgcagtggcataatcatggcacactgcagcctcgacctcctgggctcgagcgatcctcctgcct

SEQ ID NO: 65079 - DNA, 201 bp, Homo sapiens
ctcctttctcaaccattcctgcccacaacaccccagcttgctgccagcaaagcccctccacacccctcaaactccagacccttcacatcaatttactgttktcttcgacctcaccccagcaattttctctgaatcaaccccctttcctcctctcctaagtctctgagtttctctctcctcctgccatcctgagttctgcca

SEQ ID NO: 65080 - DNA, 201 bp, Homo sapiens
ttctgctcagaacgaggtgaccctgctttccaaggttttcagcctccccagagcccacctctgccctgtgggacatgagggaagctaaggtggcagtggcrtccggggaggggagccccaagttcagatcaacatctgggccagagccaggtgtcagtcctgggccccagcctcaggctccttcccacaagggacaagggg

SEQ ID NO: 65081 - DNA, 201 bp, Homo sapiens
ggcagtggcgtccggggaggggagccccaagttcagatcaacatctgggccagagccaggtgtcagtcctgggccccagcctcaggctccttcccacaagrgacaaggggccagccagagacttccctgagcccagggaccctcctgctgagcccagggctccacccaccctgtaccctccacccccggcccctcccaggc

SEQ ID NO: 65082 - DNA, 201 bp, Homo sapiens
ccaccacacccggctaattttttttgtatttttagtagagatggggtttcaccatgttagccaggctggtcttgaactcctgacctcaggcaatccacccrcctcgacctcccaaagtgctgggattacagtgagccacctcgcccagcctcttttttttttttttttatgacatagggtcttgctctgtcacccaggctg

SEQ ID NO: 65083 - DNA, 201 bp, Homo sapiens
tacaggtgtgcgccaccacacccggctaattttttttgtatttttagtagagatggggtttcaccatgttagccaggctggtcttgaactcctgacctcargcaatccacccacctcgacctcccaaagtgctgggattacagtgagccacctcgcccagcctcttttttttttttttttatgacatagggtcttgctctg

SEQ ID NO: 65084 - DNA, 201 bp, Homo sapiens
tgtctcatctgaaaggagccaaccaggtcatcctgcccattccctggtgttcaggcaggcagaccttcatttaaaccattcccagacgaatgacatagggycctgaattgaaaaactaattccctcaaaatagatcctgaacatgacctgtgctccttccactgttctttaggcacttctcttgatctagaagttcttttt

SEQ ID NO: 65085 - DNA, 201 bp, Homo sapiens
gcctgtggtggagcgctggatttcggatgaggaggatgaagcctcaagcgatgaggagttcccagagctgagtggcccattctgctcagaacgaggtgacmctgctttccaaggttttcagcctccccagagcccacctctgccctgtgggacatgagggaagctaaggtggcagtggcgtccggggaggggagccccaag

SEQ ID NO: 65086 - DNA, 201 bp, Homo sapiens
acttcggtttcttcttgcagaataagatccagcaaattgagaacctggcttgcatcccctccttgcggtatgtggtgccagggctcaggcaggggaagagrggttgggggaacctagccatatcccaaagaactggttcagatttctccaagcctgggtccttgtcagtcaaggaccagcaagcctagatctactccctca

SEQ ID NO: 65087 - DNA, 201 bp, Homo sapiens
gggtcctgtccatgacaccttctcccccacctcctacctagctcatgagccaccacccctccgggtgtgagtgctgtggtgcgtgtctttgcatcctccaygccagggtgccctcctgggtaacctctgctccttctgctctgcagcgagctggtgacagaagccctgccacttctcctggacctggacgggcagcctgtg

SEQ ID NO: 65088 - DNA, 201 bp, Homo sapiens
tgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggaggtgagtagggaggtgggacggtgggtagagcagttggaaaacagcgg

SEQ ID NO: 65089 - DNA, 201 bp, Homo sapiens
tcattcccaaagtgccagatctccagctgcagagtagacatggtcttggggctttgtccccgtaaagggcccctgacgcatctgatctcagcttggtttcyccacttcggtttcttcttgcagaataagatccagcaaattgagaacctggcttgcatcccctccttgcggtatgtggtgccagggctcaggcaggggaag

SEQ ID NO: 65090 - DNA, 201 bp, Homo sapiens
ggcataatcatggcacactgcagcctcgacctcctgggctcgagcgatcctcctgcctcggcctcccaaagtgctgggagtacagggtaagccaccatggycagcctgccctgcttctttattagtggtgggcagagactctgtcatttgtctctagtaggcactcagcaatgttgtggaatgaatgaatgggtggatgga

SEQ ID NO: 65091 - DNA, 201 bp, Homo sapiens; identical to SEQ ID NO: 26189

SEQ ID NO: 65092 - DNA, 201 bp, Homo sapiens
tggcccaagagcctcctccttcccagccacttgctgggccaagcacctcctcccaaaatctgagtgtcaccgggcaagtcactcaccaccttgagcctccrccgcctgtgggacaggctttcgtagtgagggctatggagaatgtctgaagggcccagctcctaggaaacgcagcaaaatgttctctcgctgcactcactt

SEQ ID NO: 65093 - DNA, 201 bp, Homo sapiens
cttctggcccaggtcatagcatttcttctgagccgccctcccctgacttgctggttcactcctccttactcttcccttgtgatcttggatctcagctctgycaccacctcctctaggaagtctcccctgattttcctggcttgggtcttcctgtgcggctctgcactcccacactggactgtgattttctgtaccctctca

SEQ ID NO: 65094 - DNA, 201 bp, Homo sapiens; identical to SEQ ID NO: 26181

SEQ ID NO: 65095 - DNA, 201 bp, Homo sapiens
cctcccggtgtagggctctgaaccccgggtcactcaaagccactctcgttctgcaggtctcagcgctccgtcccccaccaacccgttcggcgcgggcgagmcgggcaggccgacgctaaaccagatgcgcaccggctcgccggcgctgggcctggcaggcgggcctgtgggggcgcccctgggctccatgacctacagcgc

SEQ ID NO: 65096 - DNA, 201 bp, Homo sapiens; identical to SEQ ID NO: 26220

SEQ ID NO: 65097 - DNA, 201 bp, Homo sapiens
ttggcccacgggggcctcaacggccgttgttcccctcctctcagttctcttgagcctcagcttcctggcaggcagaggggtgtgggagccgatgggtaatygtgtggtcacagagacatgatggtcattgcagcctcctcttcgtcaccccgctatacctccgacctggagcaggcccggcctcagacgtcaggggaagag

SEQ ID NO: 65098 - DNA, 201 bp, Homo sapiens
ccctacctacctcacagggttgttatgaaaatcaggtactctgtggatgaagaaacattataaactgtaaagcactgtgcagaggtgagggatcatgaatrggtatctgtggaatgaataaagagaatgaactggcattagcctgacaggtcagggcctgccctccctccaggccccgcccacttctgagccgcggctgcc

SEQ ID NO: 65099 - DNA, 201 bp, Homo sapiens
tcacctacctccattgtttgatctgagaatgaaatgagaccaggttcaggaacgtcctctaccctgcacccagacacatggcattccccttcatccccctwcctgagggcagcggctagacagtccctgactctcctgcccccagtcatgggggcttccaggatctgaggaatactcagaatggcccgccttccataaagc

SEQ ID NO: 65100 - DNA, 201 bp, Homo sapiens; identical to SEQ ID NO: 26226

SEQ ID NO: 65101 - DNA, 201 bp, Homo sapiens
tctgactcccatgctctcctcctctgagccctggggcaggaccccagtgctgcctgctgggccccccaccacagacccctgggccctgaactctccccacyacaaactccccagcactggggctgacccttggggagcctccctggagacctccgacacacctggtaagaagagggccagagagtgtgagtgaggagctgg

SEQ ID NO: 65102 - DNA, 201 bp, Homo sapiens
ccttagcagaggacgggaagagggtgtgggctgggctggtgggtgcacagactttacgcaaactcatgcacgtgtgactggacagatctgggttctctccrtctctccgaaacccttgctggggatgagcgatctgcatttttcggtcctgacttttgggaaactctccagatccccccatcctgcaggccctgagaagag

SEQ ID NO: 65103 - DNA, 201 bp, Homo sapiens
ctgaactctccccaccacaaactccccagcactggggctgacccttggggagcctccctggagacctccgacacacctggtaagaagagggccagagagtrtgagtgaggagctgggggacttccaggcagggccaaggggcagcagatactgtttgtgttaggaggacagcttctctggaaaggggtcagaccaacacct

SEQ ID NO: 65104 - DNA, 201 bp, Homo sapiens; identical to SEQ ID NO: 26228

SEQ ID NO: 65105 - DNA, 201 bp, Homo sapiens
agtcactcaccaccttgagcctccgccgcctgtgggacaggctttcgtagtgagggctatggagaatgtctgaagggcccagctcctaggaaacgcagcaraatgttctctcgctgcactcacttgctcagcacgcctgggaaggtggcctgagtcgcccacacctgcaggtcccagttcctggggtcacttgtcaaatag

SEQ ID NO: 65106 - DNA, 201 bp, Homo sapiens
tcactcaccaccttgagcctccgccgcctgtgggacaggctttcgtagtgagggctatggagaatgtctgaagggcccagctcctaggaaacgcagcaaaatgttctctcgctgcactcacttgctcagcacgcctgggaaggtggcctgagtcgcccacacctgcaggtcccagttcctggggtcacttgtcaaataggg

SEQ ID NO: 65107 - DNA, 201 bp, Homo sapiens
ctaaggagggactggagccgcccctccatccgggatgggttgggatggggaacttacagagtgcctggcacactgcttggcccacgggggcctcaacggccgttgttcccctcctctcagttctcttgagcctcagcttcctggcaggcagaggggtgtgggagccgatgggtaatcgtgtggtcacagagacatgatggt

SEQ ID NO: 65108 - DNA, 201 bp, Homo sapiens
actctcagaggattcagaagcgaaagatcagtcttcctgacctttaaactgcatttcagatgcaggcagggagaaggccacgcccaccctgctgactgagsggcaaatggcccatgcacactgagggtgggcattagtgtctccatccccatgacccaggcaggcctatactgcccttctggtcccaaggtgggggtacag

SEQ ID NO: 65109 - DNA, 201 bp, Homo sapiens; identical to SEQ ID NO: 26176

SEQ ID NO: 65110 - DNA, 201 bp, Homo sapiens
tgctaaggagggactggagccgcccctccatccgggatgggttgggatggggaacttacagagtgcctggcacactgcttggcccacgggggcctcaacgrccgttgttcccctcctctcagttctcttgagcctcagcttcctggcaggcagaggggtgtgggagccgatgggtaatcgtgtggtcacagagacatgatg

SEQ ID NO: 65111 - DNA, 201 bp, Homo sapiens
cgaggggtgttatgaagattcagacataaggaatgtaacacgcaaggcgcaacacccggcacataggaggtgctcaacaagttagctcagataataacgtygttatagattcattatcattcgttagctgcctgataggatggcgcgatagtggaagcatgggtttggagtcagatagcattctatattctgcttcctcca

SEQ ID NO: 65112 - DNA, 201 bp, Homo sapiens
ctgcgcttcctcctgtgtcctgttactgctgaggcagacctgccgggccagctgagcaactttcctcggagtgctgcctggcgctggctaggaggcaaacrcacgcgggaagagctgctacccattccagggaccctgccgctgcccctctgaggggtctgcacctcctgggagcaggtgggtctctgggacgagggtcca

SEQ ID NO: 65113 - DNA, 201 bp, Homo sapiens
ctccctggccccctccctggcagtggcggcatggaaggcgggggttggtggggagcaaacagtggttctggggcttagtctcttttccaggtgcgagggaraaggctgagctgtagaggacctaaaggcttctttcctgccacccctccctccctgccgcccccaaaaagggactcagggccccctccccaaccatcctgg

SEQ ID NO: 65114 - DNA, 201 bp, Homo sapiens
ggaggtgaaggcaggtctgagtcactagcaagggggagggcaggagttaaacaagttgtggccgtggcattcccacagaaggcccacgacccgctggaagraaagagatagcagacaaaaggtaggctgcgctgtgggccaggcactctccacctcgcccactcccacggtatcttattctctgggcccccaacaaaacct

SEQ ID NO: 65115 - DNA, 201 bp, Homo sapiens
gggctccagcctgctgggtggtcctgaggctgcaggccatctgtgacatggatcttctgcctcccaacttgggctgggtaactgggaagggccctgggcgrgggataagggtgggcctgggatcatgtctatgctgttcccatttcaggttttaggccgaacacagaggccagtggatcctcctgggggccttctgcagac

SEQ ID NO: 65116 - DNA, 201 bp, Homo sapiens
gtttctggccccgcccttccccccagcccctgcaggggtgtgcagagaatgcccaccttctgtgagaaaggtccaggcagggccgctgggcccacaccgasagtcccctcccagaggctggtgcccccacacaggccaggccggagggccagggcagccaggtccaggtagggctctggtgcagtcacagtgcccgactgg

SEQ ID NO: 65117 - DNA, 201 bp, Homo sapiens; identical to SEQ ID NO: 26211

SEQ ID NO: 65118 - DNA, 201 bp, Homo sapiens
aggcagacctgccgggccagctgagcaactttcctcggagtgctgcctggcgctggctaggaggcaaacgcacgcgggaagagctgctacccattccaggraccctgccgctgcccctctgaggggtctgcacctcctgggagcaggtgggtctctgggacgagggtccatggtggatggctctggagacgctcccgaggc

SEQ ID NO: 65119 - DNA, 201 bp, Homo sapiens
tgcgtcgacacccctcctgcctgaagtggaagcctatctccaactcctcgtggtcatcttcatgatgaacagcaagcgctacaaagaggtatccaggatgyagtgagagcgattcataagccccaagtgatgcaaggggtttggcggggagatggtccctggtgaagaaatggaaataatcattgattcttaagaactgtc

SEQ ID NO: 65120 - DNA, 201 bp, Homo sapiens
tggcctcaagcattctcctgcctcagccttccaggtagctggcactaccggcgtgagccaccacacccagctcctccttgatttctttgggaaagactgtmatctttatttttttatccctagcacctaacaaaatcttggcacatggtagacactcaataaatatgttgaaatacatagtggatgctcaataaattcttg

SEQ ID NO: 65121 - DNA, 201 bp, Homo sapiens
cctagctagtgaatagagactagacaccaagtgttctacgtgcagactttatactgctcagcctggcacacaaaatggcaatggcatagtccccagactgyggtcccaactgtctctttcctaacagctccccaggcacccacacttttctgcctctttttcaatctgtacccttgaccctcctcctttttctgctttgtc

SEQ ID NO: 65122 - DNA, 201 bp, Homo sapiens
gacctcccccagggctcctccccagccggtgacttactgtacagcaggcaggagggtgggcaggcaacctccccgggcagggtcctggccagcagtgtggsagcaggaggggaaggatagttctgtgtactcctttagggagtgggggactagaactgggatgtcttggcttgtatgttttttgaagcttcgattatgatt

SEQ ID NO: 65123 - DNA, 201 bp, Homo sapiens
tgagttattccagtggacagggcagcctcatgggtgcctgtggagggtgaagggtctgcctggccgtaggtgtgatcacacactcccgttgtaacccctgyctcctgtgacacttgctgccccacgatttagctgctttgtgttccgtgcctcctgtttgctggtgaactcctgagttggggggcgtcattccctccactg

SEQ ID NO: 65124 - DNA, 201 bp, Homo sapiens
tactaaaaatacaaaaaatttagccaggcgtggtggcgggtgcctgtagtcccagctactcgggaggctgaggcaggagaatggtgtgaacccagcaggcrgagcttgcagtgagccgagatcacaccactgcactccggcctgggcgacagagtgagactccgtctcaaaaaaaaaaaaaaaaaaaaaaagaactccttg

SEQ ID NO: 65125 - DNA, 201 bp, Homo sapiens
gcacaatgatctgcatatagtaagctttcgtgatattttcataaatggtagctgttattatggactaatagctccatttgcaaactgcacttctaccactccccagctagggccagcttctttgttcatcatagccactgtcacaggagcatactcaggaagtaagttgcactccttaattccctggtttgtttcctttcc

SEQ ID NO: 65126 - DNA, 201 bp, Homo sapiens; identical to SEQ ID NO: 42163

SEQ ID NO: 65127 - DNA, 201 bp, Homo sapiens
aaattgatttcatcacaattctggaggctctaagtccaagagcaaagtgtgacacgattggtttcttctgagggcctctctcgtctgcttgtcgatggccrtctcctggtgttttcacatggtcttccctctgtgcgtgtctgtgtcctgcttttgtcttagaaggacaatagtcatgtaggattagggtccacccatatg

SEQ ID NO: 65128 - DNA, 201 bp, Homo sapiens
cacactccttcctctctcttctagccttggcccatcacctgtttgcttcagtctccgggaagaaaacccccagccctgctgcttcctctctcaggcggcckattcctgtctcccctggctccctccccaacagtgcactggccagccccttccctccagtgttctctctgctccttctcaccacctgggcctcagcagagc

SEQ ID NO: 65129 - DNA, 201 bp, Homo sapiens
atagttaacagtattcagcaaataaccagaaaagcaatttgtataacttttttaaggaattgagaaagagcgaagagttaaaggcagttcagagagttgtsatttgaaggctttgacatctttctttccttcttgaagcttcttgcatgctcggctccggacagctacgcttcggcatgacgcagacgggcaggccaccct

SEQ ID NO: 65130 - DNA, 201 bp, Homo sapiens
ggggtggtgcataagaggcccatttggcaccctggcttgtcggtggggagttggatgaccctactctgttgaccaactctcctctcctccactcccagggsgaatcaaagccatccagctggagtactcagaggcccggagaacgatgaccaacgcccttcgcaaggcccctcagcacacagctgtcggcttcaaacagac

SEQ ID NO: 65131 - DNA, 201 bp, Homo sapiens
tgttgaaatacatagtggatgctcaataaattcttggttacttgatcagactgagcttttccatggtaacttctgtcctctcctagcccatggacacagakgctgatttacagttccgtccccgcacgggaaaagctgcgtcgacacccctcctgcctgaagtggaagcctatctccaactcctcgtggtcatcttcatga

SEQ ID NO: 65132 - DNA, 201 bp, Homo sapiens
catcacactccttcctctctcttctagccttggcccatcacctgtttgcttcagtctccgggaagaaaacccccagccctgctgcttcctctctcaggcgsccgattcctgtctcccctggctccctccccaacagtgcactggccagccccttccctccagtgttctctctgctccttctcaccacctgggcctcagcag

SEQ ID NO: 65133 - DNA, 201 bp, Homo sapiens
ccatcacactccttcctctctcttctagccttggcccatcacctgtttgcttcagtctccgggaagaaaacccccagccctgctgcttcctctctcaggckgccgattcctgtctcccctggctccctccccaacagtgcactggccagccccttccctccagtgttctctctgctccttctcaccacctgggcctcagca

SEQ ID NO: 65134 - DNA, 201 bp, Homo sapiens
cacccgagagccccagctagccttccaccagcgcatctccttctgcctagatatccacaacatgtctgtcaaggtgagaagcccgtggctgcagagtcacrcctggcagcagcacacccctccctccacactcatggattcctcagagaagactggcttaatttgtggcccacgtcccagccaatctctgtaaaatcactg

SEQ ID NO: 65135 - DNA, 201 bp, Homo sapiens
gctatgttacctgggctggtcttgaactcctgggttcaagaagtcctcccacctcagcttcccaaagtgctgggatcacaggtatgagccaccatgcctgrcccctttgcctgttactcattccctaccacttcagttctcttctctatgctaggggctaggaaaggcatccttaaccttcctatccagaaggacttcaac

SEQ ID NO: 65136 - DNA, 201 bp, Homo sapiens
ctctgcaaaaattaaaaacctagctgggcgtgatggcatgcacctgtagtcccagctacttgggaggctgaggtgcaaggatcacttgggcccaggaagtygaggctgcagtgagccatgatcgtgccactgcactgcagcctgggcgacagagcaagactctgtctcaaaaaaaaacaaacattaaaattgaactggtct

SEQ ID NO: 65137 - DNA, 201 bp, Homo sapiens
tttccatggtaacttctgtcctctcctagcccatggacacagaggctgatttacagttccgtccccgcacgggaaaagctgcgtcgacacccctcctgccygaagtggaagcctatctccaactcctcgtggtcatcttcatgatgaacagcaagcgctacaaagaggtatccaggatgcagtgagagcgattcataagcc

SEQ ID NO: 65138 - DNA, 201 bp, Homo sapiens
gccacagcagcctccaccaccctcagttctttgggatcacccccagatacctgcttccactggccgacactccgattcaggcccaatgactgaaccttctytccaggctgggaaacactcccctcccatcccctccatccccatatctggggttgcatctatatctaggtcccagtgggcctggggactccctcttttaag

SEQ ID NO: 65139 - DNA, 201 bp, Homo sapiens
gcgtcgacacccctcctgcctgaagtggaagcctatctccaactcctcgtggtcatcttcatgatgaacagcaagcgctacaaagaggtatccaggatgcrgtgagagcgattcataagccccaagtgatgcaaggggtttggcggggagatggtccctggtgaagaaatggaaataatcattgattcttaagaactgtcc

SEQ ID NO: 65140 - DNA, 201 bp, Homo sapiens
ccacgatttagctgctttgtgttccgtgcctcctgtttgctggtgaactcctgagttggggggcgtcattccctccactgtagttcttccgcgatgctgamtccacccacggtcagcaccactcggaaatacttcacagtcctgtagaggaagacaggtccaggtttccagttacccttctatgtctggatactctgctca

SEQ ID NO: 65141 - DNA, 201 bp, Homo sapiens
taacactaactctgacccctctcacgagcatcaggcctgcagatccagctccccctcccactccccatgtctctctctacagcgtgtcccaaagagacccytcctggcccccttaccattccttcctcctgctttcccgatccagatcagggccttgggatcatctctgactctcccccatcctccttcccatcacttggt

SEQ ID NO: 65142 - DNA, 201 bp, Homo sapiens
cagcaggacttggagtttgccaaggagatggcagaagatgatgatgacagcttcccttgagctggggggctggggaggggtagggggaatggggacaggcwctttcccccttgggggtcccctgcccagggcactgtccccattttcccacacacagctcatatgctgcattcgtgcagggggtgggggtgctgggagcca

SEQ ID NO: 65143 - DNA, 201 bp, Homo sapiens
ctgttattatggactaatagctccatttgcaaactgcacttctaccactccccagctagggccagcttctttgttcatcatagccactgtcacaggagcaractcaggaagtaagttgcactccttaattccctggtttgtttcctttccttaccacactatttttggttgttgtttggttgggggtttttttgagattgg

SEQ ID NO: 65144 - DNA, 201 bp, Homo sapiens
gctgagtaatattccctcgtgtggatgtgccacattttgtttatctgttcatcagctgacgggcacctgggttgtttctactctttggttatgaataatgyttctgtgaacattcgtgtacatgcttttatgtgagcctaagtttccagttctcttggcttgcatacctaggataggaattgctggctcaaatgacaactc

SEQ ID NO: 65145 - DNA, 201 bp, Homo sapiens
tatttgtgggtgtcaatgaagcagacactacctgcacctctggcagtggatattcagagtgttcctggcagataggtttagaatattcctgattccccagmgctcctgacagtcattccaggcttggacctagattgtgttgatacaaaccccaggtttttatctagtccttcatgttcacatttggaaactgtattgtct

SEQ ID NO: 65146 - DNA, 201 bp, Homo sapiens
tccgttactctgctggcactgccaccgcaaggtcccacagacttggcggcttaaacaaccgaaattgatttcatcacaattctggaggctctaagtccaasagcaaagtgtgacacgattggtttcttctgagggcctctctcgtctgcttgtcgatggccgtctcctggtgttttcacatggtcttccctctgtgcgtgt

SEQ ID NO: 65147 - DNA, 201 bp, Homo sapiens
ccataacactaactctgacccctctcacgagcatcaggcctgcagatccagctccccctcccactccccatgtctctctctacagcgtgtcccaaagagayccttcctggcccccttaccattccttcctcctgctttcccgatccagatcagggccttgggatcatctctgactctcccccatcctccttcccatcactt

SEQ ID NO: 65148 - DNA, 201 bp, Homo sapiens; identical to SEQ ID NO: 42171

SEQ ID NO: 65149 - DNA, 201 bp, Homo sapiens
gtaacacattattttttccagtgtcagtgacaacataggaaaatatgttttgtttatatgttgactttccctaaattttctttgttcccacaagaaaccaktttttggtctcattattctgatttcatctctagaattatttcgttcagccctgtccagtagtatttgcagtggatccaggtgtggtggtttaatgtctcc

SEQ ID NO: 65150 - DNA, 201 bp, Homo sapiens
gtcagctccgtggatggggaaactcagaacatccctggaggcagggcagtgaagagtttcttgtctgggaaaggggaaaagcgtactgttcccccaactcyaccttgaatattttctgaccttcacatcgctaaactcacgaaacgtgattattttgggggtgactgtaacacattattttttccagtgtcagtgacaaca

SEQ ID NO: 65151 - DNA, 201 bp, Homo sapiens
gtgcctagcacataaatatcagctgttattatttatatcattagtgtggcccagataccctgtgctaatcgctgaatatacagaagtgcctaagaaactaytcattgattgcattcccttattgctttgcatttaaactgtttctagtttcttgctatcataaatagctttgaagcaatcatctttgtgcccaacttaaaa

SEQ ID NO: 65152 - DNA, 201 bp, Homo sapiens
gcctactgggtgtgtttattacaggcacttcattttcttcttgtaaagtaattcatattcattgcagaaattgtggaatgtatgagaagttaaaagcaggrgataaaaaacatggttaacattttttcttgtgaatttttgagctgttctcctataattgagagcaagttatgtatacagtttgtatcaaggcataactaa

SEQ ID NO: 65153 - DNA, 201 bp, Homo sapiens
tgcatcatccaatctactcctgttctgcctgcagctgtcaggacaggaaacctagccaagttcaaccaggtcctggatcagtttggggagaagtttcaagyagatgggacctacaccctaattatccggctgcggcacaacgtgattaagacaggtgtggatcaggatctgaggggctgttggaggagcagaagccaggcc

SEQ ID NO: 65154 - DNA, 201 bp, Homo sapiens
tagagcactgtcatttcagagcagactacgcgcggggtggccaggtgaaatgcagctgacggctctgcgaccaaatgtgaccaaagggccacattcccagyacccggctccaaaggcagagcttggattctatgcccagcacaggttttcagggcttcctcctctctctgggcctaaacagtgatccctttccctgtttcc

SEQ ID NO: 65155 - DNA, 201 bp, Homo sapiens
ctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgt

SEQ ID NO: 65156 - DNA, 201 bp, Homo sapiens
agggctatgtccaatccaaggagatgattgacatctattccacccgagagccccagctagccttccaccagcgcatctccttctgcctagatatccacaayatgtctgtcaaggtgagaagcccgtggctgcagagtcacgcctggcagcagcacacccctccctccacactcatggattcctcagagaagactggcttaa

SEQ ID NO: 65157 - DNA, 201 bp, Homo sapiens
taactggagaggggcccgccgcttcctgcctggtgtctagctcacagaggggacgcagggagtgcaggttgcgtgagtgcctcacctgcttccttccctcsctcatctcctctctttgctgtgccccaggccatgaggtttcctcccaaatcgtacaacaaggacttggagtctgcagaggtaagctctctgctttctggg

SEQ ID NO: 65158 - DNA, 201 bp, Homo sapiens
ctccaggcctgtgagccctggtccctcgctgttgctgagccacagcacccgcccttctggcctcactttagagcactgtcatttcagagcagactacgcgyggggtggccaggtgaaatgcagctgacggctctgcgaccaaatgtgaccaaagggccacattcccagtacccggctccaaaggcagagcttggattctat

SEQ ID NO: 65159 - DNA, 201 bp, Homo sapiens
aggcaggagaatcgcttgaacccgggaggttaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccatccgggatggtgtcattgaggccagcatcaaccac

SEQ ID NO: 65160 - DNA, 201 bp, Homo sapiens
ataggaagggaggataataagtgatctttctttcttttctttcgttttttgttttctgagacagagtctccctctgtcactcaggctggagtgcaatggcrcgatcttttctcactgcaacctctgcctcccgagttcaagtgattctcctgcctcagcttcctcagtagctgggcaggcgcctgccaccacatccaacta

SEQ ID NO: 65161 - DNA, 201 bp, Homo sapiens
gcctgggcgacagagtgagactccgtctcaaaaaaaaaaaaaaaaaaaaaaagaactccttgcctggagtggtgggggactaggagtgaaagtgacatcaytttcttctctgctcttcttcagacatcaaggagcacgtgaaacagctagagaaagcggtttcaggcaaggagccgagattcgtgctgcgggccctgcgga

SEQ ID NO: 65162 - DNA, 201 bp, Homo sapiens
taggaagggaggataataagtgatctttctttcttttctttcgttttttgttttctgagacagagtctccctctgtcactcaggctggagtgcaatggcaygatcttttctcactgcaacctctgcctcccgagttcaagtgattctcctgcctcagcttcctcagtagctgggcaggcgcctgccaccacatccaactaa

SEQ ID NO: 65163 - DNA, 201 bp, Homo sapiens
agggctcctccccagccggtgacttactgtacagcaggcaggagggtgggcaggcaacctccccgggcagggtcctggccagcagtgtgggagcaggaggkgaaggatagttctgtgtactcctttagggagtgggggactagaactgggatgtcttggcttgtatgttttttgaagcttcgattatgatttttaaacaat

SEQ ID NO: 65164 - DNA, 201 bp, Homo sapiens
cctcgtggtcatcttcatgatgaacagcaagcgctacaaagaggtatccaggatgcagtgagagcgattcataagccccaagtgatgcaaggggtttggcrgggagatggtccctggtgaagaaatggaaataatcattgattcttaagaactgtcccccacactctttccccatagaggtatgcgtttgatcccacatcc

SEQ ID NO: 65165 - DNA, 201 bp, Homo sapiens
gggacaggctctttcccccttgggggtcccctgcccagggcactgtccccattttcccacacacagctcatatgctgcattcgtgcagggggtgggggtgytgggagccagccaccctgacctcccccagggctcctccccagccggtgacttactgtacagcaggcaggagggtgggcaggcaacctccccgggcagggt

SEQ ID NO: 65166 - DNA, 201 bp, Homo sapiens
tctactgaaaatacaaaaattagccaggcctggtggcaggttcctgtaatcccagctacttgggaggctgaggcaggagaatcgcttgaacccgggaggtwaaggttgcagtgagctgagatcgcaccaccgcactctcctgcctgggtgacagagcgagactccatctcaaaaaaaaaaaaaaagaagaagctgggtgtg

SEQ ID NO: 65167 - DNA, 201 bp, Homo sapiens
acagctagagaaagcggtttcaggcaaggagccgagattcgtgctgcgggccctgcggatgctgccttccacatcacgccgcctcaaccactatgttctgyataaggctgtgcagggcttcttcacttcaaataatgccactcgagactttttgctccccttcctggaagaggtgagtgagtcaggccaacttaaagggtg

SEQ ID NO: 65168 - DNA, 201 bp, Homo sapiens
agaagactggcttaatttgtggcccacgtcccagccaatctctgtaaaatcactgagctgcagcacagggggcccagaatggggaggggacttggccatarttccatagccagttgccctctcctattgcgtttaagggatgatgtggtcaccagggaggaccaggcagggattcagagggcggggttctacatttggttc

SEQ ID NO: 65169 - DNA, 201 bp, Homo sapiens
tacctgtggtagcatgaggagagaagccaaagcagtccatttgaatactcatctgcacagtgacaagggaaccgtccactgccctgtagtgtcattcttcmaagtcaggggatcaggaccctcccagccaaactcatttcccactaccctgcaacctgtaccccctactccagttgaggttgcgttgggtgacctctctgt

SEQ ID NO: 65170 - DNA, 201 bp, Homo sapiens
ctgaagtggaagcctatctccaactcctcgtggtcatcttcatgatgaacagcaagcgctacaaagaggtatccaggatgcagtgagagcgattcataagmcccaagtgatgcaaggggtttggcggggagatggtccctggtgaagaaatggaaataatcattgattcttaagaactgtcccccacactctttccccata

SEQ ID NO: 65171 - DNA, 201 bp, Homo sapiens
ccggagaacgatgaccaacgcccttcgcaaggcccctcagcacacagctgtcggcttcaaacagacggtgagccacaactaccatcatccctttgcctctttttttttttttttttttaaatggtgtcttgctatgttacctgggctggtcttgaactcctgggttcaagaagtcctcccacctcagcttcccaaagtgct

SEQ ID NO: 65172 - DNA, 201 bp, Homo sapiens
acactccttcctctctcttctagccttggcccatcacctgtttgcttcagtctccgggaagaaaacccccagccctgctgcttcctctctcaggcggccgrttcctgtctcccctggctccctccccaacagtgcactggccagccccttccctccagtgttctctctgctccttctcaccacctgggcctcagcagagca

SEQ ID NO: 65173 - DNA, 201 bp, Homo sapiens
cttgctgccccacgatttagctgctttgtgttccgtgcctcctgtttgctggtgaactcctgagttggggggcgtcattccctccactgtagttcttccgygatgctgaatccacccacggtcagcaccactcggaaatacttcacagtcctgtagaggaagacaggtccaggtttccagttacccttctatgtctggata

SEQ ID NO: 65174 - DNA, 201 bp, Homo sapiens
cactccttcctctctcttctagccttggcccatcacctgtttgcttcagtctccgggaagaaaacccccagccctgctgcttcctctctcaggcggccgaytcctgtctcccctggctccctccccaacagtgcactggccagccccttccctccagtgttctctctgctccttctcaccacctgggcctcagcagagcac

SEQ ID NO: 65175 - DNA, 201 bp, Homo sapiens
gccaccacgcccagctaattttttgtatttttagtagagatggggtttcaccatgttggccaggctggtctcgaactcctgacctcaagtgatccacccayctcagcctcccaaagtcctgggattacaggcgtgagccaccgctccaggccaggtatttcttattattagagtatttcaaagagataaagaatgttgtgt

SEQ ID NO: 65176 - DNA, 201 bp, Homo sapiens
tgcgagctgccatgtctgcaaaaggttgcttcacatctatttgtgggtgtcaatgaagcagacactacctgcacctctggcagtggatattcagagtgttyctggcagataggtttagaatattcctgattccccagcgctcctgacagtcattccaggcttggacctagattgtgttgatacaaaccccaggtttttatc

SEQ ID NO: 65177 - DNA, 201 bp, Homo sapiens
aacagacggtgagccacaactaccatcatccctttgcctctttttttttttttttttttaaatggtgtcttgctatgttacctgggctggtcttgaactcstgggttcaagaagtcctcccacctcagcttcccaaagtgctgggatcacaggtatgagccaccatgcctggcccctttgcctgttactcattccctacca

SEQ ID NO: 65178 - DNA, 201 bp, Homo sapiens
tgttgaacctcctgctgcggaattacctacactacagcttgtacgaccaggctgagaagctggtgtccaagtctgtgttcccagagcaggccaacaacaaygagtgggccaggtacctctactacacaggtgagcagaggggcccaacccataaatcagaaggtgtctcaggcctgcctggtgcaaattttccaaggggtg

SEQ ID NO: 65179 - DNA, 201 bp, Homo sapiens
ggtggactttgaggggttagaagaggctgaaaatgccctagagtctcagccatgagaagaacagcaaaaaagcagtcggggcagagagaaaaggggctcasatgcttcgagggctcctggggtccttgtgcgttgagtgtctcccttaattctcaggacaacaccatttgcatggcatcaccagccccatgtgtggatgcg

SEQ ID NO: 65180 - DNA, 201 bp, Homo sapiens
ctttaaagcccctgcatatgacacaggttaactaaagtcaagattggggctgctgcattccaggttccctagactcacaagctggtccttggccaggtgcrgtggctcacgcctgtaatcccagcactttgggaggctgaggcaggcggatcacctgaagtcagaagtttgagaccagcctggccaacataattaaaatgt

SEQ ID NO: 65181 - DNA, 201 bp, Homo sapiens
aaggcaatcttgaaaattgctaaattatagtctctgagttcctgtgcagctgtcgtgctgctcctttccaatgctcctttccagtgcttttttttttttttgagagagttttgctcttgttgcccaggctggagtacaatggtgtgatcttggctcactgcaacctttacctcctgagttcaagcgattctcctgcctcag

SEQ ID NO: 65182 - DNA, 201 bp, Homo sapiens
aaactttggagaactggatctgtccaataaacgcttatttggccaagcctgatggctcgtgcctgtactcccagcactttgggaggctgaggtgggagggytgcttgagcccaggggtttgagaccagcttgggcaacaacaacaaaaatgccaggtgtggtggggtgcacctgtagtcccagctactagggaggctgagc

SEQ ID NO: 65183 - DNA, 201 bp, Homo sapiens
accaatgccagagcagtcttcttttcactgcatggaatgacattccaaggtcttgaatgtttcaggggctgaagtgtcctgcagcagggcattgtgttggsaagagagcatgctttggtgccagacccacgggggcgcagtcctgggttaagtaggagggactaattccaacgttaaggataaataaataatgagatacag

SEQ ID NO: 65184 - DNA, 201 bp, Homo sapiens
tggatatatcatataaatggaatcatataatatgtgatgttttatgtctggtttctttcacttagcataatattttcaaggtttatccattttatggctgwataatatttaatcgtatgaatgtaccataattcgtttatccatttatttattgatagacatttaggctgtttctaccttttggctgttgtgaatagtgct

SEQ ID NO: 65185 - DNA, 201 bp, Homo sapiens
agtggcatgggagtggggggcaccagcatttcagacataggcctcagggatgtagatgctgctcagctccagggaatctttattgacaccaatgccagagyagtcttcttttcactgcatggaatgacattccaaggtcttgaatgtttcaggggctgaagtgtcctgcagcagggcattgtgttggcaagagagcatgct

SEQ ID NO: 65186 - DNA, 201 bp, Homo sapiens
aggcatgagccaccgtgcctggccccaaaacattttcattacccaaaagaaaaccctttacccattaagcagttgctccctgttcactcctccaccccaayccctggcaaccaccaatctgtgttttatttctatgaagttacacattctggatatatcatataaatggaatcatataatatgtgatgttttatgtctggt

SEQ ID NO: 65187 - DNA, 201 bp, Homo sapiens
ctttcccctttccactcggcctggagcagcatctggcctgtgggtagcaggtgcaccctcctagtggcatgggagtggggggcaccagcatttcagacataggcctcagggatgtagatgctgctcagctccagggaatctttattgacaccaatgccagagcagtcttcttttcactgcatggaatgacattccaaggtc

SEQ ID NO: 65188 - DNA, 201 bp, Homo sapiens
gagttggggggtgggtggagggaggggaaagttaggagccaagttttgaagagagagaagataaaggttgtctgggcatggtggctcaggcctgtaatcccagcactttgggaggccaaggagggcatatcacttgaggtcaggagttcaagaccagcctggctaacatggtgaaaccccgtctctactaaaaatacataa

SEQ ID NO: 65189 - DNA, 201 bp, Homo sapiens
ggaccccatcatccaagacagttggcagggagagtgcaagacctgcctggtttctacaaccttccaaaggaggcagctcccgaaagaaggttttcagaacrcagggccttgggagacaggaagccagtcagactcctcgcacaaaccacagggggcaagcagtgctcctccaagaacctggccccaccagggtgctcaagg

SEQ ID NO: 65190 - DNA, 201 bp, Homo sapiens
gctttcccctttccactcggcctggagcagcatctggcctgtgggtagcaggtgcaccctcctagtggcatgggagtggggggcaccagcatttcagacataggcctcagggatgtagatgctgctcagctccagggaatctttattgacaccaatgccagagcagtcttcttttcactgcatggaatgacattccaaggt

SEQ ID NO: 65191 - DNA, 201 bp, Homo sapiens
ctcccccatggcccagcatccctgaattcctctctcttctctggctcaagcaaaacctcctggcttgtacatcaccatagcaggccccaggaatgcgaggraccctgtgtcagggcagggaccccatcatccaagacagttggcagggagagtgcaagacctgcctggtttctacaaccttccaaaggaggcagctcccga

SEQ ID NO: 65192 - DNA, 201 bp, Homo sapiens
gagtcccttgtccaaggtcacacaggcggtaagggcagagcctgtctgcccagctgcggcaaccctaagcctcctctccttgtgtggtcaccctccggggkccgagcttcttttcctccatgctctcatcagtgcccccatctgctttcccctttccactcggcctggagcagcatctggcctgtgggtagcaggtgcacc

SEQ ID NO: 65193 - DNA, 201 bp, Homo sapiens
ccgcctctgtgggcctcctctctctccacagcagcggggaactgggggacccatcagacttgctgacaagaaatatgccgtcctagagagagagagacagvgggagaaagacagagtaaggacaggaaagagaaagcaatgcgtgccatccttcctcctcatgttcaagtttataaacattgcttaaggtggactttgagg

SEQ ID NO: 65194 - DNA, 201 bp, Homo sapiens
gtcaggccgcctctgtgggcctcctctctctccacagcagcggggaactgggggacccatcagacttgctgacaagaaatatgccgtcctagagagagagmgacagagggagaaagacagagtaaggacaggaaagagaaagcaatgcgtgccatccttcctcctcatgttcaagtttataaacattgcttaaggtggact

SEQ ID NO: 65195 - DNA, 201 bp, Homo sapiens
gcattgtttctgttactgtttttttccttgtatctcaggctctgaaatggtttggaaccatgactaaacctgtatttctttaaaactttgggccgggcacrgtggctcacgcctgtaatcccagcactttgggaggctcgaggtgggaggatcccttgaggccaggagttggagaccagcctgggcaacataacgagaact

SEQ ID NO: 65196 - DNA, 201 bp, Homo sapiens
tttgccatgctggacgttgggggactgtttcaatcaagagacttacatttgtcagttctggaaagcgtttttgctttatttctttcagatttctcctttcyacaattcctcatggttagatgtccatttctggaagtgatccttcaattttttcttctctcttctgctgtgcgtctcttttgcattttttgttgtttattt

SEQ ID NO: 65197 - DNA, 201 bp, Homo sapiens
tgtaaagtggggagagcagcgatgtctgtctgtgcacctcaggaagttgtaaggggaaatgagatggtgcagctccagggaacctgcaaggctgcgagctmacggagtgctctgcactcagcacagcccctgcacagagcaggtgtctgcaccgacatgctgaaggagtcaacaaatgtgctgcatggtggcgctgtgctc

SEQ ID NO: 65198 - DNA, 201 bp, Homo sapiens
gaaggataaagtgtcctccttccacactctagctttcggcaggtttcccagtggttgggggatcacagcacggaacattttagggagagggtccctgaagktcagttgtgtggctcctggtaggcccaagtgccccagggcccttataagagacagtcttggttggctctgtcgctcaggagtgtggggtccccatggggg

SEQ ID NO: 65199 - DNA, 201 bp, Homo sapiens
gaccctgtctcgaacaaaacaaaacaaaacaaaaaagaaagaaatgtaaatgtttccctttgactcttttagaaacacaaatcaggaagctctcagcaggrgtgtgctggagatcatgtatgcagctgggtgagaggcaactgaacatgtctcttcctaactccatgttcagtaacttttttgaaagggtagctggaagtc

SEQ ID NO: 65200 - DNA, 201 bp, Homo sapiens
taaaacaaagactgtgtggctttgggcaaataacgtcccctctccgatctcacttttctcctttgtaaagtggggagagcagcgatgtctgtctgtgcacytcaggaagttgtaaggggaaatgagatggtgcagctccagggaacctgcaaggctgcgagctaacggagtgctctgcactcagcacagcccctgcacaga

SEQ ID NO: 65201 - DNA, 201 bp, Homo sapiens
ggtcaggccgcctctgtgggcctcctctctctccacagcagcggggaactgggggacccatcagacttgctgacaagaaatatgccgtcctagagagagasagacagagggagaaagacagagtaaggacaggaaagagaaagcaatgcgtgccatccttcctcctcatgttcaagtttataaacattgcttaaggtggac

SEQ ID NO: 65202 - DNA, 201 bp, Homo sapiens
cccctacctgcaccccagcccccaggcagttgttaaatatttatctgcactcacaactttggtgactttctggagccacagtggcttccagccctgaggttaaaagtctagcctctgattttaaaacaaagactgtgtggctttgggcaaataacgtcccctctccgatctcacttttctcctttgtaaagtggggagagc

SEQ ID NO: 65203 - DNA, 201 bp, Homo sapiens
tgaaattgcagtgacatgaccttctctggctgtttttgtttgccatgctggacgttgggggactgtttcaatcaagagacttacatttgtcagttctggawagcgtttttgctttatttctttcagatttctcctttccacaattcctcatggttagatgtccatttctggaagtgatccttcaattttttcttctctctt

SEQ ID NO: 65204 - DNA, 201 bp, Homo sapiens
tctttaggagacaaacacacagtcattccatcttttggattttggcttaattttatatatatatatattttaagacggagtctttctctgtcgcccaggcyggagtgcaatagtgcaatttcggctcactgcagcctctgcctcccgggttccagcgattcccctacctcagccacccgggtagctgggattacaggcgcg

SEQ ID NO: 65205 - DNA, 201 bp, Homo sapiens
ccctgtaactccagcattctgaaattgcagtgacatgaccttctctggctgtttttgtttgccatgctggacgttgggggactgtttcaatcaagagactkacatttgtcagttctggaaagcgtttttgctttatttctttcagatttctcctttccacaattcctcatggttagatgtccatttctggaagtgatcctt

SEQ ID NO: 65206 - DNA, 201 bp, Homo sapiens
cttgccacggggcctcctctctcagacttagggttctttaggagacaaacacacagtcattccatcttttggattttggcttaattttatatatatatatwttttaagacggagtctttctctgtcgcccaggccggagtgcaatagtgcaatttcggctcactgcagcctctgcctcccgggttccagcgattcccctac

SEQ ID NO: 65207 - DNA, 201 bp, Homo sapiens
cagcctgggaaaaagaagaagactctgtctccgaaaaaatataaaagaaagaaaataagataattcagggtggtcaaacctgtcagttcctttatcccccygagaaacttctctcctgtcctgcactccaatcccgcccagccactcgcctgctggtaccacgggtgccatcctggggcctccctttctgttcgtcctggg

SEQ ID NO: 65208 - DNA, 201 bp, Homo sapiens
ggcatcactcaggggcacctgcagcacaggtggccttggtgccacctctgggcatgtgaattacaaaaaggtgcccatcctccaatctctgtcagatcccrctcgggcttggcaaagggtctttcttgtgtcaaagggttgcatatgtgtgtgcatatgagtatgtgctcatgtgcaggtgtgtgtgtgtcttggagggct

SEQ ID NO: 65209 - DNA, 201 bp, Homo sapiens
ctgcggctgctaaacatcttacagagcactggacagttcccgcataacaatgaattatccagtccaaccaacaatccaatttaaaaacaggaaaaagactkaaatagacatttctccaaagaagatatacaaatggcccacaagcatatgaaaagatgttcggcatcactaatcatcagggaaatgccaatttataaaaac

SEQ ID NO: 65210 - DNA, 201 bp, Homo sapiens
gacaggaggaccaggctttaagggataacttatctggagagtgcagatgtcaggtcaggaacccgaaggcctcatgggcaggctggaatgacatctgcctyggaacagatgaaactactgggataaatataaatcctggcatttaagtttagaatgagttgggagagatgtggtttagcagcagctcacgaggaaaagatt

SEQ ID NO: 65211 - DNA, 201 bp, Homo sapiens
atgggactaatattagtgctcacctcctagggttgccctgcagtaacaaatatgaaatgcccagcactctcccatcaccactcagcaaatgccagcttccmttctccttcctcccacgctcccaaatgctcccctgcaggctttgtgcttggctctgcccaggagtgatccccctgcaagtcgccccctccctccagggtg

SEQ ID NO: 65212 - DNA, 201 bp, Homo sapiens
gtaaagacgaggtttcgctgttttgtccaggctggtctcgaactcctgacctcccgtgatccgcccgcctcggcctcccaaagtgctgggattacaggcgygagccaccgcgtccagcccagattttccttttccattaaatagggtactcttccagggcagggactatgactctccctcggcctgggagctccctgaaaa

SEQ ID NO: 65213 - DNA, 201 bp, Homo sapiens
ctctcagacgcttggtctaacacatgtcctccgtgttgaagctgggtttctcttccttgcccccgaaggtatctgccttgttggctttacttcctcagagragaaattgaggaatccagagacaccttcctgtgtccaggatgtcccaggtttgggaatgctgtctgtgggcttggattcccagaggaggcagctggttcc

SEQ ID NO: 65214 - DNA, 201 bp, Homo sapiens
agcagagaactccgagcaacgggccaggaagatgcattcccaggaagctcacgctttgcagtcttagctgaggcggcaagagacacgtcagcatctgtttkggcttcacaactgcagagcgtggcttctgtcccgggcactcatttcagacgcccggaggtttggggaaagctctcgctgtgcggggcccaggaagcaggc

SEQ ID NO: 65215 - DNA, 201 bp, Homo sapiens
ttgcattctcagttggagtgcctctggctgtcacgaatggattgcagatggcatgtgatatgaaacctatttgccatcctagacagtatctaggtagtgayaggagtaaaacagtaaaaaattacccctccctcaatggggcaagggggggttaattttattccccaggggatatttggcaatgtttggagacgtttttca

SEQ ID NO: 65216 - DNA, 201 bp, Homo sapiens
agccagctgcatgatggaaacctggggactggggctggggctctgggggtcctgcgggctatttcttgggcctgactaccattgaggggcttgtgctcccytttcaagtggtttcccagacacaagcagagtccaggggagggcagctggggtggtgaagaggcttgcactcttgtccctggaggaatggtagaaggcgtt

SEQ ID NO: 65217 - DNA, 201 bp, Homo sapiens
tcatgtgattacctatgtccaatcagtctgaggaagcacagggtcatgtaggagactgtgatgggtgtagtcaactcagcagggcctacgggtctgggggyaaacgtcattgggatggggatggagcatcctaaaacatgtctggtacaaggatattatttaaaatataatgtcacacctgaaattttagttagcagggct

SEQ ID NO: 65218 - DNA, 201 bp, Homo sapiens
tgggtgctctgtgtatatgattttgttaaagtgtcaaacctaccaagtttatgttttatcagccccatctcacagatgaggaaactgagtcttagagagtrtgtgtaatttgtccaatgttgtagttagtaggtggtagattcagggttcagtgtctagcttgtctgattccaaacctgtgttgttttactgctctgatac

SEQ ID NO: 65219 - DNA, 201 bp, Homo sapiens
tgagacagggtctcactctgttgttcaggctggagtgcagtggtgtgatcatagctcactgctgcctcaacttcctgggctcaagtgatcctcctgcctctgcttcctgagtagctgggactgcaggcatgcaccaccacatctggctaattttttaaaatttattattaataataaattaaattttataatacctttttt

SEQ ID NO: 65220 - DNA, 201 bp, Homo sapiens
ctgaggcaggacaatcacttgaacccgggaggttgcagggagccgagattgtgctattgcactccaccctgggcaacaggagcaaaactctgtctcaaaaaaaaaaaaaaaaaaaaaattagctgggtgtggtggcatatgcctgtgatcccagctactcaagaggctgaggcggaaggatcacttgagccctggaggtcg

SEQ ID NO: 65221 - DNA, 201 bp, Homo sapiens
ttaccatcaaaagctgcttttgatatcatgaaatgtgacagaagcggtccatgaaactgcatgatcagcagaactgtgactgtgaaattaacatacatatraaaaaacactagaagaaaataggccagcatgggaccagatgagggatggggaaggcctgtttttgtttttgtctgtccttgtcctaattctctgtggcta

SEQ ID NO: 65222 - DNA, 201 bp, Homo sapiens
ctccccagattcaccccttaacccactccagctgccgtcccctccgatcgacagataactaactggcttcttctcattcaggtcttaatcagctcaagggraccctcctcagagagccccacctcatggctctgtgtagagtagcaacaaccccaaccctttcctctgtctgattttcttcatagcccttaccaaatgatt

SEQ ID NO: 65223 - DNA, 201 bp, Homo sapiens
tgacaatgtcttgctctgttgcccaggctggaatgcagtggcatgatcatggcttactgcagctttgatcccttgggatcaggcaatcctcctgccccagyctcacaagtagctgggactacaggtgcatgccaccatgcccagctaatttttgcatttttttttttgtagacttggggggagggtctcactatgttgccc

SEQ ID NO: 65224 - DNA, 201 bp, Homo sapiens
agggaaccagggtctctgcctcttttgcctactgatacctgcttttaaggctaaaattgaggggcaggtgcagtggctccttcctaagatcctagcacttkgagaaaccaaggcaagattacttgagcacaggagtttgagactagcctgggcaacagagtgagaccccgtctctacaaaaatttaaaaaattagcccagc

SEQ ID NO: 65225 - DNA, 201 bp, Homo sapiens
catcctggctggaatttacatcaatggccaccccacatccaatgctgcgctcttcttcatcgaggtccgtgtcatctgtggccacagggctcctgtctgcytctgcgtcggcgtctcctgggccattcggtccctgcctctccccttctccctctcccctgccacatacctgagaaaacttcatccaccccatcctggcac

SEQ ID NO: 65226 - DNA, 201 bp, Homo sapiens
ctaaaaaccctgttggccaggctggtctcgaactcctgacctcaagtgatccacctgcctcggcctcccaaagtgctgggattacaggcatgagccaccakgcctggctgggctgcctgcctttcaaaattgaagaaaaccaaccccaagtcatggttcctgggtgggtatcgtggcctagagagaagtatcagagcacct

SEQ ID NO: 65227 - DNA, 201 bp, Homo sapiens
tccagcagcgccaacatcattgtcccaggctgctgggtgcacttactgccttcagtgcagcaggctgacctgtcagactgtccgggaagaggcctcgatgycctctgcctgtgatatgctcctgacaacaggctctgcctctgtttcagaatctcggcgaaggagcatctttgaataccaccgcatagagctggaccccag

SEQ ID NO: 65228 - DNA, 201 bp, Homo sapiens
ctagagtgcagtggtgtgatctcggctcactgcaatctctatctcccaggttcacgtgattctcctgcctcagcctcccaagtagctgggattacaggcayccgccaccatgcccggctaatttttgtatttttaatagaaatagggtttcactctgtcggccaggctggttttgaactcctgacctcaagtgatccaccc

SEQ ID NO: 65229 - DNA, 201 bp, Homo sapiens
gagtctttcccatacattctatgagggtacaggctctaacagggagattgaatgaagggacccagcactccagccagaggggcctgcctgggcaggcagargtagaaagcagcagggcaggaggagtgggagacatggggcctggatttaagagccgttcacttgcagtcaaacgctactcacttaaatgaaccagatgac

SEQ ID NO: 65230 - DNA, 201 bp, Homo sapiens
gctgaggcaggacaatcacttgaacccgggaggttgcagggagccgagattgtgctattgcactccaccctgggcaacaggagcaaaactctgtctcaaaaaaaaaaaaaaaaaaaaaattagctgggtgtggtggcatatgcctgtgatcccagctactcaagaggctgaggcggaaggatcacttgagccctggaggtc

SEQ ID NO: 65231 - DNA, 201 bp, Homo sapiens
ggctgaggcaggacaatcacttgaacccgggaggttgcagggagccgagattgtgctattgcactccaccctgggcaacaggagcaaaactctgtctcaaaaaaaaaaaaaaaaaaaaaattagctgggtgtggtggcatatgcctgtgatcccagctactcaagaggctgaggcggaaggatcacttgagccctggaggt

SEQ ID NO: 65232 - DNA, 201 bp, Homo sapiens
aggctgaggcaggacaatcacttgaacccgggaggttgcagggagccgagattgtgctattgcactccaccctgggcaacaggagcaaaactctgtctcaaaaaaaaaaaaaaaaaaaaaattagctgggtgtggtggcatatgcctgtgatcccagctactcaagaggctgaggcggaaggatcacttgagccctggagg

SEQ ID NO: 65233 - DNA, 201 bp, Homo sapiens
gaggctgaggcaggacaatcacttgaacccgggaggttgcagggagccgagattgtgctattgcactccaccctgggcaacaggagcaaaactctgtctcaaaaaaaaaaaaaaaaaaaaaattagctgggtgtggtggcatatgcctgtgatcccagctactcaagaggctgaggcggaaggatcacttgagccctggag

SEQ ID NO: 65234 - DNA, 201 bp, Homo sapiens
atgatgcacctgctaagcctctggtcctctggcttttgaggaaggcagtcattctgggagtgagaagggtggttccaggcatctcctctttagaatcccayccaggttccttctcactgcaagaattttccagtacactcaacactgattctaggtggaaagcatcctattctcacaccatagactaacatagatgggtct

SEQ ID NO: 65235 - DNA, 201 bp, Homo sapiens
cctgacttcaagtgatccgcctacctcggcctcccaaagtgctgggatttcaggcgtgagtcactgcacccagtcccccccccctttttttttttttttttgacagagtcttgaactgtcaaccaggctagaatgcagtggcgtgatctcagctcacgacaacctccacctcctgggttcaagtgattctcctgtgtcaac

SEQ ID NO: 65236 - DNA, 201 bp, Homo sapiens
cggcgtggctcgtgtaaccctcactgagctcctttgtaatgtcaagtcatcctggtcagagcttctacaatgggctgtgaattgtgtgaattccttgggarggttcactgccaggcaaggtctccgcatcctttttaagaggcacatcaatatggattatagtgaccataccctgggatagactggcctggtgttgggggc

SEQ ID NO: 65237 - DNA, 201 bp, Homo sapiens
ccggctggtctcaaactcctgacttcaagtgatccgcctacctcggcctcccaaagtgctgggatttcaggcgtgagtcactgcacccagtcccccccccctttttttttttttttttgacagagtcttgaactgtcaaccaggctagaatgcagtggcgtgatctcagctcacgacaacctccacctcctgggttcaagt

SEQ ID NO: 65238 - DNA, 201 bp, Homo sapiens
tagtagggatgggattttgccatgttgaccaggccggtcttgaactcttggcctcaagtgatccacctgtcttggcctcccaaagtgctgggattacaggygtgcaccaccgcatctggcatgagtatctgtttttttctctcttttgagatggagtcttgctctgttgcctagactggagtgcagtggcacaatctcggc

SEQ ID NO: 65239 - DNA, 201 bp, Homo sapiens
aatgtgacagaagcggtccatgaaactgcatgatcagcagaactgtgactgtgaaattaacatacatatgaaaaaacactagaagaaaataggccagcatrggaccagatgagggatggggaaggcctgtttttgtttttgtctgtccttgtcctaattctctgtggctatatggtctatatttaccctatcacaatccct

SEQ ID NO: 65240 - DNA, 201 bp, Homo sapiens
cctcagcctcccgagtagctgggattacaggtgtgtgccaccacgcccagctaatttttgtatttttagtagggatgggattttgccatgttgaccaggcyggtcttgaactcttggcctcaagtgatccacctgtcttggcctcccaaagtgctgggattacaggcgtgcaccaccgcatctggcatgagtatctgtttt

SEQ ID NO: 65241 - DNA, 201 bp, Homo sapiens
aacatttagatttgaggaggtgcccctccctttcaccccccttacctcccaatctcccccatggcccagcatccctgaattcctctctcttctctggctcragcaaaacctcctggcttgtacatcaccatagcaggccccaggaatgcgagggaccctgtgtcagggcagggaccccatcatccaagacagttggcaggg

SEQ ID NO: 65242 - DNA, 201 bp, Homo sapiens
ctttcttttctttctttctttctttcctttctttctttctttctttcttttctttctttctttctttcttttctttctccctctctctctctttctttctytctctctctctctctttctttcttttctttctttctttctgacagagtcttgctctgtcgcccaggctggagtgtagtggcgcaatctcagctcactgca

SEQ ID NO: 65243 - DNA, 201 bp, Homo sapiens
tttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagtgtagtggcgcaatctcagc

SEQ ID NO: 65244 - DNA, 201 bp, Homo sapiens
cacttaacctctctgttatttccattacctcagtcatgcacaaaaggggttgagcttccagctctgtggaaaatactctctcccccgggacgtatttcaartgcctaggatgttctcagagggtgactgttggcttattagcttccagaggacctagatcatcccatagactttctttgagcttctctgacgggcctgcca

SEQ ID NO: 65245 - DNA, 201 bp, Homo sapiens
ctgggactacaggcgcgtgccaccatgcctggctaatttttgtatttttagtagagacaaggtttcaccatgttggccaggctggtcttgaaatcctgacytcaggtgacctgcctgcctcggcctcctaaagtgctgggattacaggggtgagccactgcggccagcccctgccagtttttctaagagctgaggacacag

SEQ ID NO: 65246 - DNA, 201 bp, Homo sapiens
atctgtttgcagaggcactcaaaacacacaggacagtgtatccgctatgtggctggggagaccgccggaagtcaatattatttcctctgttcatttgcttmagaaactctttatttcatggttagtataaaagcaactttagcattgccaacatcgaaactgacagggattctgaattagtgggatcagttagtgaggatt

SEQ ID NO: 65247 - DNA, 201 bp, Homo sapiens
agtcctaggtctccacttggtgtattgctgaacctttcagctgtgagttctgcagaccacacagtgaaggataaagtgtcctccttccacactctagcttycggcaggtttcccagtggttgggggatcacagcacggaacattttagggagagggtccctgaaggtcagttgtgtggctcctggtaggcccaagtgcccc

SEQ ID NO: 65248 - DNA, 201 bp, Homo sapiens
ctcatgcagtcctgctagcccctacacctactcacatgggcagatgtggccttggtcctggggagctgggtgggaaggaaggcagggatgccacaaatacyttcatcttccggggaagtagagggaatgggagtgcctgactacctcagcctggggaccttggctcctcttctcactatcagcagagagctgttactgaac

SEQ ID NO: 65249 - DNA, 201 bp, Homo sapiens
agcacggaacattttagggagagggtccctgaaggtcagttgtgtggctcctggtaggcccaagtgccccagggcccttataagagacagtcttggttggytctgtcgctcaggagtgtggggtccccatgggggcgggggcatgcccactgactttgcctctgtgccttctgcagcgtagacctcaccactggccagcca

SEQ ID NO: 65250 - DNA, 201 bp, Homo sapiens
ctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagtgtagtggcgcaatctcag

SEQ ID NO: 65251 - DNA, 201 bp, Homo sapiens
tttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagtgtagtggcgcaatct

SEQ ID NO: 65252 - DNA, 201 bp, Homo sapiens
cttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagtgtagtggcgcaat

SEQ ID NO: 65253 - DNA, 201 bp, Homo sapiens
tttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagtgtagtg

SEQ ID NO: 65254 - DNA, 201 bp, Homo sapiens
ctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagtgtagt

SEQ ID NO: 65255 - DNA, 201 bp, Homo sapiens
ctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagtg

SEQ ID NO: 65256 - DNA, 201 bp, Homo sapiens
tctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctggagt

SEQ ID NO: 65257 - DNA, 201 bp, Homo sapiens
aaagtggggagagcagcgatgtctgtctgtgcacctcaggaagttgtaaggggaaatgagatggtgcagctccagggaacctgcaaggctgcgagctaacrgagtgctctgcactcagcacagcccctgcacagagcaggtgtctgcaccgacatgctgaaggagtcaacaaatgtgctgcatggtggcgctgtgctcttg

SEQ ID NO: 65258 - DNA, 201 bp, Homo sapiens
ctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctgg

SEQ ID NO: 65259 - DNA, 201 bp, Homo sapiens
acagagcaggtgtctgcaccgacatgctgaaggagtcaacaaatgtgctgcatggtggcgctgtgctcttgtagttttctcgtttaagtagatgttttccrtctacttaatggctaggcttggtaaattgtaaagagatgtggcctgtgtggtggctcatgtctagaacctcagcgctttgggaggctgaggcaggcagat

SEQ ID NO: 65260 - DNA, 201 bp, Homo sapiens
aaaggggaggtcttggcaaaggttctcttcctttgaggatttcaaaattctactccaatgtttacttggttccatggttcaggtttagagccagagtttgrgggaaatcaagcataagaacatttagatttgaggaggtgcccctccctttcaccccccttacctcccaatctcccccatggcccagcatccctgaattcc

SEQ ID NO: 65261 - DNA, 201 bp, Homo sapiens
tctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggctg

SEQ ID NO: 65262 - DNA, 201 bp, Homo sapiens
tttctcgtttaagtagatgttttccgtctacttaatggctaggcttggtaaattgtaaagagatgtggcctgtgtggtggctcatgtctagaacctcagcrctttgggaggctgaggcaggcagattgcttgagcccgggagttggagaccagcctgggtagtacagggagacccatctctactaaaaatacaaaaattag

SEQ ID NO: 65263 - DNA, 201 bp, Homo sapiens
acaggactcttgtccagactcaagatttccggagattttccaccaagaccaattctgaggccctggggacactgggcgtttcggggacgggagcaggagarctggggaagccatagtgctgagtcaagagatcctgggatgtgctgagtcagagatcctgggatgtgctgagtcagagaccctgggatgtgccacaattta

SEQ ID NO: 65264 - DNA, 201 bp, Homo sapiens
ctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccaggct

SEQ ID NO: 65265 - DNA, 201 bp, Homo sapiens
caccaccacgcctggctaattttttaaatttttagtagagacggggtttcaccatgttggccagactggttgcaaactcctgacctcaagtgatccacctrcctcggcctcccaaaatgctgagattacaggtgtacagccaacttgacttcttaactcccttgctctctcaacctgatatgtctgagtctctgcagctgt

SEQ ID NO: 65266 - DNA, 201 bp, Homo sapiens
acagtggaaacaggactcttgtccagactcaagatttccggagattttccaccaagaccaattctgaggccctggggacactgggcgtttcggggacgggrgcaggagaactggggaagccatagtgctgagtcaagagatcctgggatgtgctgagtcagagatcctgggatgtgctgagtcagagaccctgggatgtgc

SEQ ID NO: 65267 - DNA, 201 bp, Homo sapiens
cacccactctgtccagctgctttcctgaggaggagcaagttccctgatctgcctgggatggaaggaagggagggagacgtgggaggaggcctggatctcaytctaaaccatccggctccagtgcaggagtcgggcgaaggaaggagctgcagggctggagctgtcatcctcctggtaggaaaggaagaccaaggctaaagt

SEQ ID NO: 65268 - DNA, 201 bp, Homo sapiens
tcagttgtcaaaatattgaaatacttgcattcttgttggcaaattgctgctgatttgagccccctcgtacctcccacgacccctcctgccctccccttagscccctgcgctcccagtcctctatcaagtattacagcctgggctccaggacctggctccatggctgcaggcagcatctgctctgactggttggtaaacgcc

SEQ ID NO: 65269 - DNA, 201 bp, Homo sapiens
gaactcgtgagctcaagtgatccacccacctgggtctcccaaagtaccagcattacaggcctgagcctccacgcccgatctaatttaattttttaattgamaaataattgtacatattcatggggtacatagtaatgtttcaatacatataatgtatagtgatcagatcagggtaatttgcacattcataatctcaaacac

SEQ ID NO: 65270 - DNA, 201 bp, Homo sapiens
acattgtcccttcttacaagctctctggagcctcagctgcaactgagagctgaacctaggtccctaaaaacccggagggcagggccagctgacatggtctstctgccaacagctgcagtcagtccctgcatggttctctgctcccctcccctccacccactttgcctttcacagcctcccagagcttttctccttgctctt

SEQ ID NO: 65271 - DNA, 201 bp, Homo sapiens
gaggcaggagaattgcttgaacctgggaggcagaggttgcagtgagccgagatcatcccactgcactccagcctgggtgacagagcgagactcagtctcartaagtaaataaataatgagatactatgtgaaccatggacaaagctcctctaggttccttacataggaggggatgtgggggtggggcacccagcagtggca

SEQ ID NO: 65272 - DNA, 201 bp, Homo sapiens
ggggaccacctggactcctcatcccacccactctgtccagctgctttcctgaggaggagcaagttccctgatctgcctgggatggaaggaagggagggagrcgtgggaggaggcctggatctcattctaaaccatccggctccagtgcaggagtcgggcgaaggaaggagctgcagggctggagctgtcatcctcctggta

SEQ ID NO: 65273 - DNA, 201 bp, Homo sapiens
ttttgctgcttctacttgggactaattcagctctcagcataactagggtggtcccggcttatggttctgggagcaaatggctctggtggcttgagggcaamgcgcccactgctaagcggcaaataaggaatccctcctccctggtcagcatttgggtgggttatagtcttgatccatgggcccgttggctggtggctgtac

SEQ ID NO: 65274 - DNA, 201 bp, Homo sapiens
gctgcacccatgcttggggcacatccccaactctgccccccagcccggatggtggggaaacccatccccagagcctggtgtgaagtttctaggagacttgscttccctggctgccacttgtgtctctatcctcgaactcagttcccttgaaaagtctgagtctctatctgtgccccaccctgagtccctttgtccctccca

SEQ ID NO: 65275 - DNA, 201 bp, Homo sapiens
tgcttcagaaactctttatttcatggttagtataaaagcaactttagcattgccaacatcgaaactgacagggattctgaattagtgggatcagttagtgrggattttcttacaaagagctccagaatgtagcctgccccttggctggccccgaatggccttggacggccccaacatgctgatcctcctcctttaccggaa

SEQ ID NO: 65276 - DNA, 201 bp, Homo sapiens
cctcccccaggttctaaacactttcctccccacccctgctaggcaaggggatgggaggtgcaatggggaggactcttcacagcctcactcctgggggagarggtagaagaggctgaaaaccacaagagttcttaccagtacttcctcgtataaactcttccgcaggcttttcagcagagtctgcaaagcatctttggtgaa

SEQ ID NO: 65277 - DNA, 201 bp, Homo sapiens
agactgacccactcccattccacccaggggaatcttttcctcctcagctcccccaaacacccacagagtggggtgtgcaaactccccaggctgcttcttgrgactgttcttggtgtctgtgccttatttccttccctatcctgcatcccatgtacattactgagcccactgtcggggcagggatgtgtctgtttcatctgc

SEQ ID NO: 65278 - DNA, 201 bp, Homo sapiens
gcatcaagggctttaccccaacctgcagcccagccttccctgggtgagcttgctatgcgcagccacatttaccatgtggggctccctattctgatggcctrttcggtgccgggtttactcactgccctgttctgatgtcagtgcctgtacatacctccaaaggcaggacttgcctgataaatatttttcctcctctgaact

SEQ ID NO: 65279 - DNA, 201 bp, Homo sapiens
ctaataggagtctgattctcaggaggggggtcagtggacgtcagagcatctcccttgcattagctgacctgctcatgtgcctgcacgtgtgtgtctcctcrggccagcacgagtcagtgtggacagccctgtgtcccggagttgctgaataagagggagagggagactccactgagagcttgggctcctggggccaggctc

SEQ ID NO: 65280 - DNA, 201 bp, Homo sapiens
ctttaccccaacctgcagcccagccttccctgggtgagcttgctatgcgcagccacatttaccatgtggggctccctattctgatggcctgttcggtgccrggtttactcactgccctgttctgatgtcagtgcctgtacatacctccaaaggcaggacttgcctgataaatatttttcctcctctgaactggattttata

SEQ ID NO: 65281 - DNA, 201 bp, Homo sapiens
acttgaactcctgggctcaaggatcctcccacctcaacctactaagtgctgcaggtacatgccattgtgcctggtttataagaaaaaacatttttaatgaygacttccccccacatgcccaacttgcaaggcatcttggcaggagagtttgagtcactctcctgcctgtgtggttacagcccacacagggagacttgcaga

SEQ ID NO: 65282 - DNA, 201 bp, Homo sapiens
aattgaatatactgcctcagcctccccagtagctgggattacaggcatgcgccaccacacccagctaatttttgtatttttagtagagatgggtttcaccrtgttggccaggctggtcttgaactccggacatcaggtgatccgccctgtctcagcctcccaaagtgctgggattacaggcatgagccaccatgcctggcc

SEQ ID NO: 65283 - DNA, 201 bp, Homo sapiens
agtgctgcaggtacatgccattgtgcctggtttataagaaaaaacatttttaatgatgacttccccccacatgcccaacttgcaaggcatcttggcaggasagtttgagtcactctcctgcctgtgtggttacagcccacacagggagacttgcagaggcaggtgtgggatagagtctttcccatacattctatgagggta

SEQ ID NO: 65284 - DNA, 201 bp, Homo sapiens
gactttttttgagacagggtctcactgtgtcgcccagggcaaggatgcccaaagacaccaggttggagaggcacctgccaactacttgctttccctggagmctgcatgtgcctgtggggtggggaggcgtaggggtctacggctgcctgagatgggtgtgcacagtgtgtgaagtacctacctccttgccttgctggactg

SEQ ID NO: 65285 - DNA, 201 bp, Homo sapiens
ctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccagg

SEQ ID NO: 65286 - DNA, 201 bp, Homo sapiens
tctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcccag

SEQ ID NO: 65287 - DNA, 201 bp, Homo sapiens
ttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgccca

SEQ ID NO: 65288 - DNA, 201 bp, Homo sapiens
ctttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgcc

SEQ ID NO: 65289 - DNA, 201 bp, Homo sapiens
tctttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcgc

SEQ ID NO: 65290 - DNA, 201 bp, Homo sapiens
gtgggtgtctgtgatgagcatgtgtaagtgtgagtgtgcctgtggctgtgtgtgtaggtgcctgcggctgggagtgatgagggtggattcttaggacgcamgaagcaacaagaggaccttcttctcagtatagatttattttatattttaataactattttcttaaattagtatgtgctgacagttaaaaaaaaaaaaggt

SEQ ID NO: 65291 - DNA, 201 bp, Homo sapiens
ttctttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctgtcg

SEQ ID NO: 65292 - DNA, 201 bp, Homo sapiens
tcctggagacaacctccttggcctggggcagttctggggtgctggcacagggaggagaggcctggagggagtgctcttctctcagggtttccgggaggctsttggaagcctcggtgtgtctgggggtgaatctattaatataattgtgcgtttctgggaatgggtgtgtgtgtcatggacgctgggttcgcacctgtgtca

SEQ ID NO: 65293 - DNA, 201 bp, Homo sapiens
tttttctttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctctg

SEQ ID NO: 65294 - DNA, 201 bp, Homo sapiens
ctttttctttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtcttgctct

SEQ ID NO: 65295 - DNA, 201 bp, Homo sapiens
ttctttctttttctttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacagagtct

SEQ ID NO: 65296 - DNA, 201 bp, Homo sapiens
ctctttctttctttttctttctctctttctttctttcttgcttttctttcctttctttcttttctttctttctttctttcctttctttctttctttctttcttttctttctttctttctttcttttctttctccctctctctctctttctttctttctctctctctctctttctttcttttctttctttctttctgacaga

SEQ ID NO: 65297 - DNA, 201 bp, Homo sapiens
tgggaccctctgctctggggccatatcaagggactgagggctggcgggtgggctgccatgccttttgcctccccctacacaaaccccagtgccccatcacmttcctccatcgttcctcagtaaccctcctggctgcggacctcccctctggctcagcccccttgactcagctcctccatccagaccctctgcccagctgcc

SEQ ID NO: 65298 - DNA, 201 bp, Homo sapiens
agtttgatttggtctgtctcacagagttttcttgggtttcaacaggaacacttcctctgttcatctggtatcacagctgggtttggccaacagcaaccagrctctgggaccctctgctctggggccatatcaagggactgagggctggcgggtgggctgccatgccttttgcctccccctacacaaaccccagtgccccat

SEQ ID NO: 65299 - DNA, 201 bp, Homo sapiens
cccctttcaagtggtttcccagacacaagcagagtccaggggagggcagctggggtggtgaagaggcttgcactcttgtccctggaggaatggtagaaggygtttggggtatttagcctggtacagagaaggttctagatgtggttgttttctttctttcttttcttttctttgttttttcttttttttttttttttttag

SEQ ID NO: 65300 - DNA, 201 bp, Homo sapiens
agctgcccagctcctgcctccttacctttgcaaacttccccatcatcccgaagggacccaacctgtggccgctgccctccgactggcatttctgtagggcmctgctccttgcatgatctcccgtccagccgggtctctgttcttctccccagggacagtctttgtggttcagtgggaccacgtttatctccaaggctggga

SEQ ID NO: 65301 - DNA, 201 bp, Homo sapiens
accggagccaagtgaagatccacacaatactctccaacacccaccggcaggcttcggtgagtgccccagtcgccagccatgcttccctgtgctgggaggcygggggccaaaccaccctgcctggtcagtgggcatggctgtggcccgaggtctgtgacctgggaggtaccttccagggattcccatgggactttgccagag

SEQ ID NO: 65302 - DNA, 201 bp, Homo sapiens
atgaaagaaagggaagggaaaagggtgtgtcccgggtttccggcctgcatggagtgccattcaccgagacagaggaaagaagaaaatgtgcttggaggtgrtgtggagaggacttggaatttgggtggggtcccactgggcttccaatgtcttggagtcctccaggaggtggtgccatccagaaagatgggtctggagctc

SEQ ID NO: 65303 - DNA, 201 bp, Homo sapiens
aggcacatttggctctaataggagtctgattctcaggaggggggtcagtggacgtcagagcatctcccttgcattagctgacctgctcatgtgcctgcacrtgtgtgtctcctcgggccagcacgagtcagtgtggacagccctgtgtcccggagttgctgaataagagggagagggagactccactgagagcttgggctc

SEQ ID NO: 65304 - DNA, 201 bp, Homo sapiens
tatggccccagcgagccccacagccgggaactgtgggtagatgtggccgaggccaaccggagccaagtgaagatccacacaatactctccaacacccaccrgcaggcttcggtgagtgccccagtcgccagccatgcttccctgtgctgggaggccgggggccaaaccaccctgcctggtcagtgggcatggctgtggccc

SEQ ID NO: 65305 - DNA, 201 bp, Homo sapiens
acagacagatttgagagccacttagcaggttaagcaacagaattcggagatgcattagatggggaagggaagaaatgaaagaaagggaagggaaaagggtrtgtcccgggtttccggcctgcatggagtgccattcaccgagacagaggaaagaagaaaatgtgcttggaggtggtgtggagaggacttggaatttgggtg

SEQ ID NO: 65306 - DNA, 201 bp, Homo sapiens
taatttgtggtcattctttgctcaacaaatcctccattgaacacatactctgtgcttaaacacgataaataaaggctgaccttactcttggggtcttacgrtcttacaggaaaggcagacatgaagatgtgtataaaatccaagtaaattgtcacaagtgtgcaaaacaccaggagaaagaagcacagggtgtgatgggaa

SEQ ID NO: 65307 - DNA, 201 bp, Homo sapiens
ctgaaataagggatggtggaggccacttgcagggggtggaggtcctcattggggaggtaggggtgaaaggctgataagaaggcagggtttggctaggcgcrgtggctcacacctgtaatcccagcaccttgggaggcccaggtgggtggatcacttgaggtcaggagtttgagaccagcctggccaacatggtaaaacccc

SEQ ID NO: 65308 - DNA, 201 bp, Homo sapiens
tataatttgtggtcattctttgctcaacaaatcctccattgaacacatactctgtgcttaaacacgataaataaaggctgaccttactcttggggtcttaygatcttacaggaaaggcagacatgaagatgtgtataaaatccaagtaaattgtcacaagtgtgcaaaacaccaggagaaagaagcacagggtgtgatggg

SEQ ID NO: 65309 - DNA, 201 bp, Homo sapiens
gaagcaggctgggaggcagccatcggactcttcctttgtgcagatctctctgcacagagtgccacgcacggagctttgtttcttgatgggtgatttttttwaaaattgagataggggtctccagcagagatgggtggaaataggagagacagacaccaaggaaaaacatgaagcattagttctcctggaggatggggaaag

SEQ ID NO: 65310 - DNA, 201 bp, Homo sapiens
catgtctctctttagctatctggaacagagaggtgaagttgcctattcaggatcacacagccagtaagtggcaaaaccaggacaagaacccaggtctttgscttcagagcctaagctctttctcacaatttaacttaatttaattaaaaacttttttgagatagggtcttgctctgttgcccaggctggaacacagtggcg

SEQ ID NO: 65311 - DNA, 201 bp, Homo sapiens
gaagcacacgtgttcattcagtggtcggggagaggtgtgctgtgcctgtcttgcttccatgagccagggctagttgccactgtctgccatcccgtcactamaagatgcctagccttacaatgaagcccacactgaaagtggcagagaagaaagactgaaagagcttggtcttggtcattgagccacattccccgtcaaccc

SEQ ID NO: 65312 - DNA, 201 bp, Homo sapiens
caagcaattctcctgcctcagcctcccgagtagctgggattatggatgcccgccaccatgcccggctaatttttgtatttttagtagagacggggtttcgrcatgttggccaggctggtctcgaattcctgacctcaggtgatccacccacctcagcctcccaaagtgctaggattataggtgtgagccaccacgcccggc

SEQ ID NO: 65313 - DNA, 201 bp, Homo sapiens
ctgctgggctgtaccctgcatgctgggggacacagtctcccagggaagctctcaggttcaggcccaatggcagcctgagtagggccctccaagaacctagmccacatgccagccccaccccggggctgcccctgcaccctgggaaacagtggggattgtcggtcactttttactgcactttctgtggttctgagtaggctc

SEQ ID NO: 65314 - DNA, 201 bp, Homo sapiens
cctttctttctttctttctctttctttctttttctttctctctttctttctttcttgcttttctttcctttctttcttttctttctttctttctttcctttctttctttctttctttcttttctttctttctttctttcttttctttctccctctctctctctttctttctttctctctctctctctttctttcttttctt

SEQ ID NO: 65315 - DNA, 201 bp, Homo sapiens
cgtggaataatgaaggatcttttataattgcctttccttttcatatttgttagggtctttatgggtaactgatactttaaaaaaatcaaggtaaacaggasagagttggatatgttatgaataatttctgggctcctttgaatcctcaacctggtgtgatcttctgaactctgggtgtaacagagtttatgaggggaggat

SEQ ID NO: 65316 - DNA, 201 bp, Homo sapiens
ttttggctgttgtgaatagtgctgctgtgaacatgtgtaaatgtacttaaatttctttccctttctttctttctttctctttctttctttttctttctctctttctttctttcttgcttttctttcctttctttcttttctttctttctttctttcctttctttctttctttctttcttttctttctttctttctttcttt

SEQ ID NO: 65317 - DNA, 201 bp, Homo sapiens
aggatctgaacctttggctggattgtgtgaaccacggagagggctggggaagggggaattgggaggtaacaaggatgggctgggagatagtggccagaccygggcctggctgagggcggccccttcagagtagggttggggtagtagacggttgaggagaccaggaagagtggggcaggcagagacttgaatcacttctct

SEQ ID NO: 65318 - DNA, 201 bp, Homo sapiens
tatgtctggtttctttcacttagcataatattttcaaggtttatccattttatggctgaataatatttaatcgtatgaatgtaccataattcgtttatccrtttatttattgatagacatttaggctgtttctaccttttggctgttgtgaatagtgctgctgtgaacatgtgtaaatgtacttaaatttctttccctttc

SEQ ID NO: 65319 - DNA, 201 bp, Homo sapiens
ctggattgtgtgaaccacggagagggctggggaagggggaattgggaggtaacaaggatgggctgggagatagtggccagacccgggcctggctgagggcrgccccttcagagtagggttggggtagtagacggttgaggagaccaggaagagtggggcaggcagagacttgaatcacttctctaagtagaggctatcctg

SEQ ID NO: 65320 - DNA, 201 bp, Homo sapiens
ttttcttgggtttcaacaggaacacttcctctgttcatctggtatcacagctgggtttggccaacagcaaccaggctctgggaccctctgctctggggccytatcaagggactgagggctggcgggtgggctgccatgccttttgcctccccctacacaaaccccagtgccccatcaccttcctccatcgttcctcagtaa

SEQ ID NO: 65321 - DNA, 201 bp, Homo sapiens
gttttcttgggtttcaacaggaacacttcctctgttcatctggtatcacagctgggtttggccaacagcaaccaggctctgggaccctctgctctggggcyatatcaagggactgagggctggcgggtgggctgccatgccttttgcctccccctacacaaaccccagtgccccatcaccttcctccatcgttcctcagta

SEQ ID NO: 65322 - DNA, 201 bp, Homo sapiens
agagaagaaattgaggaatccagagacaccttcctgtgtccaggatgtcccaggtttgggaatgctgtctgtgggcttggattcccagaggaggcagctgkttcctccacaagtggcttttgtgtcacctgccactggagatgggggaggatgctgtccttgtcagagccacactgcacattctcagcacagtcttgacac

SEQ ID NO: 65323 - DNA, 201 bp, Homo sapiens
ttcaccatgttggccaggctggtctcagaatcctgacctcaggtgatctacccgcctcagcctcccaaagtgctgggattacaggcgggagccaccatgcrtggccaggaacttccgatctataagatttcaaaccaattttataattggtgacccgctcgattgtcagaacatgaggcttccaccatctcaggggctttg

SEQ ID NO: 65324 - DNA, 201 bp, Homo sapiens
tgtttcaagttccccatgtgttcctggcgaagttgcagagatttaaaaatgtgattctgatggtcatgtaggtgtgggaactttttttttttttttttttkagacggagtgttgctcagttgcccaggctggaatgagtggtgtaatctctcggtttactgaagcctctggctccgaggttcaagtgtttctcctgcctca

SEQ ID NO: 65325 - DNA, 201 bp, Homo sapiens
tgctttatttctttcagatttctcctttccacaattcctcatggttagatgtccatttctggaagtgatccttcaattttttcttctctcttctgctgtgygtctcttttgcattttttgttgtttatttgttagtgtgcttgttgttcttctttctggaggattttctcaatcttattttcataatgtcactgatttttt

SEQ ID NO: 65326 - DNA, 201 bp, Homo sapiens
acgggtggatcgcttgagctcaggagttccagaatagcctaagcaacatagtgagacccacgtctctaaaaaattaaaacaaaaattatctggatgtggtkgtttgcccctgtagtcccagctacttgggaggctaaggctggaggattgcttgagcctgggcggtcaaggctgtgctgagctgtgacctcaccagcctgg

SEQ ID NO: 65327 - DNA, 201 bp, Homo sapiens
tgtgcatcccctgccagctaaggaatgggtctcatttccatgttttgtgtagtggttcccaacagaaaacattcattagagtaaaaagtgaagacagttagggctctatgtccttccagtcctggaagaggtggcaaagattctgaagttacatctataagagaaaaaactttttggagggtggaacaggatcttgctatg

SEQ ID NO: 65328 - DNA, 201 bp, Homo sapiens
ctggccaggaacttccgatctataagatttcaaaccaattttataattggtgacccgctcgattgtcagaacatgaggcttccaccatctcaggggctttrtgatcccctctgcagctacacatcgagggtccacacaggagcaaggccacctggaaggaggtccctctgacagccatagggcttgtccccggctctgcct

SEQ ID NO: 65329 - DNA, 201 bp, Homo sapiens
aaggggcagaaacagagggagctgctttcccgagggaggctaagagctctgggcagaagcagtggcttcagtgcctgtgggcagagctggagagcagtgcrtccccctctgggtaccctcccgagactccagggctggtggctgtggcagcaatgggaagcagcatccttagccctcaccccaggggccgtggcatcaggg

SEQ ID NO: 65330 - DNA, 201 bp, Homo sapiens
ggtgcagctcctggagacaacctccttggcctggggcagttctggggtgctggcacagggaggagaggcctggagggagtgctcttctctcagggtttccrggaggctcttggaagcctcggtgtgtctgggggtgaatctattaatataattgtgcgtttctgggaatgggtgtgtgtgtcatggacgctgggttcgcac

SEQ ID NO: 65331 - DNA, 201 bp, Homo sapiens
aggatatgtgcgaagtgcttggcctggagctgggcacgtgactctcagtacacattgggtgtctcctgtcctggtagtcagtcaagtgtctgcaaattctrcagtggcatggtgttggggcccttgcagaataactgggctggattcccctcctgatcttcattccggactgctggcactcaggtttctgtccccttctcc

SEQ ID NO: 65332 - DNA, 201 bp, Homo sapiens
gcagcagctcgtttcatttctgactttccttgagtcagaatagatggaagttttctgtcagttaagaggtgccattgcaggggtcatcgggaactccaagmatgagtccagggatcatccaggtgtcagagctgaggcacgtgacacagggcctggtttctctgcagaacagcactagtttggatcagactgcttgtcttt

SEQ ID NO: 65333 - DNA, 201 bp, Homo sapiens
tctctgattggtccagctcacagccgatacccaggcctggaacaatcacagcgtggccagagaggcaggatcatggaagaagatggcagctgtggttcagyccacctgtaggaatgggccaggcacagtaccccaaggggaatgctgctgtttccagaagacgaaagggtgttgggcggaccaaacactgagtggttcttt

SEQ ID NO: 65334 - DNA, 201 bp, Homo sapiens
gggaagtagactggtttaaccaatctggcacgccctggcccttgtaataatcgggggccacatcagactgaagggaagatcttgtgttccactcttggtgygaggtttctccttttgaacccgacaaggaagcatgctgcctcagtggctataggcagccctctttggaccaggaggcagtcacacttaggacaatgtcct

SEQ ID NO: 65335 - DNA, 201 bp, Homo sapiens
gcctgagcctccacgcccgatctaatttaattttttaattgacaaataattgtacatattcatggggtacatagtaatgtttcaatacatataatgtatartgatcagatcagggtaatttgcacattcataatctcaaacacgtacccttgctttgtggtgggctcattcacactcttgctgtctgtaccagtgaaggac

SEQ ID NO: 65336 - DNA, 201 bp, Homo sapiens
gatgtcaggcctttgctcacccagcttccattccccattcctagcggagccatgatccccagttcctgggggaagtagactggtttaaccaatctggcacrccctggcccttgtaataatcgggggccacatcagactgaagggaagatcttgtgttccactcttggtgcgaggtttctccttttgaacccgacaaggaag

SEQ ID NO: 65337 - DNA, 201 bp, Homo sapiens
gcccaggctggggtgcagtggtgcgatcttggctcactgcagcttcaacttcccaggctcaaacgattctcctgcctcagactctgaatagctcggactaygggagcacgccatcacccctggccagttttggtattttttgtagagatggtggtttcaacatgttgcccaggctggtctcgaactcgtgagctcaagtga

SEQ ID NO: 65338 - DNA, 201 bp, Homo sapiens
catatgcctgtgatcccagctactcaagaggctgaggcggaaggatcacttgagccctggaggtcgaggactgaggctgcagtgagccatgatcaggcaasagagtgagaccctgtctcaaaaaaaaaaaaaaaaaacctaaaataaataaaaatagaaaacttggagtcagtggaaaagaatgtttaagataaagaagtt

SEQ ID NO: 65339 - DNA, 201 bp, Homo sapiens
cacattccccgtcaaccctgatgtcaggcctttgctcacccagcttccattccccattcctagcggagccatgatccccagttcctgggggaagtagactrgtttaaccaatctggcacgccctggcccttgtaataatcgggggccacatcagactgaagggaagatcttgtgttccactcttggtgcgaggtttctcct

SEQ ID NO: 65340 - DNA, 201 bp, Homo sapiens
gactcgatctcctgacctcgtgatccacccacctcagcctcccaaagtgctgggattacaggtttgagccactgtgcccagcctcttttttttttttttttgagacagagtctcgctctgtcgcccaggctggagtgcaatggcatgatcttggctcactgcaacctctgtctcctgggttcaagcaattcttgtgcctca

SEQ ID NO: 65341 - DNA, 201 bp, Homo sapiens
aagtggcagagaagaaagactgaaagagcttggtcttggtcattgagccacattccccgtcaaccctgatgtcaggcctttgctcacccagcttccattcyccattcctagcggagccatgatccccagttcctgggggaagtagactggtttaaccaatctggcacgccctggcccttgtaataatcgggggccacatca

SEQ ID NO: 65342 - DNA, 201 bp, Homo sapiens
gattcagctcatttggcaagcagatgctgaacacccaccagatgccaggtgccaacccctgcgctagggaggtgctgggggcggagatgaatgtgccaccrtccctgagctccagcctccagacagtggtccttctgattgagagtttaaccaatgactggtaggtagcctaagtcaccttcccggagagctgttgcttaa

SEQ ID NO: 65343 - DNA, 201 bp, Homo sapiens
agatgaatgtgccaccgtccctgagctccagcctccagacagtggtccttctgattgagagtttaaccaatgactggtaggtagcctaagtcaccttcccrgagagctgttgcttaaagatctcagagacagtggatagaggaaaggtcactgtctttgagtggaactgacctggtttcatacagttacattatttctttt

SEQ ID NO: 65344 - DNA, 201 bp, Homo sapiens
gcacctgtttagcatctgcagctgtcctgctttgtttggtaaaatgatcctatcctggacttcagaatatgtagtggtacctgtaaaacaggcagctatamtttgtggtcattctttgctcaacaaatcctccattgaacacatactctgtgcttaaacacgataaataaaggctgaccttactcttggggtcttacgatc

SEQ ID NO: 65345 - DNA, 201 bp, Homo sapiens
ctacggccgtggcaggtggtcccaggtgaaccataaccagcttcagagttggagtcctacagactatcagatgtacagtgttgggcagggccccctatatkttttttgcttggaagtggaataaaaactgctcacctgtgaatccaggaagcaggctgggaggcagccatcggactcttcctttgtgcagatctctctgca

SEQ ID NO: 65346 - DNA, 201 bp, Homo sapiens
tatcagatgtacagtgttgggcagggccccctatatgttttttgcttggaagtggaataaaaactgctcacctgtgaatccaggaagcaggctgggaggcrgccatcggactcttcctttgtgcagatctctctgcacagagtgccacgcacggagctttgtttcttgatgggtgatttttttaaaaattgagataggggt

SEQ ID NO: 65347 - DNA, 201 bp, Homo sapiens
aaaggaagtcaattctgccatatgctacgacatgaatgaaccttgaatttattatgctaagtgaaataagccaatcacaaaaagacaaatatagtatgatkccatttatatgagatacttagagtagtcaaaatcatagatacaggctgcgcgctgtggctcatatctgtaatcccagcaccttgggagccaaggcaggaa

SEQ ID NO: 65348 - DNA, 201 bp, Homo sapiens
aggctggagtacagtggcgcaatctcggctcactgcaacctctgcctcccaggttcaagcaattctcctgcctcagcctcccgagtagctgggattatggrtgcccgccaccatgcccggctaatttttgtatttttagtagagacggggtttcgccatgttggccaggctggtctcgaattcctgacctcaggtgatcca

SEQ ID NO: 65349 - DNA, 201 bp, Homo sapiens
gggaagcagcatccttagccctcaccccaggggccgtggcatcagggcagcccccctaccaggtggctttgtgagtaaaaccaagaatccaacaagagtgrccccatgtaactcttgcaaatagtacacatgagtcaccccttgaggactccctgaaataagggatggtggaggccacttgcagggggtggaggtcctcat

SEQ ID NO: 65350 - DNA, 201 bp, Homo sapiens
gtgtgcatcccctgccagctaaggaatgggtctcatttccatgttttgtgtagtggttcccaacagaaaacattcattagagtaaaaagtgaagacagttagggctctatgtccttccagtcctggaagaggtggcaaagattctgaagttacatctataagagaaaaaactttttggagggtggaacaggatcttgctat

SEQ ID NO: 65351 - DNA, 201 bp, Homo sapiens
gttcgagaccagcctgcccaatatggtgaaaccctgtctctactaaaaacacaagaaaattagctgggcgtggtggtacatgcctgtaatcccagctactygggaggctgaggcaggagaattgcttgaatccgggaggcagaggttgcagtgagccgagatcgtgccactacactccagcctgggtgacagagcgagact

SEQ ID NO: 65352 - DNA, 201 bp, Homo sapiens
tgtgtgcatcccctgccagctaaggaatgggtctcatttccatgttttgtgtagtggttcccaacagaaaacattcattagagtaaaaagtgaagacagttagggctctatgtccttccagtcctggaagaggtggcaaagattctgaagttacatctataagagaaaaaactttttggagggtggaacaggatcttgcta

SEQ ID NO: 65353 - DNA, 201 bp, Homo sapiens
agaccaggagtttgagaccagcctgggcaaaatagtgagaccccatgtctataaatgatttaggccaggcagggtggctcatgcctgtaatcccagcactytgggaggccgaggccggcggatcacctgaggtcaggagtttgagaccagcctggctaacatggtgaaaccccgtctctactaaatatacaaaaattagta

SEQ ID NO: 65354 - DNA, 201 bp, Homo sapiens
tgggctgtctggaggcaggaagggagggcagtggcagagggaatagcccccgacaccaaccaaccatgcttcttccgctcatcgtcccccagcctgccccraccccaggtctccagattgtgtcgcttatcgtaagagcagagtgccttctggcaggtgaggagtgcaggaaccccttgtccctgctcacgctgcgcccag

SEQ ID NO: 65355 - DNA, 201 bp, Homo sapiens
ccagccatgaagtttcgcagccaccctgaccattccacctatgcggaggtggagccctcgggccatgagaaggagggcttcatggaggctgagcagtgctragaacaccaagtctcccctttgaagactttgaggccacagaaaagacagttaaagcaaagaagagaagtgacttttcctggcctctcccagcatgccctg

SEQ ID NO: 65356 - DNA, 201 bp, Homo sapiens
ctgtgtgcatcccctgccagctaaggaatgggtctcatttccatgttttgtgtagtggttcccaacagaaaacattcattagagtaaaaagtgaagacagttagggctctatgtccttccagtcctggaagaggtggcaaagattctgaagttacatctataagagaaaaaactttttggagggtggaacaggatcttgct

SEQ ID NO: 65357 - DNA, 201 bp, Homo sapiens
tcccagctcactgcaacctctgcctcccaggttcaagcaattctcccacctcagcctcccaagtagctgggactacaggtgcacaccaccacacccagctwatttttgtatttttagtagagactgggttttgccatgttggccaggctggacttaaactcctgacctcatgtgatccacccaccttggcttcccaaagtc

SEQ ID NO: 65358 - DNA, 201 bp, Homo sapiens
gaaggaaaggaaagaagaaaaaagttaacattttaaaacattattcagccacgtttttcttccccctctagccctatgttaggatttttttttttttttttgagacagggtctcactcttgctcaggctggagtgcactggagtgatcatggctcaccacagcccgcaactcctgggctcaagcaatcctccaacctcagc

SEQ ID NO: 65359 - DNA, 201 bp, Homo sapiens
aggattagctccagaaatgggggtcataaacccataccaaaggctcaatctttgaaagaatcagttagcacagtctaaaagaaactattttttttttttttaagagacagggtcttgctctgtcacccaggctggagtgcagtggtgccatcatagctcactatagccttaaattcctgggctcaagcaatcctcctgcct

SEQ ID NO: 65360 - DNA, 201 bp, Homo sapiens
gaaaatgtgcttggaggtggtgtggagaggacttggaatttgggtggggtcccactgggcttccaatgtcttggagtcctccaggaggtggtgccatccasaaagatgggtctggagctcacaggggagggctgggtgggccccagagcgtttgggaggtggacggagtctcttctccctgccgcagatccctatgtctgt

SEQ ID NO: 65361 - DNA, 201 bp, Homo sapiens
caggattagctccagaaatgggggtcataaacccataccaaaggctcaatctttgaaagaatcagttagcacagtctaaaagaaactattttttttttttttaagagacagggtcttgctctgtcacccaggctggagtgcagtggtgccatcatagctcactatagccttaaattcctgggctcaagcaatcctcctgcc

SEQ ID NO: 65362 - DNA, 201 bp, Homo sapiens
gggttctggccattctcctgcctaagcctcccgagtagctgggactacaggtgcctgcaaccacgcctggctaattttttgtattttttttttttttttttagtagagatgaggtttcaccgtgttagccaggacagtctcgatctcctgacctcatgatccgcccgcctcggcctcccaaagtactgggattacaggcgt

SEQ ID NO: 65363 - DNA, 201 bp, Homo sapiens
ggctggagtgcagtggcgcgatctcggttcactgcaagctccgcctcccgggttctggccattctcctgcctaagcctcccgagtagctgggactacaggygcctgcaaccacgcctggctaattttttgtattttttttttttttttttagtagagatgaggtttcaccgtgttagccaggacagtctcgatctcctgac

SEQ ID NO: 65364 - DNA, 201 bp, Homo sapiens
tgaactcctgggttcaagtgatctgccctcctcggcctcccaaaatgctgggattacaggtgtgagccactgcacccaggctatcaagatatcaagaagcrtttttttttttttgagacggagtctcgctctgtcacccaggctggagtgcagtggcgcgatctcggttcactgcaagctccgcctcccgggttctggcca

SEQ ID NO: 65365 - DNA, 201 bp, Homo sapiens
tgatcagggcttcttgcacacatttcaaggaaacatcattccatttggtggacttgccaagcggcgtggctcgtgtaaccctcactgagctcctttgtaaygtcaagtcatcctggtcagagcttctacaatgggctgtgaattgtgtgaattccttgggaaggttcactgccaggcaaggtctccgcatcctttttaaga

SEQ ID NO: 65366 - DNA, 201 bp, Homo sapiens
caagcgtacagtgagctgtgattgtgccactgcactccagcctgcatgctagagtgagaccctgtctcaaaaaaagcatgcatttaacaacctagagggarctggagaggagatcatggaacctaaagccatttcgcaacctccagaaatggaggttcgcatggccgcgaaatggcctgtgtgtagtcactttccaatcct

SEQ ID NO: 65367 - DNA, 201 bp, Homo sapiens
attgagcttctatgaaagatttgttggaagaaatgatttcaggaccaaaaatgtttgaaatccatatcacactgcctcccaaaacaaatgtggattattgmtcagggcttcttgcacacatttcaaggaaacatcattccatttggtggacttgccaagcggcgtggctcgtgtaaccctcactgagctcctttgtaatgt

SEQ ID NO: 65368 - DNA, 201 bp, Homo sapiens
caaatctaccagggagataggcacatagtcgcacacgtaggtgctctaggagagggagagccacatccaggagctctggggagtgggctgggggaaggcakaggttgagacaggtatctgacacagggtgggcctgaaatggaagagggtcataggtggggaatgtcagatccacctatctgatggtctgttctcatatat

SEQ ID NO: 65369 - DNA, 201 bp, Homo sapiens
cctgtgtcagggcagggaccccatcatccaagacagttggcagggagagtgcaagacctgcctggtttctacaaccttccaaaggaggcagctcccgaaaraaggttttcagaacgcagggccttgggagacaggaagccagtcagactcctcgcacaaaccacagggggcaagcagtgctcctccaagaacctggcccca

SEQ ID NO: 65370 - DNA, 201 bp, Homo sapiens
gctctggggccatatcaagggactgagggctggcgggtgggctgccatgccttttgcctccccctacacaaaccccagtgccccatcaccttcctccatcrttcctcagtaaccctcctggctgcggacctcccctctggctcagcccccttgactcagctcctccatccagaccctctgcccagctgcctccattcagcc

SEQ ID NO: 65371 - DNA, 201 bp, Homo sapiens
gtcttgctctgttgcccaggttggaatgcagtggtgggatcatggctcactgcagcctcgacctcctgggctcaagggatcttcccacctcagcctcccargtaactgggactataggcatatgccactacaacaggctaatttttaaattttttgtagagacaagatctcactaagttgcccagggtggtcttgaactcc

SEQ ID NO: 65372 - DNA, 201 bp, Homo sapiens
gagggcggccccttcagagtagggttggggtagtagacggttgaggagaccaggaagagtggggcaggcagagacttgaatcacttctctaagtagaggcyatcctgtcttcttggctttgacagagattgagccaggagaaatgcactttttctgcagcaggagggatagaggttagacttaaggaatctgtaagaagcc

SEQ ID NO: 65373 - DNA, 201 bp, Homo sapiens
tcagttcctaagtctccaagatctttcaactcagctctcttgctgccagcttctcagtttcccaatttcaccctcccgggtggtgatctgattggctcagkctgcacaagctgtagattgtaggcttccaatagatgagctgcttttgaatcatgtgattacctatgtccaatcagtctgaggaagcacagggtcatgtag

SEQ ID NO: 65374 - DNA, 201 bp, Homo sapiens
cagcctcaagagtccccctcctcacacctgctcccatttgccctggcagcctttggctttcagctactctggctctagatggggcactggggtagggggtrgagggaggcgtcccattctgcacactcctcttcccccctaccagttctccaaactcatctctcccacctggaagtcctttctgagatctacctggaatcc

SEQ ID NO: 65375 - DNA, 201 bp, Homo sapiens
ctgtgattgtgccactgcactccagcctgcatgctagagtgagaccctgtctcaaaaaaagcatgcatttaacaacctagagggaactggagaggagatcrtggaacctaaagccatttcgcaacctccagaaatggaggttcgcatggccgcgaaatggcctgtgtgtagtcactttccaatcctgtgcccatggcagac

SEQ ID NO: 65376 - DNA, 201 bp, Homo sapiens
atgccaccatgcccagctaatttttgcatttttttttttgtagacttggggggagggtctcactatgttgcccaagctggtcttgaactcctggattcaarcgatgtttctgcctcagcctcccaaagtgcttcttgtcttttgagagtactggttcattggttggattcagatggcaagtggacattgcggttgactttt

SEQ ID NO: 65377 - DNA, 201 bp, Homo sapiens
cctggacccttgctggtgtccagatgtctgcggttgtcagccccttcctttcccccgacctaaacataaaagacaaggcaaagcccgcataattttaagayggttctttaggacattagtccaccatcttcttggtttgctggctctccgaaataaagtccctttccttgctccaactccttgtctctcaacgtattggct

SEQ ID NO: 65378 - DNA, 201 bp, Homo sapiens
gctcactgtggcctcaacctcctggctcaagcaatcctcctgcctcagtcccccctgtagttgaaaccacaggtgcacaccaccacacccggccatttttytaatattttgtagagatggggtctcactttgttggccaagctggtcttgaactcctgggttcaagtgatctgccctcctcggcctcccaaaatgctggga

SEQ ID NO: 65379 - DNA, 201 bp, Homo sapiens
agggcagtggcagagggaatagcccccgacaccaaccaaccatgcttcttccgctcatcgtcccccagcctgccccaaccccaggtctccagattgtgtcrcttatcgtaagagcagagtgccttctggcaggtgaggagtgcaggaaccccttgtccctgctcacgctgcgcccagggcaagggccggctgggcagctgg

SEQ ID NO: 65380 - DNA, 201 bp, Homo sapiens
atgcttccctgtgctgggaggccgggggccaaaccaccctgcctggtcagtgggcatggctgtggcccgaggtctgtgacctgggaggtaccttccagggrttcccatgggactttgccagagttggggtgcccagcagtggccctgggcatgcctgctccccactctgtccaaacaagcatgaggcagtgtgggtgccca

SEQ ID NO: 65381 - DNA, 201 bp, Homo sapiens
ccccttggaagtgcttccaaaggcagatgccgattcagcagtcttggggttgggcccaataatctgaatttctaacgggctcccagtgatgctgatgttgyggcccaggggtgctcttggaaaagcaggatctagaatgcatttctgttggccttgtaaggcttcctggtatatgtgccctgcgatcgaagggcagggact

SEQ ID NO: 65382 - DNA, 201 bp, Homo sapiens
agtagagacggggtttcaacatgttggcccggctggtctcaaactcctgacttcaagtgatccgcctacctcggcctcccaaagtgctgggatttcaggcrtgagtcactgcacccagtcccccccccctttttttttttttttttgacagagtcttgaactgtcaaccaggctagaatgcagtggcgtgatctcagctca

SEQ ID NO: 65383 - DNA, 201 bp, Homo sapiens
atctgccagagtcacatcatctcatgccttatctgatatgtcatgtgatatgtcagagcaagactcaatatgctgggtcaggccaggcgcagtggctcacrcctgtaatcccagcactttgggagcccgaggagggtggatcacctgaggtcggtctctactaaaaatacaaaatttagccgggcgtggtggcgggtgcct

SEQ ID NO: 65384 - DNA, 201 bp, Homo sapiens
tgggggcttctggaagaccatttagggattccagctactcaggctccctcctcacacccaggaggagagggttcatcctggaacagggcttctcggagtgytccacagctgtgggcattagaccctgggctccagttaaacacactggattcctgggacccatcccagaccctctgtatcaggatctctgggagagaaccc

SEQ ID NO: 65385 - DNA, 201 bp, Homo sapiens
atcacctgaggtcggtctctactaaaaatacaaaatttagccgggcgtggtggcgggtgcctgtaatcccagctacttgggaggctgaggcaggagagtcrcttgaacctgggaggcagaggttgccgtgagccgaggtggtgccattgcactccagcctgtgttacatgagcgaaactccatctcaaaaaacaaaacaaa

SEQ ID NO: 65386 - DNA, 201 bp, Homo sapiens
tagccgggcgtggtggcgggtgcctgtaatcccagctacttgggaggctgaggcaggagagtcgcttgaacctgggaggcagaggttgccgtgagccgagrtggtgccattgcactccagcctgtgttacatgagcgaaactccatctcaaaaaacaaaacaaaaaagcgctgggtcagagtggcctgcaggggtgcgtga

SEQ ID NO: 65387 - DNA, 201 bp, Homo sapiens
gccttgatgggggtaggactccgctcagactgaacctgagctgctggggggatggcagtggcagggagtagacaaggggcagagagttgagagggaaaccrggcaggaaaggatgcccagtgacttccagcttttctttgttatagcagagggaccattttctccagcaaaatctccaatgggaggcactgctctggttgt

SEQ ID NO: 65388 - DNA, 201 bp, Homo sapiens
tctcatagggttgttctaaaaatcagatgcactgattgcttgagaaagttaactagaaaaatccctcccagatcttacctgaaagtacaaaaataggattrtagtcacaaaagaggatttcctggccttgaagcttcaggtgttatctttcatattcttaatactcttcaaggtgtgggaagggaccggcagcactggcag

SEQ ID NO: 65389 - DNA, 201 bp, Homo sapiens
gagtggaggttgcagtgagctgggatcacgccactgcactccagcctgggcgacagagcaagactgtctcaaaaataaaataaagtaaaataaaataaacsattttaaagtgaacaattcagtggcatttaataaattcacaatgttgtgcaaccaaccccccatccagttccaaaaccttttctgttttgtttttgttct

SEQ ID NO: 65390 - DNA, 201 bp, Homo sapiens
cttaattggatacaatgtctaatgacaaagcagggccccacagcggagttctggcctcagccccaggcctgggcctggccaagcctggtctcaacctctgyccttgctggctcccaggagctaccctatgcactgcgtcctcaattctgcagtgatggagcacctgctgtttgctggacatgccaaatttgaagaaggtgg

SEQ ID NO: 65391 - DNA, 201 bp, Homo sapiens
ttctacaaccttccaaaggaggcagctcccgaaagaaggttttcagaacgcagggccttgggagacaggaagccagtcagactcctcgcacaaaccacagrgggcaagcagtgctcctccaagaacctggccccaccagggtgctcaagggaacgaggtaaggaggccaatcccggaagattctgggagcagagttggggg

SEQ ID NO: 65392 - DNA, 201 bp, Homo sapiens
aaaaagatgggctgaatagcatctaaacttggtttcctttcttcaggcaaaattttaggctaactgatgtctcttaataagccacttttttgtttgaactrgggggaagagggcaggctgtagctacggccgtggcaggtggtcccaggtgaaccataaccagcttcagagttggagtcctacagactatcagatgtacag

SEQ ID NO: 65393 - DNA, 201 bp, Homo sapiens
aagactccgtctcaaaaaaaaaaaaaaaaaaagaaagaaaaaaaaagatgggctgaatagcatctaaacttggtttcctttcttcaggcaaaattttaggstaactgatgtctcttaataagccacttttttgtttgaactggggggaagagggcaggctgtagctacggccgtggcaggtggtcccaggtgaaccataac

SEQ ID NO: 65394 - DNA, 201 bp, Homo sapiens
ctccttcctcccacgctcccaaatgctcccctgcaggctttgtgcttggctctgcccaggagtgatccccctgcaagtcgccccctccctccagggtgcartttggcctcacccatcactgtgtggccaccctcagccagagctgagtagatatggctcctggcttcactgtcctggagtaataaaagtcaggtgtgccag

SEQ ID NO: 65395 - DNA, 201 bp, Homo sapiens
agcagtgtcacggcagctcagagtcaaggcgaccttgaggatcactggagctcatgcagtcctgctagcccctacacctactcacatgggcagatgtggcyttggtcctggggagctgggtgggaaggaaggcagggatgccacaaataccttcatcttccggggaagtagagggaatgggagtgcctgactacctcagcc

SEQ ID NO: 65396 - DNA, 201 bp, Homo sapiens
taattttaaccttcacaataaccctattaggtgggtgttattatccttgttcaaaagaaatgataatgaagacacagagaggttagataatttgcacaagstcacacagctagtaagtggcagagcatagatttcaacccaggcagccagatttcagatcccaaactcttaaccctccgatgccctttgtgaattccttaa

SEQ ID NO: 65397 - DNA, 201 bp, Homo sapiens
gaacaacaacctaatctcatcctgttttgatgcaagggttctcttctgtgtcttgtaaccatgaaacagcagaagaactaacataactaactccatttttrtttaaggggcctttacctattcctgcacctaggctaggataactttagagcactgacataaaacgcaaaaacaggaatcatgccgtttgcaaaactaact

SEQ ID NO: 65398 - DNA, 201 bp, Homo sapiens
accatgaaacagcagaagaactaacataactaactccatttttgtttaaggggcctttacctattcctgcacctaggctaggataactttagagcactgasataaaacgcaaaaacaggaatcatgccgtttgcaaaactaactctgggattaaaggggaagcatgtaaacagctaactgtttttgttaaagatttatagg

SEQ ID NO: 65399 - DNA, 201 bp, Homo sapiens
agcactgacataaaacgcaaaaacaggaatcatgccgtttgcaaaactaactctgggattaaaggggaagcatgtaaacagctaactgtttttgttaaagrtttataggaatgaggaggtttggctattgtcacatgacagactgttagccaaggacaaagaagttctgcaaacctcccctggacccttgctggtgtccag

SEQ ID NO: 65400 - DNA, 201 bp, Homo sapiens
accactacctcctcctccctcttcatcgacagcctcaccacagaaggtaagttctgagcccaggaggggagcagagaggaggccaggaaggagagctaccyacccctctggggccccctctctgtccctgacagggatgatctcatgggatgggaactgccccatccttttatagctaagggggcctgaagttcagacagt

SEQ ID NO: 65401 - DNA, 201 bp, Homo sapiens
aaccggcctatcggatgccttcatgattctcaatccatccccggatgtgccaggtgagtcttcagggaccccgcagaggccttgatgggggtaggactccrctcagactgaacctgagctgctggggggatggcagtggcagggagtagacaaggggcagagagttgagagggaaaccaggcaggaaaggatgcccagtga

SEQ ID NO: 65402 - DNA, 201 bp, Homo sapiens
gcctccagctatctgctcatcagaggtgctttcctcaacctcctgcaccacctccaagagaaacagcctaaaaagaaaccccagctgtttacttatattgktctgtaaatccctggaagtaaaccccatgcatttttatctactgtctgaggacatacaataaatctgagaaagtctatgctgtcacatttctggatgctt

SEQ ID NO: 65403 - DNA, 201 bp, Homo sapiens
ctgatcttcattccggactgctggcactcaggtttctgtccccttctcccaggtcacgatgagggcccaggctctggatgggctgccaaagggaccgtgckgggctggaaccggagagcccgagagagccctgggcatgtgtcagagccggacaggacccagctgagccaggacctgggtgggggcaccctggccatggac

SEQ ID NO: 65404 - DNA, 201 bp, Homo sapiens
ggcagtctgagctcttacccaccgtctcttcagggacaaaaatgagtgacgtgttgatgcagaaggtacttctggaccaggacctctgaaactgtgctttrcaaaaaatccccttggaagtgcttccaaaggcagatgccgattcagcagtcttggggttgggcccaataatctgaatttctaacgggctcccagtgatgc

SEQ ID NO: 65405 - DNA, 201 bp, Homo sapiens
gtgttgatgcagaaggtacttctggaccaggacctctgaaactgtgctttgcaaaaaatccccttggaagtgcttccaaaggcagatgccgattcagcagkcttggggttgggcccaataatctgaatttctaacgggctcccagtgatgctgatgttgcggcccaggggtgctcttggaaaagcaggatctagaatgcat

SEQ ID NO: 65406 - DNA, 201 bp, Homo sapiens
ttgggctcctggggccaggctccctgttgataggaggcacctgtctttaatccctgcacttcagttccacatcccacttccccagggatggggaaagctgygagtcctctcctcttcctgccccctcgccctatagtctgtgccctgctgaagggacagggaggaccttctcctatctggggtcctttggctccatacaca

SEQ ID NO: 65407 - DNA, 201 bp, Homo sapiens
ccagcccagcacaaacaactctgtctccagaagcagctgtgggccccacccaagagagaccagacagccctggcttgggcctgggcagtgggcaggctgcmttcccagccctggactcatgtccatctgtgggcagccagtgggcatcttggggaaggggtctggggactgccctcctccccacgtgctccagcagcatct

SEQ ID NO: 65408 - DNA, 201 bp, Homo sapiens
tggagctctctccagtggaaggcaggtggggtgaggagtggctgagggttgggcaggtgtccaacttgtgtgtgagcacatacgggaaggccgaggctttsaggaaagtctttgtgggcatgtgcacaggcacgtgggcccctgcacatacacgtgagcaaccagctgtgttggcttctttcatgagtcgtggggatgacg

SEQ ID NO: 65409 - DNA, 201 bp, Homo sapiens
agcatgtcactgtgagttgccctaccctcgctcttatttaacctgaaccaaaagctgggggccattgcccccattgatcgatcacaggggaaaactggggstcagagaagtttaatgaattggcctgcatctcgctgctagaaggtgacgggcccagcatttaaatatcaactctccagaccctgtggccatacacttacc

SEQ ID NO: 65410 - DNA, 201 bp, Homo sapiens
agcagcagcagagagatgagtggcccaaagacagagtcagacagcaggggagaccaggatgacagacaggaaaatggccttggggtgcagagcaggggccmagggaactgacagtctggtcagatggaaccagaggtgcatatgacagataaagaagaggcagcgagagttggcatcctggcctgggagtcctgcaggagg

SEQ ID NO: 65411 - DNA, 201 bp, Homo sapiens
aagcatgtcactgtgagttgccctaccctcgctcttatttaacctgaaccaaaagctgggggccattgcccccattgatcgatcacaggggaaaactgggkctcagagaagtttaatgaattggcctgcatctcgctgctagaaggtgacgggcccagcatttaaatatcaactctccagaccctgtggccatacacttac

SEQ ID NO: 65412 - DNA, 201 bp, Homo sapiens
gtagggcctgcccctggaaactcttctcaaggtggcattagctcttggcaatatcctcccttccatctaagatttgttttccagactgccttgagccaatyagacccactttggaaggtttcagagggctctgtgggtctctgagacgagcattctgatgccttgaccttaagtgggcagctctcaaggaattcttttggt

SEQ ID NO: 65413 - DNA, 201 bp, Homo sapiens
aaatcctcagtgtggcattcaaggccgggcacagctgggtgcagtcaaccacgcaggcgcatttccaaaccctccctccgctcaccgccctctgcctgggsagctctggtctgtgtcccctgggttccctgaacatgctaagggctgtccacatcggtatgacacagtccccttgtataaaacgcctcttactccaatctt

SEQ ID NO: 65414 - DNA, 201 bp, Homo sapiens
cttggcccaggctctggggccgcacaacctggcctcctgaggtcagccccattcccccttgccctgaaatgggaccagtgccagctgaggggactgggacrctactgctgggctgtaccctgcatgctgggggacacagtctcccagggaagctctcaggttcaggcccaatggcagcctgagtagggccctccaagaacc

SEQ ID NO: 65415 - DNA, 201 bp, Homo sapiens
gggtttgtggggctggtggggggccttgggaagtagctgagatctcccctcgctcctgatggacaggcttgtttggtagagccttgaaacctcatctatcrttagaacagcagcagcagagagatgagtggcccaaagacagagtcagacagcaggggagaccaggatgacagacaggaaaatggccttggggtgcagagc

SEQ ID NO: 65416 - DNA, 201 bp, Homo sapiens
ggcgtgcaccaccgcatctggcatgagtatctgtttttttctctcttttgagatggagtcttgctctgttgcctagactggagtgcagtggcacaatctcrgctcactgcaacctccacctaccaggttcaagccattctcctgcctcagcctcccgagtagctggcactacaggcgcgtgccaccacactcagctaattt

SEQ ID NO: 65417 - DNA, 201 bp, Homo sapiens
gtcaagcgtacagtgagctgtgattgtgccactgcactccagcctgcatgctagagtgagaccctgtctcaaaaaaagcatgcatttaacaacctagaggraactggagaggagatcatggaacctaaagccatttcgcaacctccagaaatggaggttcgcatggccgcgaaatggcctgtgtgtagtcactttccaatc

SEQ ID NO: 65418 - DNA, 201 bp, Homo sapiens
ttgttcactacccgctctatcctgttctggctcctgcccaggccccagggctgcttgcaggaagacctggggagctgggcagaccagcccagcacaaacarctctgtctccagaagcagctgtgggccccacccaagagagaccagacagccctggcttgggcctgggcagtgggcaggctgccttcccagccctggactc

SEQ ID NO: 65419 - DNA, 201 bp, Homo sapiens
gcaagactgggtgtcgaggtcaacccagtgtctcttccctggccacccccagctgggccccctccctgtccttccccgtgctgcaggcctccaccatcccrcctcctgtctcggctccaggtttgtgaatcctgaagatccccaacactcctctctgggccgctgagcccctccacttgttcactacccgctctatcctgt

SEQ ID NO: 65420 - DNA, 201 bp, Homo sapiens
aaggtcccataacttgtgagtggcaagactgggtgtcgaggtcaacccagtgtctcttccctggccacccccagctgggccccctccctgtccttccccgkgctgcaggcctccaccatcccacctcctgtctcggctccaggtttgtgaatcctgaagatccccaacactcctctctgggccgctgagcccctccacttg

SEQ ID NO: 65421 - DNA, 201 bp, Homo sapiens
accatcgtcaaatccatttgagtcactagggagctgaggattagagaggaaaactgatggggctaaggtcccataacttgtgagtggcaagactgggtgtsgaggtcaacccagtgtctcttccctggccacccccagctgggccccctccctgtccttccccgtgctgcaggcctccaccatcccacctcctgtctcggc

SEQ ID NO: 65422 - DNA, 201 bp, Homo sapiens
ttggggtgcccagcagtggccctgggcatgcctgctccccactctgtccaaacaagcatgaggcagtgtgggtgcccaggcccctggcctgcagcttggcscgtgctgactttctcccatcccctgcagagagtggtcttgtcctttgatttccctttctacgggcatcctctgcggcagatcaccatagcaactggaggt

SEQ ID NO: 65423 - DNA, 201 bp, Homo sapiens
ggctggtggggggccttgggaagtagctgagatctcccctcgctcctgatggacaggcttgtttggtagagccttgaaacctcatctatcattagaacagyagcagcagagagatgagtggcccaaagacagagtcagacagcaggggagaccaggatgacagacaggaaaatggccttggggtgcagagcaggggcccag

SEQ ID NO: 65424 - DNA, 201 bp, Homo sapiens
tgagacagacctgggtccctattgagaagaagagtatgttgggggtgggaggggaaggaggctgacagtgggaagtatgggcagagggcagtggagctgaygaaccgagaagctgctggtgagaaccaccaattttcagggagaccacacagagggtggccagagacgtggcttctagtcccgccatctcacttgctgtgt

SEQ ID NO: 65425 - DNA, 201 bp, Homo sapiens
agcctggcccctcagcagagatgattaagaagatagatacctgtgcatcattggcatgggtgcccctcaggtggggtgagggaggcgctgttgaggtgagygctgtggttgacctgctgtgtctcaggagtgtgctggcaccaggcacagtgtcagtggcaatgttcttgactttaatggtcccagcatgtagctgagaca

SEQ ID NO: 65426 - DNA, 201 bp, Homo sapiens
gattttaaagtgaacaattcagtggcatttaataaattcacaatgttgtgcaaccaaccccccatccagttccaaaaccttttctgttttgtttttgttcytgagaaagggtcttgctctgttgcccaggttggaatgcagtggtgggatcatggctcactgcagcctcgacctcctgggctcaagggatcttcccacctc

SEQ ID NO: 65427 - DNA, 201 bp, Homo sapiens
caggagaaatgcactttttctgcagcaggagggatagaggttagacttaaggaatctgtaagaagccagaggcggcagctgttgactcccagtccggtgcycttttcacaggccaggtgggatttcacaggcaggaggacctatgaggaggaagcgggtgtctggggaggccagatgtaggagaaggacattctgggggag

SEQ ID NO: 65428 - DNA, 201 bp, Homo sapiens
tagaggtcacagccataccccaaccctatcactctccatcggggcagaaggctcagggcctgagaaccagggttcctcgaggactggtgagagcaaacctyaggctctatgatgtggataaaactgcatttaggagcaagggcatccaagggcagggctgactgcctgggtggaagcagtgaaatgttttgggaatgcatt

SEQ ID NO: 65429 - DNA, 201 bp, Homo sapiens
agagtagggttggggtagtagacggttgaggagaccaggaagagtggggcaggcagagacttgaatcacttctctaagtagaggctatcctgtcttcttgrctttgacagagattgagccaggagaaatgcactttttctgcagcaggagggatagaggttagacttaaggaatctgtaagaagccagaggcggcagctgt

SEQ ID NO: 65430 - DNA, 201 bp, Homo sapiens
aggtcacagccataccccaaccctatcactctccatcggggcagaaggctcagggcctgagaaccagggttcctcgaggactggtgagagcaaacctcagsctctatgatgtggataaaactgcatttaggagcaagggcatccaagggcagggctgactgcctgggtggaagcagtgaaatgttttgggaatgcatttct

SEQ ID NO: 65431 - DNA, 201 bp, Homo sapiens
taatgaaggatcttttataattgcctttccttttcatatttgttagggtctttatgggtaactgatactttaaaaaaatcaaggtaaacaggagagagttrgatatgttatgaataatttctgggctcctttgaatcctcaacctggtgtgatcttctgaactctgggtgtaacagagtttatgaggggaggatctgaacc

SEQ ID NO: 65432 - DNA, 201 bp, Homo sapiens
gggcagaaggctcagggcctgagaaccagggttcctcgaggactggtgagagcaaacctcaggctctatgatgtggataaaactgcatttaggagcaaggrcatccaagggcagggctgactgcctgggtggaagcagtgaaatgttttgggaatgcatttctgggacactgtacatttaaggtacttctcacccctccgg

SEQ ID NO: 65433 - DNA, 201 bp, Homo sapiens
ggctgttggcaaaatctttgactcttgtgcgtggaataatgaaggatcttttataattgcctttccttttcatatttgttagggtctttatgggtaactgrtactttaaaaaaatcaaggtaaacaggagagagttggatatgttatgaataatttctgggctcctttgaatcctcaacctggtgtgatcttctgaactct

SEQ ID NO: 65434 - DNA, 201 bp, Homo sapiens
tcagttccctcctccataaaatggggataacaagagcacttatatattgattcgacataccatgtgccaggcactgttccagaccctctggatacacaggraacaaaacagccagagagtgctcatcctcctgcacagggcagcccctgcttctttcctgcccatggctctttccatccactctcccagggccttcaacac

SEQ ID NO: 65435 - DNA, 201 bp, Homo sapiens
ccccgtgcctactgcgccccctgccctgctgctcctgtgcctggcctgtgccagaagggttcacgcgccctccagcaacctggtcccactaatctctctgytctctggctctgtcctgcccaggctgggccccagctgtcgctccctcttcattcgtactaattccagccccttcactctgtgcagcctggtagcagttct

SEQ ID NO: 65436 - DNA, 201 bp, Homo sapiens
cctgccctgctgctcctgtgcctggcctgtgccagaagggttcacgcgccctccagcaacctggtcccactaatctctctgttctctggctctgtcctgcycaggctgggccccagctgtcgctccctcttcattcgtactaattccagccccttcactctgtgcagcctggtagcagttctggctgctgctgggaccacg

SEQ ID NO: 65437 - DNA, 201 bp, Homo sapiens
ccaggagagctgtgggctgtgggcaggtggatagggaccccactttcccaaacacatagggtgtgtgagtgacggtggagacaccgatgcccggacctctycttctctcctggaaggatactggagggaccttaggagaggcggctctatgtggccatgggctctgaaaggggacagcgggagagtcatcaggacccctga

SEQ ID NO: 65438 - DNA, 201 bp, Homo sapiens
ctgcccaggctgggccccagctgtcgctccctcttcattcgtactaattccagccccttcactctgtgcagcctggtagcagttctggctgctgctgggaycacgtctgggccgttcccctctcggctctgcacatgggacctttctgccttgacttcttctctcccaggagagctgttttctccccatggaccgaacatc

SEQ ID NO: 65439 - DNA, 201 bp, Homo sapiens
gagggctgagcatgagggcagcaggcgtggatttggctgtggccaggcctgttggggcaccactaggggccagctagtgagctgtctggggccaagggggmgtccagggggtcctaggcctaaatcagcccttggggccacaggtccagcaccctgggagggtggtgacttcctgtacccagaaatctgagtggggaaggg

SEQ ID NO: 65440 - DNA, 201 bp, Homo sapiens
tcccctaagcacctagactttctctggggttggggagatgggtaatttgcagcctggcccctcagcagagatgattaagaagatagatacctgtgcatcaytggcatgggtgcccctcaggtggggtgagggaggcgctgttgaggtgagtgctgtggttgacctgctgtgtctcaggagtgtgctggcaccaggcacagt

SEQ ID NO: 65441 - DNA, 201 bp, Homo sapiens
ggctgtgggcaggtggatagggaccccactttcccaaacacatagggtgtgtgagtgacggtggagacaccgatgcccggacctcttcttctctcctggarggatactggagggaccttaggagaggcggctctatgtggccatgggctctgaaaggggacagcgggagagtcatcaggacccctgatcaccccaggcaag

SEQ ID NO: 65442 - DNA, 201 bp, Homo sapiens
cctggcgatgtccgcgaggggggcattgtccgcaggaggccaggagagctgtgggctgtgggcaggtggatagggaccccactttcccaaacacatagggrgtgtgagtgacggtggagacaccgatgcccggacctcttcttctctcctggaaggatactggagggaccttaggagaggcggctctatgtggccatgggc

SEQ ID NO: 65443 - DNA, 201 bp, Homo sapiens
tttcacagacctcttaaccttggcagaggccaggggaggctttgctgaggaaaagagttgaaatctgaaggataaatacgagttcaggaagcaaagaggasagtgaagtatgttctaggagagacaacagcacacagcacatgcaaaagtcctgaggcaggacagagcacggctggcacaaagcactgaaagaaggcagca

SEQ ID NO: 65444 - DNA, 201 bp, Homo sapiens
tctggtcatactccatagctaccaagttaacctgctctaaactttggagaactggatctgtccaataaacgcttatttggccaagcctgatggctcgtgcytgtactcccagcactttgggaggctgaggtgggagggttgcttgagcccaggggtttgagaccagcttgggcaacaacaacaaaaatgccaggtgtggtg

SEQ ID NO: 65445 - DNA, 201 bp, Homo sapiens
tccatctggtcatactccatagctaccaagttaacctgctctaaactttggagaactggatctgtccaataaacgcttatttggccaagcctgatggctcrtgcctgtactcccagcactttgggaggctgaggtgggagggttgcttgagcccaggggtttgagaccagcttgggcaacaacaacaaaaatgccaggtgt

SEQ ID NO: 65446 - DNA, 201 bp, Homo sapiens
gcaggaaaggatgcccagtgacttccagcttttctttgttatagcagagggaccattttctccagcaaaatctccaatgggaggcactgctctggttgttraggtgaaagggagccacagcccttccactcagcccctgttctatgtagaaaacctccaaagatgccctagtaaggggtttgagtcctcccagaatacaac

SEQ ID NO: 65447 - DNA, 201 bp, Homo sapiens
ttgaacccgagaggtggaggttgcagggagctgagatcacaccaatgtactccagcctgggtgacatatcgagattccctctcaaaaaaaaaaaaaaaaaaggaatgggccgaagtgcagcctgattaatgcttaattactcctatacttctgcccagaacccggcatgtaattcttgttaaccctgagaagacggtttca

SEQ ID NO: 65448 - DNA, 201 bp, Homo sapiens
ctcaggcaatccacccgcttcggcctcccaaagtgctaggattacagacgtgagccaccacaccccgccaatgtggtggttttccagcagctgcagggctstgactggggcacagggaatagactttatttttttttcttttcttttctttttttttttgagacggagtcttgctctgtcgcccaggctgtagtgcagtgg

SEQ ID NO: 65449 - DNA, 201 bp, Homo sapiens
ctgtccgggaagaggcctcgatgccctctgcctgtgatatgctcctgacaacaggctctgcctctgtttcagaatctcggcgaaggagcatctttgaataycaccgcatagagctggaccccagcaaggtcaccagcatgtcggccgtggagttcaccccattgccgagtgagtaggggtcattccgccatcccagaaaga

SEQ ID NO: 65450 - DNA, 201 bp, Homo sapiens
agagggtatggttaggggctttgtaacttggaggcaggatttcagtttagggtttggagccttccctggcccctctgaaagctggtcctgtgaccctaacyggtgtgttgcccaaggtgcagcaagttgacacaccaacaccgagggggcagcagagaaagagtttcatcatcgtggggcagcatttggggctagaggttt

SEQ ID NO: 65451 - DNA, 201 bp, Homo sapiens
gggactaattcagctctcagcataactagggtggtcccggcttatggttctgggagcaaatggctctggtggcttgagggcaacgcgcccactgctaagcsgcaaataaggaatccctcctccctggtcagcatttgggtgggttatagtcttgatccatgggcccgttggctggtggctgtaccccaggcctagcctgcc

SEQ ID NO: 65452 - DNA, 201 bp, Homo sapiens
ctcctcccagcatcctgtcaaaaccggcctatcggatgccttcatgattctcaatccatccccggatgtgccaggtgagtcttcagggaccccgcagaggscttgatgggggtaggactccgctcagactgaacctgagctgctggggggatggcagtggcagggagtagacaaggggcagagagttgagagggaaaccag

SEQ ID NO: 65453 - DNA, 201 bp, Homo sapiens
atcccactgcatttgtttaaaaataaatttttaaaatttgtgtgttttatcaggggtctcctgtacagtgtatctgtgtatgtttgtgtgtgtgtttgtawacagccttgtttaatgttttgagcaataagatatgcacacacaggtattttgttgctaaagagattggacaaggttgtagctgtgctcaggcttcagctt

SEQ ID NO: 65454 - DNA, 201 bp, Homo sapiens
gaatcccatccaggttccttctcactgcaagaattttccagtacactcaacactgattctaggtggaaagcatcctattctcacaccatagactaacatasatgggtctattcatctgtgccctcttttttgccccctccctttatatcttcttgcaaagcaagcatgctgcatgtgccaagcatgtcactgtgagttgcc

SEQ ID NO: 65455 - DNA, 201 bp, Homo sapiens
ccgggaagaggcctcgatgccctctgcctgtgatatgctcctgacaacaggctctgcctctgtttcagaatctcggcgaaggagcatctttgaataccacygcatagagctggaccccagcaaggtcaccagcatgtcggccgtggagttcaccccattgccgagtgagtaggggtcattccgccatcccagaaagagctc

SEQ ID NO: 65456 - DNA, 201 bp, Homo sapiens
tctgagcctcagtttccttacctctaaaatgaaagtttgggctgaactttcatcccatctggactcagagtgacaaaggctgtaatgattccactaatctygctccttctgtcttctctctttgaagatgacaccaagttgaatccctatgcaggaggagacggtgagtacagaactgcctgccctcagcgtcagacccag

SEQ ID NO: 65457 - DNA, 201 bp, Homo sapiens
cttggtgctgaaagaaatggaaaagggtctatgtgaattcagggtcagggcagagtagcaaagtgtgaaaaagtgaggcagattccgacagctcccattaytctgaagttgctctggaataacaaggagctggcactgagagcagagcacgtggtggtgctgcaggggattcaatgaaaaagaagcagaggctgggagagg

SEQ ID NO: 65458 - DNA, 201 bp, Homo sapiens
acctgggcaccatcgtgggcatcgtgctggcagtcctcctcgtggcggccatcatcctggctggaatttacatcaatggccaccccacatccaatgctgcrctcttcttcatcgaggtccgtgtcatctgtggccacagggctcctgtctgcttctgcgtcggcgtctcctgggccattcggtccctgcctctccccttct

SEQ ID NO: 65459 - DNA, 201 bp, Homo sapiens
tgggtggggtcccactgggcttccaatgtcttggagtcctccaggaggtggtgccatccagaaagatgggtctggagctcacaggggagggctgggtgggycccagagcgtttgggaggtggacggagtctcttctccctgccgcagatccctatgtctgtcccggaaatcagctcctcccagcatcctgtcaaaaccggc

SEQ ID NO: 65460 - DNA, 201 bp, Homo sapiens
tgcctttcacagcctcccagagcttttctccttgctcttgggctggaatggatttaaacaatttcgtctctcacggcagatgcctgcctgcccccgccccrccatgacccactctggagtctaagggtaatgttaattccaggattagctccagaaatgggggtcataaacccataccaaaggctcaatctttgaaagaat

SEQ ID NO: 65461 - DNA, 201 bp, Homo sapiens
ctgaaccctgtctggggaaaactctcctcccccaggttctaaacactttcctccccacccctgctaggcaaggggatgggaggtgcaatggggaggactcytcacagcctcactcctgggggagagggtagaagaggctgaaaaccacaagagttcttaccagtacttcctcgtataaactcttccgcaggcttttcagca

SEQ ID NO: 65462 - DNA, 201 bp, Homo sapiens
ctcctgagtagctgggactagaggcacctgccaccacgcctggctaatttttgtatttttagtagagatggggtttcaccatgttagccaggatggtctcratctcctgaccttgtgatccaccctccttggcctcccaaagtactaatgcatttctttatcttcatttataaagttatattttttcatgaataagtgtat

SEQ ID NO: 65463 - DNA, 201 bp, Homo sapiens
tttggggcaacttttacatgattttggaaaactacccagatggtgtcaagaacatgaatgccttactcataatgattccaactcccacccaacctcttccygtattggataagtggacccaaaggctctgtcggctttcatctctgagactttgttagaacccaagaccccatggttcgaccttccctgctcccctgcagc

SEQ ID NO: 65464 - DNA, 201 bp, Homo sapiens
ttgggaggctgaggtgggaggatagctttagaccaggagtttgagaccagcctgggcaaaatagtgagaccccatgtctataaatgatttaggccaggcarggtggctcatgcctgtaatcccagcactttgggaggccgaggccggcggatcacctgaggtcaggagtttgagaccagcctggctaacatggtgaaaccc

SEQ ID NO: 65465 - DNA, 201 bp, Homo sapiens
ttgtgatcctaacactttgggaggctgaggtgggaggatagctttagaccaggagtttgagaccagcctgggcaaaatagtgagaccccatgtctataaaygatttaggccaggcagggtggctcatgcctgtaatcccagcactttgggaggccgaggccggcggatcacctgaggtcaggagtttgagaccagcctggc

SEQ ID NO: 65466 - DNA, 201 bp, Homo sapiens
cagtccggtgcccttttcacaggccaggtgggatttcacaggcaggaggacctatgaggaggaagcgggtgtctggggaggccagatgtaggagaaggacrttctgggggagagttgctaaggaggggcagcctgacctgattgatggcggagttgttgtgaccagtggaagggcagctgggagcaggacctgaagagatg

SEQ ID NO: 65467 - DNA, 201 bp, Homo sapiens
ccctgccgcagatccctatgtctgtcccggaaatcagctcctcccagcatcctgtcaaaaccggcctatcggatgccttcatgattctcaatccatccccrgatgtgccaggtgagtcttcagggaccccgcagaggccttgatgggggtaggactccgctcagactgaacctgagctgctggggggatggcagtggcagg

SEQ ID NO: 65468 - DNA, 201 bp, Homo sapiens
aagctgctggtgagaaccaccaattttcagggagaccacacagagggtggccagagacgtggcttctagtcccgccatctcacttgctgtgtgactttagrcaagttactttctctctctggacctatttttgcatttataaagtgaggctgttggcaaaatctttgactcttgtgcgtggaataatgaaggatcttttat

SEQ ID NO: 65469 - DNA, 201 bp, Homo sapiens
gcatcccatgtacattactgagcccactgtcggggcagggatgtgtctgtttcatctgcacctccctcaagggcttcttccaggcagagtctcaggaaacrtgtgcctgatcaagctgtggaatgagggtgaattagagggggtcagatccccggtagcatctgcctctgaggctcttctgtgattctggaatgagaagcc

SEQ ID NO: 65470 - DNA, 201 bp, Homo sapiens
agagtgtctaagttgtcccaggatgagtgagcgtgaatatgtgtgagtgcgccctgtgatagaatgggctctgagtcagttcccgccttgttccctgagcygctgggataggttccagccaccagagaccctgaactggaataattgtgtaaataattattctaacttgtttttatgagtcttttttaaatgtatgtatta

SEQ ID NO: 65471 - DNA, 201 bp, Homo sapiens
gactgatcatttctcatagggttgttctaaaaatcagatgcactgattgcttgagaaagttaactagaaaaatccctcccagatcttacctgaaagtacaraaataggattatagtcacaaaagaggatttcctggccttgaagcttcaggtgttatctttcatattcttaatactcttcaaggtgtgggaagggaccggc

SEQ ID NO: 65472 - DNA, 201 bp, Homo sapiens
tctaaacctgtttcctcatctgtaaggtgggactgatcatttctcatagggttgttctaaaaatcagatgcactgattgcttgagaaagttaactagaaaratccctcccagatcttacctgaaagtacaaaaataggattatagtcacaaaagaggatttcctggccttgaagcttcaggtgttatctttcatattctta

SEQ ID NO: 65473 - DNA, 201 bp, Homo sapiens
attgtctaatggggatgctattgtctgaagtgttattgcaaaggtgttgtgcggtaatgtccattcagggcctagcacacagtgggagtgggaagcataarctgacttggaattcggctctggtctaggggatcaactatcccgggtttcccaggatggtcccggctttagttctgagagtctggcatcctggaaattcct

SEQ ID NO: 65474 - DNA, 201 bp, Homo sapiens
tttttatatcttctttggaggaatatctattcaagtcatttgtccgtttcttcccccttgccaattttttaattagaatgtttgtctttttgtcttgggcragtttcttagcccctctactgaggagcccatttcttcattgtctaatggggatgctattgtctgaagtgttattgcaaaggtgttgtgcggtaatgtcca

SEQ ID NO: 65475 - DNA, 201 bp, Homo sapiens
cgctttgagatctagcttaggaggcggcatgtctggtttactgtggtctttcagggttgtccttttgagaatggcagtaatttgtggtgggctggggaggragggcgtgcttcctttgggctgtgggctgacgttataagttgctgaggttttcatgactatttgtaacccattcattcactcacagtcatttcttaaggt

SEQ ID NO: 65476 - DNA, 201 bp, Homo sapiens
gtgatctgcccacctcgacctcccaaagtgctgggattacaggcgtgagccactgcacccggcgagtatctgttttgaattccttgggatctatacctagragtggaattgctgggtcatatggtaactctgtgtttaactttttgaggaactgccagactgttttccacagcaactgaactattttacattcccaccagc

SEQ ID NO: 65477 - DNA, 201 bp, Homo sapiens
caggccttctggccgtgcccatgccccttgggtgcctggggcagaggggtggaatacgttggggtgccccacgatagctgtggggggggctcttagtgcargatcctgtggattagaaacaagttgctcctcagagctctcaagcagggactgctctttaggaaggggagcagcggctgggagtgagcagggcagggtggg

SEQ ID NO: 65478 - DNA, 201 bp, Homo sapiens
cagactggttgtgaggggcccaatgcagggggccggccccagcccacagggtcgttctgcagatgggctggtcggggacgctctaccaggtgaagggtctrtggtcggagtcttcgccctggccagggcccaggacgctcacggtgcaggctgagggtcagagccgccgagggccccctgccgggattctgtgcaaagggc

SEQ ID NO: 65479 - DNA, 201 bp, Homo sapiens
cctgcctgtacgagagcggggccaggacctcctatgatgagatttccttttgtacattctccctgcgtgaggtcctggagaacgtgcccgccagccccaarccgcccaaccttggggacaagcctcgggggtgctgctggccctcctgacaggccttctggccgtgcccatgccccttgggtgcctggggcagaggggtgg

SEQ ID NO: 65480 - DNA, 201 bp, Homo sapiens
tgggggtgctggacgagtcccactccttgccaaccccagggtggctcctcagctctcaaacaaggggcgggctgcagggattccgagggcccctccagcargaggtcccacatgcatctcccaatgggacacttacctggcccacagggtgggtgtgacactgagggttcctgggggcagattcagggcatgggatggaga

SEQ ID NO: 65481 - DNA, 201 bp, Homo sapiens
gtgcgcggaccccagagggtgtgcgtggaccccagagggtgtgtgcggaccccagagggtgtgcgtggagggcctggtctgacctcaaggctcttggggcrcccacacaggatgggctgtgaggggttggcgggggtggggggggtggtctgtgatggccccctgctgagccagagtgacccctacaaccggtccaggggt

SEQ ID NO: 65482 - DNA, 201 bp, Homo sapiens
ccttcctccagccccccgacctcggggacccagcagcccctcccacctctgccctcctccctgcagactgggccacattcgctgtgggtcccggccacggygtgcagctgccctcaggccgcctgctggtacccgcctacacctaccgcgtggaccgccgagagtgttttggcaagatctgccggaccagccctcactcct

SEQ ID NO: 65483 - DNA, 201 bp, Homo sapiens; identical to SEQ ID NO: 42484

SEQ ID NO: 65484 - DNA, 201 bp, Homo sapiens
cgtctctggagcagcagacccgtgtccctctgggaggtcaactgcggcctcacagctgggcctgtcccagcacagcccttgttggagggcgcacccccgtstcctcagcaccccagtgttgagtgcattgacctgcagaggggagcctgtgctggtcccgggcgtctgtgtggctcctgggtgcccatctgcacccctggc

SEQ ID NO: 65485 - DNA, 201 bp, Homo sapiens
actgcagggcctcatgccccccgcctgccctctgctctctctgtgtgggcagcgctcaccagcctccctgggtgccgtccacctgggctcggctgctaagrgctgtgagaggcttgttcagcctgggaggactcagggcggctgggatgagtcgtgtggaagggcggtcagagtgcgatggtcctaacccgaggcaccagc

SEQ ID NO: 65486 - DNA, 201 bp, Homo sapiens
aggggtcaccctgggccctgagaggcacaggacattgcgatggggtgctggcctgccaggagcacagatacagagctagagcccagcgaggcctgtgctgygaggggctgtgctgtgccaggggaggccccgcacccgggaagcccagaggagagtgtgcactcacggagccctcctggcagggccgcgtctctggagcag

SEQ ID NO: 65487 - DNA, 201 bp, Homo sapiens
cacctgaccccggcccgtgggagctacagcagggagtgcagcagacacatggccaacccagggaccccactgcagggcctcatgccccccgcctgccctcygctctctctgtgtgggcagcgctcaccagcctccctgggtgccgtccacctgggctcggctgctaagagctgtgagaggcttgttcagcctgggaggact

SEQ ID NO: 65488 - DNA, 201 bp, Homo sapiens
cagcctcccctgcaccctggcaccaaccagcctggccgagggtcagctcccagagccgtgttgagaggggaaggggctgattccacagacatttggggtgsagtgggtgcgagggagggtgggggaggggctgctccagatctggggtgagggagtcagaaacagggctgaccccaaggtgggtacaggaagaggcccagg

SEQ ID NO: 65489 - DNA, 201 bp, Homo sapiens; identical to SEQ ID NO: 42469

SEQ ID NO: 65490 - DNA, 201 bp, Homo sapiens
gcccacagggtcgttctgcagatgggctggtcggggacgctctaccaggtgaagggtctgtggtcggagtcttcgccctggccagggcccaggacgctcayggtgcaggctgagggtcagagccgccgagggccccctgccgggattctgtgcaaagggcctctgcactttatgtgggtgcatgtgaatgcccctcgccaa

SEQ ID NO: 65491 - DNA, 201 bp, Homo sapiens
gcctcgggggtgctgctggccctcctgacaggccttctggccgtgcccatgccccttgggtgcctggggcagaggggtggaatacgttggggtgccccacratagctgtggggggggctcttagtgcaggatcctgtggattagaaacaagttgctcctcagagctctcaagcagggactgctctttaggaaggggagcag

SEQ ID NO: 65492 - DNA, 201 bp, Homo sapiens
gcctgagccagtccccgctggacccgcgcagctggacagagccctgggtgatctacgagggccccagcggctactccgacctggcgtccatcgggccggcycctgaggggggcctggtttttgcctgcctgtacgagagcggggccaggacctcctatgatgagatttccttttgtacattctccctgcgtgaggtcctgg

SEQ ID NO: 65493 - DNA, 201 bp, Homo sapiens
atcgggccggctcctgaggggggcctggtttttgcctgcctgtacgagagcggggccaggacctcctatgatgagatttccttttgtacattctccctgcrtgaggtcctggagaacgtgcccgccagccccaaaccgcccaaccttggggacaagcctcgggggtgctgctggccctcctgacaggccttctggccgtgc

SEQ ID NO: 65494 - DNA, 201 bp, Homo sapiens
tgagtcgtgtggaagggcggtcagagtgcgatggtcctaacccgaggcaccagcccctccttccccgtccccctgtgccttcctccagccccccgacctcrgggacccagcagcccctcccacctctgccctcctccctgcagactgggccacattcgctgtgggtcccggccacggcgtgcagctgccctcaggccgcct

SEQ ID NO: 65495 - DNA, 201 bp, Homo sapiens
ggtgggggcagggtgggggcacgaagtgggccctgggtgacccccacagctcccttccgaggctgcagggccaggcgcgggaccgcaggtagcccagggtrttgtgggtggcagcacttgtttactggctgctttctggctcgaaataaaggaatcgtgcttgtgtcggggtagacgtttctttccttttcaggttccagc

SEQ ID NO: 65496 - DNA, 201 bp, Homo sapiens
gagccccgtgactcccccgatgacgttcaggaagtgggagcggatcccctgtccccagagagccccgtgactcccccgatgacgttcaggaagtgggagcsgatcccctgtccccagagagccccatgactcccccgatgacgttcaggaagtgggagccgatcccctgtccccagagagccccgtggctcccacaggtcc

SEQ ID NO: 65497 - DNA, 201 bp, Homo sapiens
ctcattgtccacatgacctcctgctgggcgaattctgggatgaccctgtgtcctgggcacatggctggcagggtcccgggggctctctggccagcctcccstgcaccctggcaccaaccagcctggccgagggtcagctcccagagccgtgttgagaggggaaggggctgattccacagacatttggggtggagtgggtgc

SEQ ID NO: 65498 - DNA, 201 bp, Homo sapiens
gggctcggctacacatgggtatccgcctgagccagtccccgctggacccgcgcagctggacagagccctgggtgatctacgagggccccagcggctactcygacctggcgtccatcgggccggctcctgaggggggcctggtttttgcctgcctgtacgagagcggggccaggacctcctatgatgagatttccttttgta

SEQ ID NO: 65499 - DNA, 201 bp, Homo sapiens; identical to SEQ ID NO: 42499

SEQ ID NO: 65500 - DNA, 201 bp, Homo sapiens; identical to SEQ ID NO: 42500

SEQ ID NO: 65501 - DNA, 201 bp, Homo sapiens
tccccgtcgtaggcaggcgttctgccctggccaggcgtggtgtccggcatccggccatctccctcctccctccttcccttagccccgcatccaggtgcccygtgtgcccggcctgggcggctggccgtggatctgaccgctcctgcatggtggaggaccagcgttcccactgtctgcagctgtgccacctccctgtgccgg

SEQ ID NO: 65502 - DNA, 201 bp, Homo sapiens
gagagccgccagacccacgtgacgctgcacgacatcgaccctcaggccttggaccagctggtgcagtttgcctacacggctgagattgtggtgggcgaggscaatgtgcaggtgagggctccctcacccggatcccggtgtcccccgaccctgtgcctccctcacctgcctctcggtgccccgtagactctgctcccagcc

SEQ ID NO: 65503 - DNA, 201 bp, Homo sapiens
tggcccccaccagggacgtcctgcgccatccgttcacgtctctgcatccattccttcatgtctttatttagttgtttatttatttagttatttatcttatwgagaggtgaggagtgccacggctgcccgtttacacctttagcgtctggtcctcctgcgtgtcctcccctccactgcctgcatggggggcgcggggagtga

SEQ ID NO: 65504 - DNA, 201 bp, Homo sapiens
ctgtgccggtcaggtcctgacctgcccctccgcccctccattcaggggcctctccaggagcctggggtgtggcccagcagtgggatccactcacgagtccygtctccacctgccctccccaggcggcgggagcctgtttgccatccacggagactgtgaggcctacgacacgcgcaccgaccgctggcacgtggtggcctc

SEQ ID NO: 65505 - DNA, 201 bp, Homo sapiens
gccccagtggctttgtacagtccatctgcaagaggcaagtttgtgtcaccatcacaggggtcgtatctgatggggtgttaaaggaggtgatccgcgaggcygtttcaccccaggccactgccacactgggcctgaactcttggctttgctgccccagtgccctttcctctctcgggtccttacccccagtccagaggctgg

SEQ ID NO: 65506 - DNA, 201 bp, Homo sapiens
gcccccacctgctaaccctccctcctaggcatcttcagggctccctgggtccacaggaccctccccagatctcaggtctgaggacccccactcccaggttytggaactggtctctagcgacagcctgaacgtgccttcagaggaggaggtctaccgagccgtcctgagctgggtgaaacacgacgtggacgcccgcaggca

SEQ ID NO: 65507 - DNA, 201 bp, Homo sapiens
aacactcagcccccacctgctaaccctccctcctaggcatcttcagggctccctgggtccacaggaccctccccagatctcaggtctgaggacccccactyccaggttctggaactggtctctagcgacagcctgaacgtgccttcagaggaggaggtctaccgagccgtcctgagctgggtgaaacacgacgtggacgcc

SEQ ID NO: 65508 - DNA, 201 bp, Homo sapiens
gctccagcctcaactccatcgagaagtacaacccgaggaccaacaagtgggtggccgcatcctgcatgttcacccggcgcagcagtgtgggtgtggcggtsctggagctgctcaatttcccgccgccatcctccccgacgctgtccgtgtcctccaccagcctctgacccacctaccaccagaggcctgcagcctcccaca

SEQ ID NO: 65509 - DNA, 201 bp, Homo sapiens
acggagactgtgaggcctacgacacgcgcaccgaccgctggcacgtggtggcctccatgtccacgcgccgggcccgggtgggagtggctgcggtggggaaycggctctatgctgtgggcgggtaagcctggaggctggacttgggtcgggtctggcacgtgcccgccaggccagtcttgacctgcagtggcttaattccgc

SEQ ID NO: 65510 - DNA, 201 bp, Homo sapiens
gtctcctgcagctgaatggcgtccgagacgcttgctgcaagtttctactgagtcagctcgacccctccaactgcctgggtatccggggctttgccgatgcscactcctgcagcgacctgctcaaggccgcccacaggtacgtgctgcagcacttcgtggacgtggccaagaccgaggagtttatgctgctgcccctgaaac

SEQ ID NO: 65511 - DNA, 201 bp, Homo sapiens
ggaggaggtctaccgagccgtcctgagctgggtgaaacacgacgtggacgcccgcaggcagcatgtcccacgggtgaggcgcggccgcggggggctcccayagcatccaggagggcatgcaggtggctgagggcctggtgcaccctgaccttccccgagttcagggactccgtgggggtggtgcccccacctgtctgaaga

SEQ ID NO: 65512 - DNA, 201 bp, Homo sapiens
tcccgggaagggtggggagcaggtgtccttcctgtcgtcgtctgccgtgtgccatctttcctggatcttgtagcgggtgcacacgcgtgcactgggaccccacacagcaatacgagtccaacttaataaacacatttctggggttcctcaggctgagcatctctctctggcatgtggggcagctgcgcaactttgggtcct

SEQ ID NO: 65513 - DNA, 201 bp, Homo sapiens
gtcccgggaagggtggggagcaggtgtccttcctgtcgtcgtctgccgtgtgccatctttcctggatcttgtagcgggtgcacacgcgtgcactgggaccccacacagcaatacgagtccaacttaataaacacatttctggggttcctcaggctgagcatctctctctggcatgtggggcagctgcgcaactttgggtcc

SEQ ID NO: 65514 - DNA, 201 bp, Homo sapiens
ccaccagggacgtcctgcgccatccgttcacgtctctgcatccattccttcatgtctttatttagttgtttatttatttagttatttatcttattgagaggtgaggagtgccacggctgcccgtttacacctttagcgtctggtcctcctgcgtgtcctcccctccactgcctgcatggggggcgcggggagtgaccaggc

SEQ ID NO: 65515 - DNA, 201 bp, Homo sapiens
agaggggcgtcctaggcaccagccgcacacgtccccggcgctgcgagggggccgggcctgtgctttttgctgtgggtatggccccccgcccgtttccctcytgccctgtgccttctactccccaccagcacaagcccaccccacctgtgccggtcaggtcctgacctgcccctccgcccctccattcaggggcctctccag

SEQ ID NO: 65516 - DNA, 201 bp, Homo sapiens
ggcccccaccagggacgtcctgcgccatccgttcacgtctctgcatccattccttcatgtctttatttagttgtttatttatttagttatttatcttattdagaggtgaggagtgccacggctgcccgtttacacctttagcgtctggtcctcctgcgtgtcctcccctccactgcctgcatggggggcgcggggagtgac

SEQ ID NO: 65517 - DNA, 201 bp, Homo sapiens
accccgtgactaacacgtggcagccggaggtgtccatgggcacaaggcgaagctgcctgggtgtggccgccttgcatggactcctgtactcggccggcggytatgacggggcctcctgcctgaacaggtagttggggttggggccccagtggctttgtacagtccatctgcaagaggcaagtttgtgtcaccatcacaggg

SEQ ID NO: 65518 - DNA, 201 bp, Homo sapiens
ctagagttacgtgacaaaagacatggatacagaggtgggtgatacagagaagcgtgaaggataagattggggccgtttttgcaatctaccacatccagtgygccaacctaggctttcttcttcctctcctctttataggcggagtcgatctcccaaaaggagaaggtaggccttcagtcatttgtgatgaaggatagggct

SEQ ID NO: 65519 - DNA, 201 bp, Homo sapiens
tactttttggcatctaaatcttttatttccaggttgtttgctctaatgactttttcttgcagagtttgaattgatgcatgttgatgagtttattgatgaaytattgcacagtgagagagtctgtgatatcattctgccccgactacaggtaagaaataaaagtctgttaccagagtcacccttctcttcctagacgggcag

SEQ ID NO: 65520 - DNA, 201 bp, Homo sapiens
tgttgccatttcaggtctaagaagagccacaagaagagccggagagggaatgagtaatggactcagtttggttttagtccacatggcctcctgtggatatraggatatctgtatgtggaaggattaagatctcccccaggcagctataagaatattttagtttttttcttatcaagtttctcaacctttatttttaatgaa

SEQ ID NO: 65521 - DNA, 201 bp, Homo sapiens
gcctgtaatcctagctacccaggaggctgaggcagcagaattgcttgaacccgggaggcagaggttgcagtgagccaagatcgcaacactgcactccagcytgggcaaaagtgagactccgtctcaaaaaaaattttttttctaactctagccaaaaacaatatttccttattaaaagcacctcagctctgccatatacta

SEQ ID NO: 65522 - DNA, 201 bp, Homo sapiens
tttcttagccctcattttccttacctggaaataagaacattgctagaactttcttcatgacttgttaaaaaaggttaagtgagataatatgaaaagcttakcagggtacctattttattatccattctcaatgtatattagctgttgtcgttactgttattaatacacattcgttctcctaatattacactgttgatgtat

SEQ ID NO: 65523 - DNA, 201 bp, Homo sapiens
cagtcctaaagttagaatgggagggtgctagagttacgtgacaaaagacatggatacagaggtgggtgatacagagaagcgtgaaggataagattggggcygtttttgcaatctaccacatccagtgcgccaacctaggctttcttcttcctctcctctttataggcggagtcgatctcccaaaaggagaaggtaggcctt

SEQ ID NO: 65524 - DNA, 201 bp, Homo sapiens
gcgagtcatgtcaccagtcctaaagttagaatgggagggtgctagagttacgtgacaaaagacatggatacagaggtgggtgatacagagaagcgtgaagrataagattggggccgtttttgcaatctaccacatccagtgcgccaacctaggctttcttcttcctctcctctttataggcggagtcgatctcccaaaagg

SEQ ID NO: 65525 - DNA, 201 bp, Homo sapiens
catggtagtggcagaactcaagagcaaacaaacccggtcatgcaaatgtttttccagtatctgcttttatcacatttgcaaatatctcattagccaaagcragtcatgtcaccagtcctaaagttagaatgggagggtgctagagttacgtgacaaaagacatggatacagaggtgggtgatacagagaagcgtgaaggat

SEQ ID NO: 65526 - DNA, 201 bp, Homo sapiens
ttttaccagtacttctacctttgcattgtcatagacagtgtgaatgctccttttcatctacattgttactgtctctatgcaggttttcccttgtccctcaygggagttttcagtctgactactagcttcgtgttggccttacccagcctgcctctgtctgtctccctttccaagtgcatcttatgttaatccctgccttgc

SEQ ID NO: 65527 - DNA, 201 bp, Homo sapiens
ctgagtagctgggattacaggtgcccgccgccatgctcggctaatttttgtacttttagtagagacagggtttcaccatgttggccaggctggtctcgaaytcctgacctcaggtgatctgcctaccttggcatcccaaagtgctgggattacaggcgtgagccaccgtgcctggctgcttcttaatataattatttatat

SEQ ID NO: 65528 - DNA, 201 bp, Homo sapiens
ccaactaggaagagcttagccctaatatgttactgtattgtttttgttttttagctgaacttgtagtcgataaagccatggagttaaggtttgtgggtggygtctatggtggcaacataaaaccaacaccctttctgtgtttaaccttgaagatgcttcaaattcaacccgagaaggatatcattgtagagtttatcaaaa

SEQ ID NO: 65529 - DNA, 201 bp, Homo sapiens
aatggctgcaagttaaatttgaaatcagttttggggacaacattggaataagactaaatagcaagaccacttttcttttttttttttttttttttttttgktaatacgaagtcttgctctgttgcccaggcttgagtgcagtgatgcgatctcggctcgctgctgcaaactctgccttctaggctgagacaattcttccac

SEQ ID NO: 65530 - DNA, 201 bp, Homo sapiens
ttattttttatttttgtagagatgggttctcattttgttgcccaggctggtcttcaactacagggctcaaatgatcctcccaccctagcctcccaaagtgytgggattacaggtgtgagccacagcacccagctttgctaagtcttcaagcaaggtacttcacctatctgagcttcaatttttttcacctggagagaatat

SEQ ID NO: 65531 - DNA, 201 bp, Homo sapiens
caagggagtagtttaggtgataataattaggaattttccagaaatgtcagaagatgcctatcattagttccaggaagctcgggcttgcaagcaagaaacctttttttttttttttttggagacagagtctcactctgtcttccaggctggagttcagtggtgcaatcttggctcactgtaacctctgcctcccaggtttaa

SEQ ID NO: 65532 - DNA, 201 bp, Homo sapiens
gggggttcaggacaattctagtatataatttactcttataactgtgatatgagattgcagttgattattctctggctgtcttaagtagttatagtctttgmattttagtaatgggaaatagttttctagataaagcttcttaactctaggtggcagaactctttagccttatcatcagtacattattagtcaagttacctg

SEQ ID NO: 65533 - DNA, 201 bp, Homo sapiens
ttgcattccaggaataaatcccatttgatcgtggtgtacaattctttaactgtgctgctgatttcagtttgctagtattctgttgtggatttttgcatgartgtttatactattttcattttaagcctcagcctcccaggtagctaagcatacattcagtgacattaaatttatttacattattgtgcaactatcaccacc

SEQ ID NO: 65534 - DNA, 201 bp, Homo sapiens
atcagctgggaggatcgtcttagcccaggaattcgaagctgtagtgagttagaatggcatcactgcaccccagcctgggtgacacagggagaccctggctytgaaaaaaaaaaaaaagtactttttcttgataattattaagatatagttggttatttaaggttagaatttcatttaatacccatttaccacattctaaaa

SEQ ID NO: 65535 - DNA, 201 bp, Homo sapiens
tcagtttcctgtctgtgttgtatccaacagacagatgtgccacccgtcggtgtagagagcgttgtccccacccaccaagaggaaacgtgtcggagtaatgmgagtccattttctttcagctggtctaccgatgcacagcaaccagccaatcctgctgtctcaagggtatccgtacctcaatgtcagttacattcagcagaa

SEQ ID NO: 65536 - DNA, 201 bp, Homo sapiens
cactgtgttagccaggatggtcttgatctcctgaccttgtgatccaccctcctcagcctcccaaagtgctgggcttacaggtgtgagccacggcgcacagsctgtatgtagccatcttatctgtattaaaccaaacatgatttcataatggtatatccaactcgaactcattaccacatggctcgttttagcccccactcc

SEQ ID NO: 65537 - DNA, 201 bp, Homo sapiens
ccgtattgtaggtatctggtagatggaaggtgaatatttttgttgagttagtttatttctgtctttccctgctaaatataagaacaattaaaatagaaactttttttgtttttattgttgtgaatcattacattaataggaaaaacaagaagaaagtgagcttcgttctctgccacctccttcccctgcccacttggctgc

SEQ ID NO: 65538 - DNA, 201 bp, Homo sapiens
ctgcccgtctaggaagagaagggtgactctggtaacagacttttatttcttacctgtagtcggggcagaatgatatcacagactctctcactgtgcaatarttcatcaataaactcatcaacatgcatcaattcaaactctgcaagaaaaagtcattagagcaaacaacctggaaataaaagatttagatgccaaaaagta

SEQ ID NO: 65539 - DNA, 201 bp, Homo sapiens
aggagaatcacttgaacctgggaggcagaggttgcagtgagccaaggtcatgcctttgcactccagcctgggcgacaagagcgaaactctgtctcaaaaawatatatatatatatatatatatttttttttttttttgaaataggatattactctgtcacccgggctcaactgcagtggtgcaatcatgtgatcagggttc

SEQ ID NO: 65540 - DNA, 201 bp, Homo sapiens
aaaagcagatggatttattatgtaagtcggaaaaagctaaaagtctcaatgattgtttggatgtggacattgagagacagatattaaggattgcacctgtrtttctgatgtgggcatctgtgtacatgatggtactatttgctaagaacagggataatagaaatagtaatagatttggggcaaagttgatagttcagacgt

SEQ ID NO: 65541 - DNA, 201 bp, Homo sapiens
ttgtaaacttgctgtaattgcttattcttggagtattgtttcaatttggattttatgcatggattatcatgtcatatgtgaacagttttatttcttctcamcctgtataccttttatttccttttcttgtttcattgcattagctagaacttccagtgtcagcattacctaagacttcccagatgttgaaaaggagtggtg

SEQ ID NO: 65542 - DNA, 201 bp, Homo sapiens
aacatctttctttaattcgtatggaactctagttatggaatgacatgtagttttcagttagctctaaatttattaaaacatttgtttttattagggctttwacggtactatgttacaatatgataactagaaagaaaatagccacaggatttgaagtattctgcttttaagggtattaatacaatgaaatttgtttctttc

SEQ ID NO: 65543 - DNA, 201 bp, Homo sapiens
aaagctaactacaagttaattctaaggtgttgtcagataaacaggcacaagcctttcagtttcctgtctgtgttgtatccaacagacagatgtgccacccrtcggtgtagagagcgttgtccccacccaccaagaggaaacgtgtcggagtaatgcgagtccattttctttcagctggtctaccgatgcacagcaaccagc

SEQ ID NO: 65544 - DNA, 201 bp, Homo sapiens
ggtagttgcttctgaggagagaaattgggagttggcaagagagtactgtttttcaaccatgtaaatgtatttgttttattaaaaacagattagaggcaggsgtggtaatcccagcactttgggaggccgaggcgggcagaacatgaggtcaggaccatcctgaccaacatggtaaaaccccgtatctgctaaaaatacaaa

SEQ ID NO: 65545 - DNA, 201 bp, Homo sapiens
atccttcacgcttctctgtatcacccacctctgtatccatgtcttttgtcacgtaactctagcaccctcccattctaactttaggactggtgacatgactygctttggctaatgagatatttgcaaatgtgataaaagcagatactggaaaaacatttgcatgaccgggtttgtttgctcttgagttctgccactaccatg

SEQ ID NO: 65546 - DNA, 201 bp, Homo sapiens
aggaaactttttggtacccctttttatccactcattggcagagaagctgtaagtttacattatatgaattgtgaatcttttctttttttaaatagaacaaraaacttaattgtgtttccaaactgatgttagatatagggaaagagatggtcatagctttgtatattttttcttattgcatttatcatagtccatagtgag

SEQ ID NO: 65547 - DNA, 201 bp, Homo sapiens
tgggaaggagattgtccaagctccagggaagaaaaagactgattggacagggaagaagtgtcccaggccttctcaacagcaactagcaaaggagggtatcyttgtagatgttcagtcctttaccagcctagctattgttatttatgtttcaaaatgcgggactgtttgcaagattggggtgaggcccagcttctggcatct

SEQ ID NO: 65548 - DNA, 201 bp, Homo sapiens
caggatcactttcaggatcacttcttacagccatggttcattaagtgtggccccccagtccagccacatcagctgggaggatcgtcttagcccaggaattygaagctgtagtgagttagaatggcatcactgcaccccagcctgggtgacacagggagaccctggctctgaaaaaaaaaaaaaagtactttttcttgataa

SEQ ID NO: 65549 - DNA, 201 bp, Homo sapiens
tagactttttgttattaatcttagagcaattagagttgtttactgggtactaactgaattgttttaattctagaatcctaaataattacataatttggggkaaatgtttaaaaaccatcatttctgcagagtatttttctttccttttttaaatctttattttattatgtacagactatattcaaataaaccacacactct

SEQ ID NO: 65550 - DNA, 201 bp, Homo sapiens
tcttttgtttcagatattaatagctgcaattgcctctttttttttttttttttttttttttgagacagaatctcgcttagtcacccagtctggagtgtagkggcacaatctcagctcattgcaacctcaatctcctgagttcaagcgattctcctgcctccgcctcccaagtagctgggactaccagcacgaaccaccacg

SEQ ID NO: 65551 - DNA, 201 bp, Homo sapiens
catttggctgatttttgtttgttttttttttttttgtagagacagggttttgccatgttgcctgagctggctttgaacttctgaactcaaatgatcctccygcctcaatctaccaaagtgctgggattgcaggcatgaagcaccgtgcctggccctaacctagaattttatacctaactaaatgaggtgtgaagatacaat

SEQ ID NO: 65552 - DNA, 201 bp, Homo sapiens
aagtagctgggattacaggcatgtgccactacgcccagctaattttgtatttttagtagagacggggtttcgccatgttggtcaggctggttttgaactcyggaccttaggtgatccacctgcctcggcctcccaaagtgctgggattacaggcgtgagccgctgtgcctttccgagactttttagtagaatgctaaatta

SEQ ID NO: 65553 - DNA, 201 bp, Homo sapiens
aaagacagtgaagaagagaaggaagggaatgaagaagagaaagattcccgagatgttcttgacccccgagacctccacgatactcgagactttagagaccygagagacctcagatgttttatatgtggagatgctggacatgtacgaagggagtgcccagaggtcaagctggcccgtcagaggaatagcagtgtggcaggt

SEQ ID NO: 65554 - DNA, 201 bp, Homo sapiens
tgtagcacttgatgaaacagaacatatcctgtttctgtttttaaagtaatgagaactgttagctaataaaattggataatcccagccagatatgataattyagagaataccaccgagaggtgttgaattgtgggatggtttaaaaagaaaagccgactttgtgtgtgtgtgtgtatgtgtgtgtgtgcgcgcgcgagcgcg

SEQ ID NO: 65555 - DNA, 201 bp, Homo sapiens
atcttcattatgtcagtgttaacaacttacacaggttgagcactccaaatctgaagcctgaaatttactgagcactgacatgaccctcaaatgaaatgctyatgtggagcatttgagatttcagattttctggtttggggtgctcagctggtataaatgtaatgcaagtattccaaaatccaaaacacttctgatctcaag

SEQ ID NO: 65556 - DNA, 201 bp, Homo sapiens
ttcattatgtcagtgttaacaacttacacaggttgagcactccaaatctgaagcctgaaatttactgagcactgacatgaccctcaaatgaaatgcttatrtggagcatttgagatttcagattttctggtttggggtgctcagctggtataaatgtaatgcaagtattccaaaatccaaaacacttctgatctcaagcat

SEQ ID NO: 65557 - DNA, 201 bp, Homo sapiens
ctcagcctcccaaagtgttgggattacaggcatgagtcactgcacctagcctacaggcaattttgtacagagaataattcctttccagaagtagcccgatrtagcagaaagcatgagttttgttgtgagacagacttagctctacatcttttatgtgagacttaacctgttttttctatgggcaaatgacctgaactcctg

SEQ ID NO: 65558 - DNA, 201 bp, Homo sapiens
tttgtatatatgtccttgctaggcacataaggtggaatgagcattccttttggaataatgtagatctgggtttctgtctacagagaagctacttaatttayatgagcctactcttcaattgtacaataactacctaataagatggattaaaaataaggtaatgactttgaggtttcagactttgcttagtggaaaaatatc

SEQ ID NO: 65559 - DNA, 201 bp, Homo sapiens
ccttttgggagatcgactccgcctataaagaggagaggaagaagaaagcctaggttggcgcactggatgtggtagattgcaaaaacggccccaatcttatycttcacgcttctctgtatcacccacctctgtatccatgtcttttgtcacgtaactctagcaccctcccattctaactttaggactggtgacatgactcgc

SEQ ID NO: 65560 - DNA, 201 bp, Homo sapiens
gatgaaaaaatatttttaaaatgtgtccacagtaaaataactacatgtaatattattccttttaacaaaaatatgtatctttgtatgaattttaaaaagartgaaaaaaatgatcatcaacattttaatggttattttagagtgatgatatttcaagttattccttatatttttcattgtcatttgaactttttacaatga

SEQ ID NO: 65561 - DNA, 201 bp, Homo sapiens
cccagctactcgggagactgaggcagaagaattgcttgaacccgggatgcggaggttgcagtgagctgagattgcgctgctacactccagcctgggcggcwaaagtgaaactccgtctggaaaatacaaaaacaaaaaaccttcatatgcaaaaaactactgccttttgggtaattaaaaaatatttgctttgaatattat

SEQ ID NO: 65562 - DNA, 201 bp, Homo sapiens
atataaataattatattaagaagcagccaggcacggtggctcacgcctgtaatcccagcactttgggatgccaaggtaggcagatcacctgaggtcaggarttcgagaccagcctggccaacatggtgaaaccctgtctctactaaaagtacaaaaattagccgagcatggcggcgggcacctgtaatcccagctactcag

SEQ ID NO: 65563 - DNA, 201 bp, Homo sapiens
tgaggtgggaggatggcctgagcctgggaggttgaggctgcagtgagccgtgattgtgccactgcactccagcctgggtgacagagtgagaccctgtctcaaaaaaaaaaaaaaaaaagcctctcttctcaaggatctcacaatccattagaatttagagtttagtttttatttcacttacattgaatgagttgatttaaa

SEQ ID NO: 65564 - DNA, 201 bp, Homo sapiens
agaccagcctggccaacatggtgaaaccctgtctctgctaaaaatacagaaattagctgggcatggtggccggtgcctgtagtcccagttactcgggagtytgaggcaggagaatcgcttggacctgggaggtggaggttgtggtgagccaagattatgccactgcactccagcccgggcaacagagtgagactccgtctt

SEQ ID NO: 65565 - DNA, 201 bp, Homo sapiens
tacatatgtatagcagtatcagaactgttaaccaatacccctgtgggaaacaactttattaactagagtaccgtgcttatgtatggtttcttttgcccttagtcttatcgattccactcattttcaaatttacttaggtcagcacctttccccccactccctcatgtgaagttgtttcatacatttataatatagttagat

SEQ ID NO: 65566 - DNA, 201 bp, Homo sapiens
acatgagacagaagacagaattacaacagattggaaaaaaaattccaagctcctttacttctgtggacaaagtgaatattgaagctgtagggggagaaaartgtgctctgcaaaactcaccacgatctcagaagcaacagacatgtacagataatactggtgattctgatgatagtgcttcaggaattgaagacgtatcgg

SEQ ID NO: 65567 - DNA, 201 bp, Homo sapiens
gtgggttttgacaagtgcattgtgtcatgtatccaccattagagtgtcatacagaatagtttcactgccctaaaacaagttaacgaattacattaattttwtttaactccccttcttctgtaagcactgataactgcatttgtttttaaaaagctgaatattagtttaattcattataacaaattcttaataaattactgc

SEQ ID NO: 65568 - DNA, 201 bp, Homo sapiens
gtgctctgcaaaactcaccacgatctcagaagcaacagacatgtacagataatactggtgattctgatgatagtgcttcaggaattgaagacgtatcggaygatttaagtaagtcattttttggagggatttttgtatattaatgttctttagattatccccggtttaaccattttaattacaaaaagtcatgtttataca

SEQ ID NO: 65569 - DNA, 201 bp, Homo sapiens
tgcttaatgcagtttctgacatataggtcttcagcacgtgttttttgactaaattaataattacaacaagtactattgagaaattttctttgaattacaartgatgttaatctatctggtttttttttgttgttgttatttttgttttgtttattttgagatggagtctcgctcaggctgaagtgggaatgtagtggcacg

SEQ ID NO: 65570 - DNA, 201 bp, Homo sapiens
tggtgaacacggtgaaacctggtctctactaaaaatacaaaaaaattagccgggcacggtggcgggtgcctgtagtcccagcaactcgggaggctgagacrggagaatggcatgaacccgggaggcagagcttgcagtgagccgagatagcaccactgcactccggcctgggcgaaagagcaagactccgtctcaaaaaaa

SEQ ID NO: 65571 - DNA, 201 bp, Homo sapiens
tgccactgtataactttccccagtcaccaccagctcagtattctcccatgcacaatatgggattgttgccaatgcaccctctccagatccctgccccgtcytggcccatccatggcccagtgatccactctgcaccaggcagtgcccccagcaatattggcctaaatgatcccagcatcatctttgcacagcctgctgcca

SEQ ID NO: 65572 - DNA, 201 bp, Homo sapiens
ctttaggtgtataatcatctgtctgtctgtccatccatcctcccttcctccttccctctccccccctcccctgccctcccctcccttcctctcccccgtctttttttttttttttttttttttaaaggtagcgtctcactcctgttgctgcccgggctggactgtgcaatcatggctccctgcagcctcaacttcccaggc

SEQ ID NO: 65573 - DNA, 201 bp, Homo sapiens
gttgcatcagtcttgcagctttgttcttctccttcaatattgtgttagctattctgagtcttttgcctctctatgtaaactttagaatcagtttgtctatrtccacaaaatgacttgctagaattttgattgggattgaattgaatctggagaccaagtagggaagaactgacatcttgacaattttgagtcttcctgtca

SEQ ID NO: 65574 - DNA, 201 bp, Homo sapiens
ggatagtactgtatagacattgttcttttctttttttttttatatgtagaaaaagcgtttaccttcacttggaaagaacacagaatcattaggggagcttyggctgggactgcttcgtttctatactgaagagtttgatttcaaggaatatgtaattagcattcggcagaaaaagctgttgacaacttttgagaagcagtg

SEQ ID NO: 65575 - DNA, 201 bp, Homo sapiens
atcagcatttatagatgaacagttgctctcagttttaatgatagggaacactaactttgaaccccaattaaatgaactgttatctccctccaaaataattmtattcttagtggtaaacttataaaagattatatctaattattagtattagcatatttaacatttcttcaataaaatttttttgtggaaatttgctttctc

SEQ ID NO: 65576 - DNA, 201 bp, Homo sapiens
tatttttaaaatgtgtccacagtaaaataactacatgtaatattattccttttaacaaaaatatgtatctttgtatgaattttaaaaagaatgaaaaaaaygatcatcaacattttaatggttattttagagtgatgatatttcaagttattccttatatttttcattgtcatttgaactttttacaatgattagggtagg

SEQ ID NO: 65577 - DNA, 201 bp, Homo sapiens
gctaaggtaagtgaaagagaggaaaactacttatttatatttttagaaggaaatgtatttaatcttcaaaattaggccttttcttgtactgacatgtaacrtcaatcataacatgtgggagaaagtagttttctgtgctagacagaaagttggtgtggcaggttgtaatttatggacataaaaataaatttttgtagacac

SEQ ID NO: 65578 - DNA, 201 bp, Homo sapiens
ccaaatgagcaggtgtgccataaatgtttgttcccttgccttcaaaaagacgcatgaaatgatgggcatgttagtccttttgttattgtgagagtcctgcrtagtttgttctgtgactcacttaatttacaagtccctagccccacattattggtatcagcagtttactgtttagactaaagaagaaagacagtgaagaag

SEQ ID NO: 65579 - DNA, 201 bp, Homo sapiens
gcaaagaactggggctgaaggaagttactattagtcataagcccttttaggaggggagagtctgcaactcttttctagtgggttttttccctttgattcckcctctccatctttcgtgtcctctccttttttcacatacaggtatttccttcccttcttcatttttctccccaccctctcaaatgttttgcagcatgcttt

SEQ ID NO: 65580 - DNA, 201 bp, Homo sapiens
gtttaagttacatgtaaaaattatttactatgataagaaaaggaatgaatttttatgggtttagtgacttgaatgactttcagacattttatgaacttgaraagtagacttttatatatacaactgaggatgaagttaaactttctaagaaactaaatcttcttgatctgtcccaatcatattattttcaaattggcctct

SEQ ID NO: 65581 - DNA, 201 bp, Homo sapiens
tatttttagtagagacggggtttcaccatgttggccaggctggtctcaaactcctgacctcctgatccacccgcgtcagcctcccaaagtgcggggattayaggtgtgaaacagtgcacctggccataacatgtatttttgcaaggtcactcaccctggcttctgtgaaagaagcctgagaagggtctgtttggggagacc

SEQ ID NO: 65582 - DNA, 201 bp, Homo sapiens
aagacagaaacagacaaccaaagtaatgccatgaaggaaaaacatggcaaagtaagcctttttgtttttgttttttggcttttctatctgtagaatttgtratattcttcgattgaagctattttaattgtagattgactgaccttgagcaagcctcttggcctcattttcctcatctataaagtgaggggttgatctggt

SEQ ID NO: 65583 - DNA, 201 bp, Homo sapiens
ttaaacatcttttggatttcatgtatttttaaagtgtgaacaattaaaaataattcagattactttaaaaaaatccatttaacccatttattgggtgcctrctttgtattaggcactgtggtatgcccagaagatgtaatgataagcaaaatcagaaatgatttcttacctcatagacttgagaatctcatggggagactg

SEQ ID NO: 65584 - DNA, 201 bp, Homo sapiens
agtctgaatcaccatcttattctcctcagcctcagccatttccacagaactcttcccagtcagctgctattactcagccttcatctcagccaggatcccarcctaagcttggcccacctcagcagggagcccaacctccccatcaggtccagatgccactgtataactttccccagtcaccaccagctcagtattctccca

SEQ ID NO: 65585 - DNA, 201 bp, Homo sapiens
gacttaattcattctccagtaggaactgatttgacagaatttttatgctagagaattgaaataactagattgagccaacttttcttatttacttgttgccwtgggcaaattaatccctgagatttagtttgccaataaaatggggagttctgatagggttgttgaaaggttaatactctataagggatggctatatttatt

SEQ ID NO: 65586 - DNA, 201 bp, Homo sapiens
cccagtacaaattatctccaaattgtataactagtggtggttcacatctgtaattccgggattcctttgggaggctgaggtgggagaattgtcttggtgcyctaaagtgttgggattacaggtgtaagccactttacctggcttcaacactctctttaacttggtggtaagtaaggcaggaatgaaaggaaaaggagatat

SEQ ID NO: 65587 - DNA, 201 bp, Homo sapiens
atcaatggaaggaaactttttggtacccctttttatccactcattggcagagaagctgtaagtttacattatatgaattgtgaatcttttctttttttaamtagaacaagaaacttaattgtgtttccaaactgatgttagatatagggaaagagatggtcatagctttgtatattttttcttattgcatttatcatagtc

SEQ ID NO: 65588 - DNA, 201 bp, Homo sapiens
gcaaggcagggattaacataagatgcacttggaaagggagacagacagaggcaggctgggtaaggccaacacgaagctagtagtcagactgaaaactcccrtgagggacaagggaaaacctgcatagagacagtaacaatgtagatgaaaaggagcattcacactgtctatgacaatgcaaaggtagaagtactggtaaaa

SEQ ID NO: 65589 - DNA, 201 bp, Homo sapiens
ttggagccgggattcgtaacccaggtctgtctgactccagagttcatgctctttccattgtatctcactgcctctctgtaatttttttaacccataatgtwgctgaaatatagtactaatagtactgtagaacctaaccactgctttctgaaactgatagctttctgagttccaccgtgagatgccaggagcagaccttcc

SEQ ID NO: 65590 - DNA, 201 bp, Homo sapiens
ttatttgttatgatatacatcatagagttctgttttataaagtttttaattttgtattttatctctacttttataaaattaagatgtttataaattaattwaaaaaaattttttttttgtctgcagtctgaatcaccatcttattctcctcagcctcagccatttccacagaactcttcccagtcagctgctattactcag

SEQ ID NO: 65591 - DNA, 201 bp, Homo sapiens
tctaatacccagtccttgttcagtttttcctgtttatctaaaaaagtatatagttttttgagacagtctcgctctgttgccaggctggagtgcagtggaayaatctcggctcactgcaacctccgccttctgagttcaagtgattctcctgcctcccgaatagctgagactacaggtgcgcaccaccatgcccggaatttt

SEQ ID NO: 65592 - DNA, 201 bp, Homo sapiens
gcttgggtgggttttattctgggatagagagccttagtgaaggccaggatctgggagtgaaaattcatgaattcagtaaacatttactgagaaattatactgtgtgtcagatggtgctaggtgcttgtaaaacaaaatctccattacttgatgcacactttattaggaaagccagacatgttaaatagaaaaggagtttag

SEQ ID NO: 65593 - DNA, 201 bp, Homo sapiens
gtggggaggtacttacgttgcacagttatgtatgtttttaaggggaatatttgagatagctaaatccatacctttcatgtaggaagttagcagataatagstaaggccgggcatggtagctcatgcctgtaatcccggcacttgggtaggccaaggcagcaggatcgcttgagcccaggagttcgagacagcctgggcaac

SEQ ID NO: 65594 - DNA, 201 bp, Homo sapiens
cttgggtgggttttattctgggatagagagccttagtgaaggccaggatctgggagtgaaaattcatgaattcagtaaacatttactgagaaattatactgtgtgtcagatggtgctaggtgcttgtaaaacaaaatctccattacttgatgcacactttattaggaaagccagacatgttaaatagaaaaggagtttaga

SEQ ID NO: 65595 - DNA, 201 bp, Homo sapiens
gagacagcctgggcaacatggtgagaccctgtctccataaaattttttaaaaaattgccaggtgtggtcgtgtgtgcctgtgaggctgaggtgggaggctygcttgagcccaggggtcaaggctgcagtgagccatgactgcacgccactgcactccagcgtgggtgacagagtgagatactgtataaaaaaaaaaagcta

SEQ ID NO: 65596 - DNA, 201 bp, Homo sapiens
gtcaaacttatttatttgatttgttttttagaaattaaattgtaaggaaataattgaaaatttggcaaaaattcttaagagacatccaggtatgaattttraatcttatctgtaaaacaaaataaatttttttagcatatatgaaaattatttaacctactgaagtcttttttttttaaattaggtttaagaaacattttg

SEQ ID NO: 65597 - DNA, 201 bp, Homo sapiens
ggcattgtctgagtctggccttcagctctttgttaacttagttcagaacacttgggtcagagtcagtatagttaaactaggagttcaagaagttaaaacaggcactcaggaaatgctgattgaatgaaatgataacttaaaggggaagtgcctggtatggtctcaggcttgttatatttaagccttcttaaaccacccata

SEQ ID NO: 65598 - DNA, 201 bp, Homo sapiens
catgtaaagtaaatgctgccaaccttccaggtcctaaagatttggggttagtccttcgagatcaaagtcattgcaaagcaaaaaaatttcctaattcaccrgtgaaagccgaaaaggcaaccatttcacaggcaaaatcagaaaaggcaaccagtttacaggcaaaagcagaaaaatcaccaaagtcacctaattcagtga

SEQ ID NO: 65599 - DNA, 201 bp, Homo sapiens
gcgattctcctgcctcagcctcccgagtagctgggattacaggcatgcaccaccacacttggccaatttttgtatttttagtagtggcggggtttcatcaygttggtcaggctggtctcgaattcctgacctcaggtgatccacctgccttggcctcccaaagtgctgggattacaggcgttgagccactgcacccagccc

SEQ ID NO: 65600 - DNA, 201 bp, Homo sapiens
tctaggaacctccatgtgttcagctatcaagaagctatttggaccgagacctttgggtttttatggaggcttcattacatatgcaagattgattaagccamgctgttcgccattggtgatcaacttaacctttagcccttctccgctccccaaaggttggggtatagggctgaaagtcccaaccctgtaatcatgccttgg

SEQ ID NO: 65601 - DNA, 201 bp, Homo sapiens
gagaatctcatggggagactgacacgaatcagattgttcactgtaagactgtacagaagtcccttcatttctgctttcaggatcactttcaggatcacttyttacagccatggttcattaagtgtggccccccagtccagccacatcagctgggaggatcgtcttagcccaggaattcgaagctgtagtgagttagaatgg

SEQ ID NO: 65602 - DNA, 201 bp, Homo sapiens
ttgctgttattttctttgtaaaaataaaccatgtttgcatcttggtcttctttccatttggattcaaaagttttatagtgattcctcctagtaaaattgcrttttctccctaggagtacttctttgattccagagtattaacagatggagaactggctcccaatgatagatgttgccgtgtgtgtggaaaaataggccact

SEQ ID NO: 65603 - DNA, 201 bp, Homo sapiens
ttcattaaaaataaaggttgagaaacttgataagaaaaaaactaaaatattcttatagctgcctgggggagatcttaatccttccacatacagatatcctyatatccacaggaggccatgtggactaaaaccaaactgagtccattactcattccctctccggctcttcttgtggctcttcttagacctgaaatggcaaca

SEQ ID NO: 65604 - DNA, 201 bp, Homo sapiens
aattgaagaacttggagtccgacatttgagggctggaagcattcagcacaggagaaagatgtaggctgagaggctagtcctgtcttgccttttcacatttytctgcttgccttatgttcactggaagatgattaaattatgcacactagattaagtgcagatgtgccttccccagcccactgactcaaatgttaatctctt

SEQ ID NO: 65605 - DNA, 201 bp, Homo sapiens
agagatcagtgccctgtctctcatgtatatcagttttgataattcataatgctgcttttgaaattaatttctcattaacttaaatactaagtttggttgamatttatttctgaagtacaaatgaatgttaaaaacatctttctttaattcgtatggaactctagttatggaatgacatgtagttttcagttagctctaaat

SEQ ID NO: 65606 - DNA, 201 bp, Homo sapiens
tgagccactgttcctgtctctcatcagcctttaaaaaaattctctattttattcttattaaaccaggataatctttctaaagttcagattgatcatgttcyatacctgtttaaaacccttcagtggtttaccactgcatttaggatatagtctaaattacaaggcttataagacacttcattgtcttgcccctatttagct

SEQ ID NO: 65607 - DNA, 201 bp, Homo sapiens
tagagatggggtttcattcaccatgttggccaggatggtctcgatctcttgacctcatgatccgcctgccttggcctcccaaagtgctggatttacaggcrtgagccactgtgcccagcctaaaaaagtattcctattatcgatttatttgaatcaaaattaaaactgtgtgtttggtttttatatctctttgatttttat

SEQ ID NO: 65608 - DNA, 201 bp, Homo sapiens
cttattaaaccaggataatctttctaaagttcagattgatcatgttccatacctgtttaaaacccttcagtggtttaccactgcatttaggatatagtctraattacaaggcttataagacacttcattgtcttgcccctatttagctcttcagcctcggccattcccctgccattatatatactccagtaatattaaact

SEQ ID NO: 65609 - DNA, 201 bp, Homo sapiens
ttgaacattcaaacttgaatggaaagttgattttgtctgtatttgaagtacttctattttaagttaataaatctttttgacaagagttaaatttggttaawctgttgtatagatgatggaaatattacgtaacaagatttcttttaatttcagtgaatagagcattctaaatcacagattttagttttagagattcaagta

SEQ ID NO: 65610 - DNA, 201 bp, Homo sapiens
gagtagggtggctctgtctttttttcctgtatgtattctattcccatgtgcaactgactagtcagtttctcagcagtaacatttctcaatgcagtgatttyagccccaggcatgggagttggcatatcatcctagttaagaatttctgagttaagaaatcttatatttgagtttagtgataagtttttctgacccagaaaa

SEQ ID NO: 65611 - DNA, 201 bp, Homo sapiens
tttttttttttaattacctcctgaaagcacaggttatcaaaactgagttacataaaagatttgttttgaattcacttcctaagtgatgaagtccctcaaargtttattagattagatttctttttatctttgtgtagccaccaacgatagtatgcagcatctgcaaaaaggatggccattcaaagaatgattgcccagagg

SEQ ID NO: 65612 - DNA, 201 bp, Homo sapiens
aaatatgtatctttgtatgaattttaaaaagaatgaaaaaaatgatcatcaacattttaatggttattttagagtgatgatatttcaagttattccttatrtttttcattgtcatttgaactttttacaatgattagggtaggaaaaagcaagctacttttatcatgaaaattaagaaagctaaatggtagtacttttttc

SEQ ID NO: 65613 - DNA, 201 bp, Homo sapiens
ttgaatttattcactgttaaagtttctagtttcagagaaacaaaataaccaacacttacctgtagggcctggccaggtggctcactcacgcctgtaatctyagcactttgggaagtggaggcgagaggattgcttgagcgtaggagtttgatatcagtctgagcagcatagtgagactttgtcactgccaaaaaataaaag

SEQ ID NO: 65614 - DNA, 201 bp, Homo sapiens
tgatgatagtgcttcaggaattgaagacgtatcggacgatttaagtaagtcattttttggagggatttttgtatattaatgttctttagattatccccggkttaaccattttaattacaaaaagtcatgtttatacataattgtttagcacttttgttcccgtatgaaaacatccacattaataatacttgcattaatggt

SEQ ID NO: 65615 - DNA, 201 bp, Homo sapiens
ctgggctcaagccatcctcccacctcagcctcttgagtaggtgggactgtgggcgcttgcgaccacacctggccaatttttttttttttttttttttttgkatttttgtagagatgcagtttcaccatattgcccaggctggtctcaaactcctgagctcaagtgatgtgcctgcctcggcctcccaaactgctgggatta

SEQ ID NO: 65616 - DNA, 201 bp, Homo sapiens
aggcatgagctaccatacatggctagatcattatctatttggacttgataggttatatagaaatttgattgatctcagtcttctccattaggcctaacttyagctcccacctggcacatcatttttctttttgtcatttattcattcattcaataaaattttgttttttggtgtccactacatgccaggaactgaactagt

SEQ ID NO: 65617 - DNA, 201 bp, Homo sapiens
tttgcaaactgagataattttacttcttcttttccaattgagatgcgttttgtttcttttgcctaatggcgttggctagaacttccagtactgtgttgagyagaaatggtgaacacaggccgggcatggtggctcacgcctgtaatcccagcactttgggaggctgaggtgggtggatcacctgaggtcaggagttcgaga

SEQ ID NO: 65618 - DNA, 201 bp, Homo sapiens
gaatcgcttgaacctgggaggcggaggttgcggtgagccgagatcgtgccattgcactccagcctgggcaacaagagtgaaactctgcctcaaaaaaaaawaaataaataaataaataaaaagaaatggtgaaaacagacatctttcccttgtcttgatgttagaggaaaaggttttcatttttatcattgagtatgatgt

SEQ ID NO: 65619 - DNA, 201 bp, Homo sapiens
cttgtagatacatccagattcatttatttattcaacatgacacagagcattagctcagatctaggcattgtattaaaatctgaaggtaaaagtaagacccyggtcattagcatcaagaaatccgtcatctaatgtaggggacagatacatgaatacaaattccattactctgtaaatgtgagataatagagggtaatagaa

SEQ ID NO: 65620 - DNA, 201 bp, Homo sapiens
agaccggtttgctcatcctttagaatgttgattcctaagtttagagctgttaggtacaattagtccatccaactgatgtttattgagttcttgtgtgctasttctaggcagtggtgaataagatagttgtggttcctgccctcagattttctaagaattgatgagggcatgcgttgaataaagatttaaatataatgagtc

SEQ ID NO: 65621 - DNA, 201 bp, Homo sapiens
cagtggacttccaagtgcattgcaattgaaggtaacatttaagctgatattaattcaggagcaaccaaaatttggtcaacgaaattgaggggaaaactgawatacattaggatttggaagattcttcctcttttatcagttttcctcctttaatgtgtaattttagaggaagagtttgctgatttgtatagtctgagtaca

SEQ ID NO: 65622 - DNA, 201 bp, Homo sapiens
tggattttcagattagggatgctcagcccgtatagggaaactttagaacattatagaaatgaacaaaaagaaagcaaacttgaatgcagccatataggacrtatacttttggtgaagttagagtaacagtggatttacttttcccttgaaatgacaaacaaaaaaaaaatacagaaatatgaagcagtggttttcaggcga

SEQ ID NO: 65623 - DNA, 201 bp, Homo sapiens
atcccagcactttgggaggctgaggtaggcagatcacctgaggttgggaattcgagaccagcctggccaatgtggcgaaaccccctctccactaaaaataygaaaattagccgggcttggtgacccacacctgtaattccagctactcgagaggctgaggcaggagaatcgcttgaatcccagaggtagaggttgcagtga

SEQ ID NO: 65624 - DNA, 201 bp, Homo sapiens
atctaattcagtgttaataatcctttggctttgtggcactatatatatatgtcactagattgtcattctttatttttaatttttttagagacagggtcttkccctgttgcccaggcagaagtgcagtgataggatcatggcttactgcaacctcaaactcatgggttcaagggatcctcagcttcctgagtagctaggact

SEQ ID NO: 65625 - DNA, 201 bp, Homo sapiens
attttgtatttttagtagagacggaatttcaccatgttggccaggctggtcttgaactcctgacctcaaatgttccactcacttcggcctcccaaagtacraggattataggcatgagccaccatgcctggcctttactctgtttcttttctggcttttttttttttttggggacaaggtctcactctgtcccctaggctg

SEQ ID NO: 65626 - DNA, 201 bp, Homo sapiens
agccctatccttcatcacaaatgactgaaggcctaccttctccttttgggagatcgactccgcctataaagaggagaggaagaagaaagcctaggttggcrcactggatgtggtagattgcaaaaacggccccaatcttatccttcacgcttctctgtatcacccacctctgtatccatgtcttttgtcacgtaactctag

SEQ ID NO: 65627 - DNA, 201 bp, Homo sapiens
gatattttggtatgtattttaccttttgtgtttttcatatagttgcctttaaataatgtatataaagcctcaaaaggtttcagcattctattaccagttgrtttcctttactttctcatatatgaaaggattcatctgatatttcatgaaaatcttagcaaaggtagcatgcattttaaatgttgcttattttgtattttt

SEQ ID NO: 65628 - DNA, 201 bp, Homo sapiens
gctctgtctcccaagctggagtgcagtggcatggtgttggctcactgcaacctctgcctcctgggctcaagccatcctcccacctcagcctcttgagtagstgggactgtgggcgcttgcgaccacacctggccaatttttttttttttttttttttttgtatttttgtagagatgcagtttcaccatattgcccaggctg

SEQ ID NO: 65629 - DNA, 201 bp, Homo sapiens
taagtcattttttggagggatttttgtatattaatgttctttagattatccccggtttaaccattttaattacaaaaagtcatgtttatacataattgttyagcacttttgttcccgtatgaaaacatccacattaataatacttgcattaatggtttcttactagattgatccttggtgaagctaaaaaaaaaaagcctt

SEQ ID NO: 65630 - DNA, 201 bp, Homo sapiens
gagttttgcctggcataatgaaaaagagtagaaaatattagggctagaggacggaggtatatgggaaagatggtgataaggctagagagggtaggcttagmccatattatggagtttggacttggtttactgagcattggggacctaattaaaggtttttagtggaacgaagacataatcatatttgtttagtaaacgtag

SEQ ID NO: 65631 - DNA, 201 bp, Homo sapiens
aattccagaaccttttcttgctttaagaaaccattaattctaagagtgtttctggaataaaagtgctatatcatttattagattctacttctttgaacaakatttgttgacataaaagtaaaacatggccaggtaaggtggctcatgcttataattcccgtgctttgggaggcaaaagtaggaggaatccttcttgccagg

SEQ ID NO: 65632 - DNA, 201 bp, Homo sapiens
cttggtatatacttaatagtgtaattgctgtgtcattttgataaatttatgtttaacttttcaaggaactgttttctaaagtggctgtgctactttacatycccaccagcaatacatatgtgttctagtttttctgcatcctcaccaatacttgttattgtctttttaaagctataggcatcttattgggcgtgtctctta

SEQ ID NO: 65633 - DNA, 201 bp, Homo sapiens
aaggcctaccttctccttttgggagatcgactccgcctataaagaggagaggaagaagaaagcctaggttggcgcactggatgtggtagattgcaaaaacrgccccaatcttatccttcacgcttctctgtatcacccacctctgtatccatgtcttttgtcacgtaactctagcaccctcccattctaactttaggactg

SEQ ID NO: 65634 - DNA, 201 bp, Homo sapiens
tatccttatggtgctgtactttctgcagcagagaaagccacctgttatcccagttctacaagaggtaggtgtttaagaaaactataaaggagttttttttkaaaacaatagatctaaacacaggagattttgcttggttcatgtcatcatgaaggatttttccatcatggttgtcctaagttttctctttccattaatgct

SEQ ID NO: 65635 - DNA, 201 bp, Homo sapiens
attgcaaagcaaaaaaatttcctaattcaccagtgaaagccgaaaaggcaaccatttcacaggcaaaatcagaaaaggcaaccagtttacaggcaaaagcrgaaaaatcaccaaagtcacctaattcagtgaaagcagaaaaagcatccagttatcagatgaagtcagaaaaagtaccaagttcaccagcagaagcagaaa

SEQ ID NO: 65636 - DNA, 201 bp, Homo sapiens
gaattttaatagagttgactttatgtgtctcagtctcaattgtatattaaggctgagggcaaggccaaatttaaaaactaagtcagtttagagacagaatyaaataagtgataatactggtaatgtttagatatgggaaaaatgtaaacatcatggtacttgaatgattcaggaaatagtggtggtttttttttttgtttt

SEQ ID NO: 65637 - DNA, 201 bp, Homo sapiens
tagtatatggcagagctgaggtgcttttaataaggaaatattgtttttggctagagttagaaaaaaaattttttttgagacggagtctcacttttgcccargctggagtgcagtgttgcgatcttggctcactgcaacctctgcctcccgggttcaagcaattctgctgcctcagcctcctgggtagctaggattacaggc

SEQ ID NO: 65638 - DNA, 201 bp, Homo sapiens
ccatttttttattctatagatcagttagaaagggtgttcttcttgtataattgtcttactagaaatggaagacgtagaactgaagtgtgtgaaattttccygtcgctgtttttttacatctctcatatttgcatgctatttcatgctttgatgtttttcctttattccagaatgttcacttaggttgtatggctcatctct

SEQ ID NO: 65639 - DNA, 201 bp, Homo sapiens
ggagagaaattgggagttggcaagagagtactgtttttcaaccatgtaaatgtatttgttttattaaaaacagattagaggcaggcgtggtaatcccagcmctttgggaggccgaggcgggcagaacatgaggtcaggaccatcctgaccaacatggtaaaaccccgtatctgctaaaaatacaaaaattagctgggcgtg

SEQ ID NO: 65640 - DNA, 201 bp, Homo sapiens
catttttttattctatagatcagttagaaagggtgttcttcttgtataattgtcttactagaaatggaagacgtagaactgaagtgtgtgaaattttcccrtcgctgtttttttacatctctcatatttgcatgctatttcatgctttgatgtttttcctttattccagaatgttcacttaggttgtatggctcatctctg

SEQ ID NO: 65641 - DNA, 201 bp, Homo sapiens
cagattagaggcaggcgtggtaatcccagcactttgggaggccgaggcgggcagaacatgaggtcaggaccatcctgaccaacatggtaaaaccccgtatytgctaaaaatacaaaaattagctgggcgtggtagcacacgcttgtagtcccagctactcaggaggctgaggcaggagatttgcttgaacctgggaagtgg

SEQ ID NO: 65642 - DNA, 201 bp, Homo sapiens
cacaggttatcaaaactgagttacataaaagatttgttttgaattcacttcctaagtgatgaagtccctcaaaagtttattagattagatttctttttatytttgtgtagccaccaacgatagtatgcagcatctgcaaaaaggatggccattcaaagaatgattgcccagaggattttaggaaaattgatttaaaacctc

SEQ ID NO: 65643 - DNA, 201 bp, Homo sapiens
tgcagctttgttcttctccttcaatattgtgttagctattctgagtcttttgcctctctatgtaaactttagaatcagtttgtctatatccacaaaatgacttgctagaattttgattgggattgaattgaatctggagaccaagtagggaagaactgacatcttgacaattttgagtcttcctgtcaattataatggaat

SEQ ID NO: 65644 - DNA, 201 bp, Homo sapiens
aactcctggactcaatccgccagcctcggcctcccaaaatgttgggattacaggtgtgagccatgtgcctggccttgacattattattattattattattwtttttttcgagatggagtcttgctctgtcacccaggctggagtgctgtggcgcgatctcagttcactgcaacttccgcttcccgggttcaagcaattctc

SEQ ID NO: 65645 - DNA, 201 bp, Homo sapiens
atgttttaaagaattctctttaaattcatgtataatatgatatgtatagtattagccttgaagtcatgtttatacgtaattgtttagcacttctttttttcccatatgaaaacatccaaattaataatgtttgaattaatgatttcttattagattgattctcagtgaaataaatacagtaaaacctttatatctagatca

SEQ ID NO: 65646 - DNA, 201 bp, Homo sapiens
gctctatggatacagacataaagaagaaatagcctctcttcagtcacttgagcccaggaattcaagactagcctgggcaacatagtgagaccttgtctccmcaaaaaaaataaaaaaatcagccaggcatggtgggtgtgtgtgcctgtggtcccagctactcgggaggctgaggtgggaggatggcctgagcctgggagg

SEQ ID NO: 65647 - DNA, 201 bp, Homo sapiens
tgcagtcggcagatcacatccttcatgccctgactgcatgctggccagaactgagtggcgtggcgatgcctggctgccagggcagctggaggatgtcctcrtgtttcctgagttgctgtcatgctgaaagtcagagatccacagtttcacaatctcttagccaaaattatgaaatccaaaaagcccccaacactgaaatat

SEQ ID NO: 65648 - DNA, 201 bp, Homo sapiens
gtgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgt

SEQ ID NO: 65649 - DNA, 201 bp, Homo sapiens
tgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgta

SEQ ID NO: 65650 - DNA, 201 bp, Homo sapiens
agagatccacagtttcacaatctcttagccaaaattatgaaatccaaaaagcccccaacactgaaatatttttcttagaattgatgctaaaagcattggayggtcaaattggccctaagcacgtgagaagctgtttgtggttttcccttgacctctgcagtttgagtgttcagaggccttgctgcagacacagggcagtgg

SEQ ID NO: 65651 - DNA, 201 bp, Homo sapiens
gtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgtaa

SEQ ID NO: 65652 - DNA, 201 bp, Homo sapiens
tataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgtaag

SEQ ID NO: 65653 - DNA, 201 bp, Homo sapiens
cgtagtggggagaagattccagtgtctgtgtggatgaagaggatgcggcaggagcgccgcctatgctgcgtggtggtcctggagcccgtggagagggtctygacctgggtcgctttccagagcgatgtgagtgtgcaactttgcctcatgtctcatggacgctggagccggcgtcgttctcctcttcagcaagtgctggtc

SEQ ID NO: 65654 - DNA, 201 bp, Homo sapiens
tacttagggaattgcagctttgctcgtgcagtttactgagctaaacgcggtttagctggtggaccaagaatcatggggcagaagtctgttggtgcctcctmtgtccagattccgttggtgcctcctttgtccaggcaccccaaaggactgggccatggtgaggaaggaagcgtcacttgcctttcaggggctgtctgatgg

SEQ ID NO: 65655 - DNA, 201 bp, Homo sapiens
tttactgagctaaacgcggtttagctggtggaccaagaatcatggggcagaagtctgttggtgcctcctatgtccagattccgttggtgcctcctttgtcsaggcaccccaaaggactgggccatggtgaggaaggaagcgtcacttgcctttcaggggctgtctgatggaggcacttggggagacagcaggctgtgtgct

SEQ ID NO: 65656 - DNA, 201 bp, Homo sapiens
cggggactggagggagccaggtgacatggagcccaggaagtggccagagctcgggaggaaggcaaagaggggaagagggcatgcagtcttaggcttggggkcccaggaggcctagggaagccttgtagatacccaggtacagcatttctgggatcaggagccatgatcccaaggcctctaatacttcagatatggcaggga

SEQ ID NO: 65657 - DNA, 201 bp, Homo sapiens
ggcccggaaagagcttcttttagcaccactttgggtggaccattctcccattgcgggttctgacccaggatggcggttggtggtgtatgtcttttggggcygagctgaactcagcattataaattagttggttaaactgtctttgtgtttttgcattgcagatgttaatcagcttcatgttgttttctagttgttagagtt

SEQ ID NO: 65658 - DNA, 201 bp, Homo sapiens
ctcccaaagtgctgggattacaggtgtgagccactgtgcgtggcctcccagggtccttcctaatgcaggctgctttctctcatgtaaccaagagacatacwttcatcccctaccacgtgccaggctgcactgcgtgcagatgcccctgcgctcacggggactggagggagccaggtgacatggagcccaggaagtggccag

SEQ ID NO: 65659 - DNA, 201 bp, Homo sapiens
tggtgtggcaggggtgtcaggtgggggggtctctgttctatggaaggacacagtgggggtgagagagagagagtggccagtgctggcagaaagcacagccrcctcggggctctgcatcgtggtggggccaggcgggtcggcaggtgctggcttgcgaggttgtcctgcatgcggtcactcgggtatcgaatgagtgcgaaa

SEQ ID NO: 65660 - DNA, 201 bp, Homo sapiens
tgggagcaatgaggggcagtagaacccgctgatgtcctggcagggcccacgcctgagctcctggtaaggagcaggcccctggctgcttccacagtgctcaytcttgttgacaagcatggggtgggggtgcgccctgtccctggctctgccctggtggggaccccggaactctgcctccagggcctctgcccacctggagcg

SEQ ID NO: 65661 - DNA, 201 bp, Homo sapiens
ttttctagaatatcactttcctgattcctggtttctacagctacatggaccttgcgtacaacagctcattacagctcccagacctggccagctgcctggaygtcggcaatgagagtgggtgtggggagagaaccttggacccgtggcagggccaggacccagctgaggggggccagggtaagacgtcctcttcctcctgaa

SEQ ID NO: 65662 - DNA, 201 bp, Homo sapiens
cagcagagtggatgcatttgaacccatcaccctaggaaatcaggggacctgtgcccttgtgcctcttccccactcttgcacctgcctgacccagagggaascacctgcctgaaatttaggtttaccagtctcttatttaagaagtagtttaattacataggtgtgtttccctgaactacttatttagattatttcatgaca

SEQ ID NO: 65663 - DNA, 201 bp, Homo sapiens
aggccctcagcgaggagcacatggaggccgacggccacgctgcggtggtgtttggcacggtggtgagtggatgcgggtgcagcgttcagtctggcctcaasaccagcagtgtgtggcaggaacagctcagtgttccctaccaggagctctgctgggggttgggtggcaccaggacatctcagcttcttcagctgaaaatgt

SEQ ID NO: 65664 - DNA, 201 bp, Homo sapiens
cagagtggatgcatttgaacccatcaccctaggaaatcaggggacctgtgcccttgtgcctcttccccactcttgcacctgcctgacccagagggaaccayctgcctgaaatttaggtttaccagtctcttatttaagaagtagtttaattacataggtgtgtttccctgaactacttatttagattatttcatgacaaag

SEQ ID NO: 65665 - DNA, 201 bp, Homo sapiens
atgtctgctccaaagatgtgtcgatgtcactgtaacttgccgcagagtatgtttttacctttttcttaaggggaaaatcacagatcacatgttgagcatcygaggggcttcaggtgcgtcgaagggcatttggcccgaggcctttcctgaccttaagggtgaaccctcagggactggctctccttgtgttcattcctcccc

SEQ ID NO: 65666 - DNA, 201 bp, Homo sapiens
tccctgggaggaagctgctgtgctctgcagtgcgggcttgcgtgtggcacaggcctcgcacccggcaagctctccagctcgctcctttacccaggaaggaycttgggtccagggagggaggtccctgctcatggctgccaagctccttcctctccacccttccccagcaaccaccgtcggagggagaggagcactgtgctt

SEQ ID NO: 65667 - DNA, 201 bp, Homo sapiens
gtgtaaacacgtttcgacatgtgtgccagttgggatcagtgtgctgaggctgcttggggtgccctgtggagataggctttcagacctgtctgagagcatgrgaggagaggggactggagtgcagggcacacctgcctcgggcggctgctgaagacgcagggggaccactgtgggtgctgcacctctgcccggtgcagttgc

SEQ ID NO: 65668 - DNA, 201 bp, Homo sapiens
tgagaatgaaatctactctcttgataaaacttgcacttggagattttaatgttcagtatgggaaatcttgtttgtgctttggtaaatttctgaaatgaaartcaggtaagcagaagttgaaaacgttgcagtgcctggagtttgggcctcctggaggcaggtgccccacccatactggtcttttgggttcatggcatgcag

SEQ ID NO: 65669 - DNA, 201 bp, Homo sapiens
ggcagctgtgtgaagtctaaagcttcgcttcgcttctcttttcagaagacagatggagctcctattgtctatcatcactggctgcccagaatatttgtacragtaaactgcactgccctgctgcccctgagcacacggacccgtccgaaccgcggggcagtgtgtcctgctgctccctgctgcggggactgtcctcagggt

SEQ ID NO: 65670 - DNA, 201 bp, Homo sapiens
ttgggtggcaccaggacatctcagcttcttcagctgaaaatgtcatcccaggcgccgtttccccgcttcagctgcagtgggggtgggggccctttaagaaygaatcatcgcaggaatggacactgtggctgtggctggactcctgggaggtgtcgtgggtggcccttgctttgtctgagggctgtagcttcactaatgttt

SEQ ID NO: 65671 - DNA, 201 bp, Homo sapiens
cgacggccacgctgcggtggtgtttggcacggtggtgagtggatgcgggtgcagcgttcagtctggcctcaagaccagcagtgtgtggcaggaacagctcrgtgttccctaccaggagctctgctgggggttgggtggcaccaggacatctcagcttcttcagctgaaaatgtcatcccaggcgccgtttccccgcttcag

SEQ ID NO: 65672 - DNA, 201 bp, Homo sapiens
ctgcctcccagagctgtggctcccaccctctccctgagcgcctgccctgccagggctctgccctgcctcctggcctctcctttctggctgtgagcggtgtrctgctcctgggcctgcggggctgcaggcctcctctcaggagctccttcctccctcctgcgtcctctccccatctccctggatgaaagggtttctgagttc

SEQ ID NO: 65673 - DNA, 201 bp, Homo sapiens
acctgctgcacctgacctggtggcctgaggccagggcatttgctcgcagtcacgcacgagctccatgccgtgccttgggctctcgggagggcctcagcatyggggagaggagtggctgggctctggatcctggtgtctgcttaggccatatttcattaggaggtgcaggttccaggctgcacaccctgagtcctcagagcc

SEQ ID NO: 65674 - DNA, 201 bp, Homo sapiens
tatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgtaagttaatc

SEQ ID NO: 65675 - DNA, 201 bp, Homo sapiens
atgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgtaagttaatcg

SEQ ID NO: 65676 - DNA, 201 bp, Homo sapiens
tgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgtaagttaatcgg

SEQ ID NO: 65677 - DNA, 201 bp, Homo sapiens
gcacagtcttaggtgtgtggcttgtgaagacagggtgagcacactgcctcctgtcccgagggacccactctggctgggagcaatgaggggcagtagaaccygctgatgtcctggcagggcccacgcctgagctcctggtaaggagcaggcccctggctgcttccacagtgctcattcttgttgacaagcatggggtggggg

SEQ ID NO: 65678 - DNA, 201 bp, Homo sapiens
gcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaatgtaagttaatcggg

SEQ ID NO: 65679 - DNA, 201 bp, Homo sapiens
ataaatggtagcatggatgaggatgtttacggtgacaggaaataaatggtagcgtggatgaggatgtttacggcgacaggaaataaatggtagcgtggatraggatgtttacggtgacaggaaataaatggtagcgtggatgaggatgtttacggtgacaggaaataaatggtagcgtggatgaggatgtttacggcgaca

SEQ ID NO: 65680 - DNA, 201 bp, Homo sapiens
ccaaggtcataaagatttactcccatgttttctctaagagtcttatggttttagattttacatgtaagtctttgatctatttttgaagttaatttttgtgygtggtgtgagactggggttggacttcaccctttcgtatgtggatatctagttgtactagcactgcttgttgaagactgtcctctccccattgagtggttt

SEQ ID NO: 65681 - DNA, 201 bp, Homo sapiens
tcattgcattgcaagctccgcctcctgggttcacaccattctcctgcctcagcctcccgagtagctggggactacaggcgcccgccaccacgcccggttamttttttgtattttttttagtttcaccatgttggccaggatggtctcgatttcctgactttgttatccacccgccttggcctcccaaagtgctgggattaa

SEQ ID NO: 65682 - DNA, 201 bp, Homo sapiens
caggaaataaatggtagcgtggatgaggatgtttacggcgacaggaaataaatggtagcgtggatgaggatgtttacggtgacaggaaataaatggtagcrtggatgaggatgtttacggtgacaggaaataaatggtagcgtggatgaggatgtttacggcgacaggaagtaacaatagtcctttgggtgtcttctccct

SEQ ID NO: 65683 - DNA, 201 bp, Homo sapiens
cccatgttttctctaagagtcttatggttttagattttacatgtaagtctttgatctatttttgaagttaatttttgtgtgtggtgtgagactggggttgracttcaccctttcgtatgtggatatctagttgtactagcactgcttgttgaagactgtcctctccccattgagtggtttttggcacccttgtcaaaaatc

SEQ ID NO: 65684 - DNA, 201 bp, Homo sapiens
tgtggatatctagttgtactagcactgcttgttgaagactgtcctctccccattgagtggtttttggcacccttgtcaaaaatcagttgaccatagatgcrtggatttgtttctggactctgaattctattccattgatctatagtctgtctttctatcttaagtgtgtccttaagccagtaccacactgtcttgattact

SEQ ID NO: 65685 - DNA, 201 bp, Homo sapiens
tcacacctcctcacagctcaggtgcgctctgccacagtcctgtgctcccgctgccctctgcctggagggccttccccgaggcgctcagaagctgccttccygggactcactccctatcccatgcacctcgcaggggctgcacccccgcggcacttcctgccccatctttttttccttcttggcactcatcgttccttggtg

SEQ ID NO: 65686 - DNA, 201 bp, Homo sapiens
tgcacctcgcaggggctgcacccccgcggcacttcctgccccatctttttttccttcttggcactcatcgttccttggtgcgtgatctcactcagcatctyttcctgacacctgaacaggcccatcctgtggttggcacccgctgggttgcccatcgctccttcagctgcgtgccgacacccacgtagcagcaggcgttgt

SEQ ID NO: 65687 - DNA, 201 bp, Homo sapiens
ccatctttttttccttcttggcactcatcgttccttggtgcgtgatctcactcagcatctcttcctgacacctgaacaggcccatcctgtggttggcaccygctgggttgcccatcgctccttcagctgcgtgccgacacccacgtagcagcaggcgttgtgttgggcgaccagattttcagcgacttgcagtgttctttc

SEQ ID NO: 65688 - DNA, 201 bp, Homo sapiens
cttcttggcactcatcgttccttggtgcgtgatctcactcagcatctcttcctgacacctgaacaggcccatcctgtggttggcacccgctgggttgcccrtcgctccttcagctgcgtgccgacacccacgtagcagcaggcgttgtgttgggcgaccagattttcagcgacttgcagtgttctttcttttgtgaatggt

SEQ ID NO: 65689 - DNA, 201 bp, Homo sapiens
agaacgaatcatcgcaggaatggacactgtggctgtggctggactcctgggaggtgtcgtgggtggcccttgctttgtctgagggctgtagcttcactaaygttttgcagtcctgccgggcagcacatcagatgctcaagagtaatatggttttattgtctattgatttttacattctgtttggtgtttgtgggagcgggc

SEQ ID NO: 65690 - DNA, 201 bp, Homo sapiens
agaggatgcggcaggagcgccgcctatgctgcgtggtggtcctggagcccgtggagagggtctcgacctgggtcgctttccagagcgatgtgagtgtgcarctttgcctcatgtctcatggacgctggagccggcgtcgttctcctcttcagcaagtgctggtccctgtctcattcctttgggaagaaagagaggatgagg

SEQ ID NO: 65691 - DNA, 201 bp, Homo sapiens
tgagggcattgagaccttgcagggattttgggggcatggacacttgtgccctctgtgaggttagagcgggttctggcattacagctatgggcagtgtccckgtgagggggccacacacaggttcagaggaagcatctgtcagagcagctcctggcctgggaggaaggccccacagtccttctgtcctgggtgcatgtcact

SEQ ID NO: 65692 - DNA, 201 bp, Homo sapiens
atctctgcagtctggggagcctgtgagtcgggggccggcctgggcagggcctcctctcgggggactttagagaggaaagcaaaacggaaaggaagattgtkgttcatttgtagggcctgagtggagactgtctgctgacgtgcccgatcactgtctcatctgcctgtaaaccaaatgtgtctatgtgtatgaaatagactt

SEQ ID NO: 65693 - DNA, 201 bp, Homo sapiens
tgtcccggtgagggggccacacacaggttcagaggaagcatctgtcagagcagctcctggcctgggaggaaggccccacagtccttctgtcctgggtgcakgtcactgttccggccaccagtgagccgcgtgaggtgaggcttgcagacacaggctcccagatccatctaaacatggggccaaaggccagatgtctgctcc

SEQ ID NO: 65694 - DNA, 201 bp, Homo sapiens
tggagtgaccctcctcttgggaaaccactgcctggcctgtgtgctggtcgggaagggccatggtgcttcccatgggcgggcttggcaagcctgcgctgagygccgtggcgtcctgatgcctcctcctcctcacagctacagagggccggagctggagatgtggtctctgggagtcactctgtacacgctggtctttgagga

SEQ ID NO: 65695 - DNA, 201 bp, Homo sapiens
tttagattatttcatgacaaaggaatcctcctgctgattgtcttccgtaacttgattttttccactcgtatatggctaagattcacccttgtgtgtagttyatttgttttcactgctgtaattagtggtatgaatataccagaatttaaaatctatcttcttgttaaagagtgtttgggtttcatttccttttttcctccc

SEQ ID NO: 65696 - DNA, 201 bp, Homo sapiens
tacacactctcgggttgttgggtttccgaagtttagtttctcaggctcctacttgtaagtttcagatattatggttctgcaaaaaagggtcacctctctcsctcttcctgtgttggaaggtgacgtcctccctttagtttgtggccaacacttgtttctgaaactttttacagcaaacagagtatctgtatgaggttatgt

SEQ ID NO: 65697 - DNA, 201 bp, Homo sapiens
caggtggatcacgaggtcaggagatcgagaccatcttggctaacacggtgaaaccctgactctactaaaaataccaaaaattagccaggcgtggtggcggstgcctgtagtcccagctactcgggaggctgaggcaggagaatggcgtgaacccgggaggcggaggttgcagtgagccgaagtcgcgccactgcactccac

SEQ ID NO: 65698 - DNA, 201 bp, Homo sapiens
agctccctccttctggccagcacatcccaaaggtagggctcctgacctcccgcactgtgtgatggggtggagttcttagctctgaatccataactggagaygcagaccaagggtttctgaaggcaagggtggccttaggggtgggacatgctcagttttgagcttcctgtgcgctgaggccttgaccaagggccggagcct

SEQ ID NO: 65699 - DNA, 201 bp, Homo sapiens
ttctagttgttagagttggaagcttggcagttggcctcccttcttcccatggaggacgggggcttaacagcctttgaagaggaccagagatgcctttcccrgagcctccccttgccagtgtcagcagagggcccagctgcacagaccactgctgagcccagcaggtcgttttcctcagcccacagacacctgagcagaagg

SEQ ID NO: 65700 - DNA, 201 bp, Homo sapiens
gggctgaagcgattctcccacctcaacctcccaagcagctgggactaccagcatgtgccaccacaccttgctaatttttaattttttttttgtagagatgrggtctccctatgttgcccaggctgatctcgaactcctgggctcaagtaatctgcctggcctcccaaagtactgggtatatgactttttaaaatagttttg

SEQ ID NO: 65701 - DNA, 201 bp, Homo sapiens
gcccatatctgctccatgtggttctctaggagggaagctgatgctgcccccacaggagaggcacacggggtccctcacagacctgctgcacctgacctggyggcctgaggccagggcatttgctcgcagtcacgcacgagctccatgccgtgccttgggctctcgggagggcctcagcattggggagaggagtggctgggc

SEQ ID NO: 65702 - DNA, 201 bp, Homo sapiens
gcagagaaaagttcgtggtttaagtgctcggctcatgctggcagatgactccggcaggacccttcctgctgcttttactctgctgtgattcccaggcagcwggcgcttcttttcaggcagcaggtggaactcaccttcacatttcagggtcaagttacaacaaaatgttatttcttactttagagtatgtgagaacgctgt

SEQ ID NO: 65703 - DNA, 201 bp, Homo sapiens
tatcctggtgccagatcaaggatggcacagttgccagtggcgtggctgagccccgagcctgagccccacagtcctccctccctccctccctgctggtgccyggcccctcactggggtgtctcacttgccctggggttgctgtgcctggggcggctctggacactgagtcctccccacccacagaagggctctttcctgggc

SEQ ID NO: 65704 - DNA, 201 bp, Homo sapiens
cagggtttacgacacaactgcgggggttcatttctcaccctagtagaaatactaaaaagtagctaagctgaattgtagttacgttaaatttaagttagttraaaagcagttagtgttcttcctggatgaggggttcccacaggagctgagggcattgagaccttgcagggattttgggggcatggacacttgtgccctctg

SEQ ID NO: 65705 - DNA, 201 bp, Homo sapiens
gaggagaccgtggaggctgccatacacccgccatacctggtgtccaaaggtgagcgtgagctgcaagtggtagacagtcgacactgtccttagagaccagmcacttttttttcccatttcctcattcctcagtgtatctctgtccatatcaacagtctcatttgtttcttttctattcatcaaataatttgcatatgactt

SEQ ID NO: 65706 - DNA, 201 bp, Homo sapiens
acttccccttgcaggtggggccgaggctaggctgcacggctgacggggggtttgggggccctgagatgaagcgagagcgctgaccaaagcattggcaagtkctcctgtactttactgttgggcttttggtagcattctctgcaaaatcatttctaaatgtggacttaatttggagaaatttgagactaagtgctttatttt

SEQ ID NO: 65707 - DNA, 201 bp, Homo sapiens
ttctgagggcctcaccttaggcttttgttctaggacttcttcaagtgagaagcaaagtattttagaaccttaagttgttagcacgtgatacagttaccttyttgtttcttcagaaagtggagttctgtccgctgcgagcctggagatggggaacaggagcctgagtgatgtggcccaggctcaggagctttgtgggggccc

SEQ ID NO: 65708 - DNA, 201 bp, Homo sapiens
acagacctgatcccttctgtgcagctccctccttctggccagcacatcccaaaggtagggctcctgacctcccgcactgtgtgatggggtggagttcttakctctgaatccataactggagacgcagaccaagggtttctgaaggcaagggtggccttaggggtgggacatgctcagttttgagcttcctgtgcgctgagg

SEQ ID NO: 65709 - DNA, 201 bp, Homo sapiens
ggtggccctggcgtaatgggatgcttgaggaccggtggcccctggtgtaacgggatgcttggggaccgggtggccccggtgtaatgggatgcttgaggacygggtggccctggtgtaatgggatgcttgaggaccgggtgtccctggtgtaatgggatgcttgaggactgggtgtccctggtgtaatgggatgcttgggga

SEQ ID NO: 65710 - DNA, 201 bp, Homo sapiens
tgccaattatttggtgattgttcagatatctttttgtttttaatttctttatagagaacatactttgtataatgtcagtttctttaaatttgttgatgctygtattatgttttgaagtctctacctatacttgtggatttgcttgtttccctttgtaatcctcccagattttacttcatatatttggaagctctgttgtta

SEQ ID NO: 65711 - DNA, 201 bp, Homo sapiens
acagtgttagtcaggatggtctcgatctcctcgatctcctgacctcgtgatccgccctcctcagcctcccaaagtgctgggatgacaggcgtgcgccaccktgcctggcccggaaagagcttcttttagcaccactttgggtggaccattctcccattgcgggttctgacccaggatggcggttggtggtgtatgtctttt

SEQ ID NO: 65712 - DNA, 201 bp, Homo sapiens
ggccagggtaagacgtcctcttcctcctgaatgcgcctgtagctgctgagccccagacagccccatgcctctgagacagggctgggaggagcaggagctaytgtccctccagaggctcaggggtggtggggggcggagtagggggtgactgttttctggtttgatgttcctctctgtctcgggggctgtgacatattctta

SEQ ID NO: 65713 - DNA, 201 bp, Homo sapiens
ctcgctgtgttgtccaggctggtcttgaactcctgaactcaagcaaccttcctgcctcagccttccaaagaactgggattataggcacgcctggctttgartgtaatttagacacagaagtgttgatcttatgctgtttgtgcttccgagtggacctggtggttgcctaagtggattctggggaccatgttcagacacgca

SEQ ID NO: 65714 - DNA, 201 bp, Homo sapiens
gccaaggccaacgtcccaggggtagggcggaagtggggtggcgtgcacagggcacgcagcccaggcctctgctgtccccacctccctccccaccctccgaragaaaagacagtttgggcctcagccatggacggacgccgttactggcagcgtctccttaaactacagagatacaatgtgtatcaacagggtgatcgcttc

SEQ ID NO: 65715 - DNA, 201 bp, Homo sapiens
cctcatttcgtgggggaaactccagccatggttctggtattggccacagcctcctcttgctgtttatctaaagcctggatgaccaggtgggggcttcctgycagtagaggaaatcttcttgctttaagggctctttttgttgagtttggccatgaggacagggtattggtaaatgtgtacttgtgtttcaagtgcttgcca

SEQ ID NO: 65716 - DNA, 201 bp, Homo sapiens
gtggggtggcgtgcacagggcacgcagcccaggcctctgctgtccccacctccctccccaccctccgaaagaaaagacagtttgggcctcagccatggacsgacgccgttactggcagcgtctccttaaactacagagatacaatgtgtatcaacagggtgatcgcttctgacccactcaggcagacacctagaggtgctg

SEQ ID NO: 65717 - DNA, 201 bp, Homo sapiens
gatggagctcctattgtctatcatcactggctgcccagaatatttgtacaagtaaactgcactgccctgctgcccctgagcacacggacccgtccgaaccrcggggcagtgtgtcctgctgctccctgctgcggggactgtcctcagggtggtcctcacctctgcttccggcccctgtgtgcaaccctaacaaggccatct

SEQ ID NO: 65718 - DNA, 201 bp, Homo sapiens
agtgcctgtgaagagcaaacgctcttttttggtgttgctgccagatccaaggattaatgtcgtgcttgctggtggccacgttgtgccccgagatgagatcyggaagctgatggaaagccaagacatcttcaccgggactcagactgagctgattgctggaggccagctcctttcctgcctctcacctcagcctgctccagg

SEQ ID NO: 65719 - DNA, 201 bp, Homo sapiens
cccctctggcctcctgattccagctagtgtcagcagtgggatacctgcgcttgaaggacatcatccaccgtgacatcaaggatgagaacatcgtgatcgcygaggacttcacaatcaagctgatagactttggctcggccgcctacttggaaaggggaaaattattttatactttttgtgggaccatcgagtactgtgcac

SEQ ID NO: 65720 - DNA, 201 bp, Homo sapiens
tgagggtggcttgattttgggtgggaaaatggcttcctttgtgcctctttgtgatgagtgttgagtggtcagggtgatatgctggaaagtaagtgggcagkcaggcaaggtcatattgggcaaaggcactgggcgatggatataggagttaataattttattttctcagcttttatttgtttggagtttcatataataaaa

SEQ ID NO: 65721 - DNA, 201 bp, Homo sapiens
atggaaagccaagacatcttcaccgggactcagactgagctgattgctggaggccagctcctttcctgcctctcacctcagcctgctccagggtaagtccyttggtgggaggttgcaggtttactaaaagtccagacagatggtaggtgaatgaggaacaagtcagagagaaatgttcagcctattattcatagtaacatt

SEQ ID NO: 65722 - DNA, 201 bp, Homo sapiens
gctcctgtgtcgtcctgcgatctgggaggcagagacctgtgcggtggctgcacgggcagctcctcagcctgctatgccttggccacggacctccctggggrcctggaagcagtggaggcccaggaggttgatgtgaattcgttttcctggaacctcaaggaactctttttcagtgaccagacagaccaaacgtcatcaaat

SEQ ID NO: 65723 - DNA, 201 bp, Homo sapiens
gagagtggccagtgctggcagaaagcacagccacctcggggctctgcatcgtggtggggccaggcgggtcggcaggtgctggcttgcgaggttgtcctgcmtgcggtcactcgggtatcgaatgagtgcgaaagtggatttaatacagtcactgagaaaaactacagcttcacgagactgaccagcctggtgagataaaca

SEQ ID NO: 65724 - DNA, 201 bp, Homo sapiens
gcctccttccccacagggtctcgcctggggcattagaagctggattgtaacatttgttttaaaagatactttgttaggctgttggttctccttacaatccyggctttccttagcatgtggttcccttcattgtatctgggtttttctatctcagtctgtcctttatacaagctttttcctctagcactaattatattcccc

SEQ ID NO: 65725 - DNA, 201 bp, Homo sapiens
tacattcagtccttgtatgtattaaagtgtgtttatttttctctcatattttagtgatgatatgcctttctcctctcagaactttttagacctgtatctgktgtaatctagcattattttgaagtgaattttgctgacagcaaaacgtgatttatttttctttctagatgtaaaatctttgtctttcaaagttttcaccag

SEQ ID NO: 65726 - DNA, 201 bp, Homo sapiens
catctcttcctgacacctgaacaggcccatcctgtggttggcacccgctgggttgcccatcgctccttcagctgcgtgccgacacccacgtagcagcaggygttgtgttgggcgaccagattttcagcgacttgcagtgttctttcttttgtgaatggtatctttttctgttacactttgactatcattgactgtggtagc

SEQ ID NO: 65727 - DNA, 201 bp, Homo sapiens
acatcttgataatttagtttttgttaatgttcctctttggatcttagaggccctcttgtgagaaacacacttgcagtcaggacagggaggctccaagtggccctgttgacttggtgcctacatggttaaaggaactggggcccgaatccagatgcaaggctgggggcttctctcagcttgtgctggcatcccctcacctgt

SEQ ID NO: 65728 - DNA, 201 bp, Homo sapiens
tgcaatctctccttttgactcatctgtggccctacatgatggtcacccatgtcattatccccagggtggacaatgtcccagaaggaagcctgccagtgcayggtgaacaggcgctgcccaaggaccagcaaatcactgccttggggagagaggaacctgtggcaatagagagccccggacaggatcttctgggagaaagca

SEQ ID NO: 65729 - DNA, 201 bp, Homo sapiens
tcatgcttggcccttccaggcccacgtccacctactcttctgggtactgaactcctctctgggaggctttgcctctgaaagacttcttcactctgcttggwagggcccggctctgcaggtgcctcctccaggactgacatccttgctgtgttctactgcactgttcaccttgttggcctcatcctgaaactggttctcctt

SEQ ID NO: 65730 - DNA, 201 bp, Homo sapiens
aacggaaaggaagattgtggttcatttgtagggcctgagtggagactgtctgctgacgtgcccgatcactgtctcatctgcctgtaaaccaaatgtgtctrtgtgtatgaaatagactttattaagtcagaaatagatagcaggtgttttccactaacacctacatgtattttagagaggtgtggttggaatgcatctcta

SEQ ID NO: 65731 - DNA, 201 bp, Homo sapiens
tggagactgtctgctgacgtgcccgatcactgtctcatctgcctgtaaaccaaatgtgtctatgtgtatgaaatagactttattaagtcagaaatagatarcaggtgttttccactaacacctacatgtattttagagaggtgtggttggaatgcatctctaggtgagttcatggttagagagtcggatgatcacagcact

SEQ ID NO: 65732 - DNA, 201 bp, Homo sapiens
agtcatagctcgctgcagtctcaaactcctgggctcaggcaatcctcctgccttagcctcctgagtagatggggctgcaagggcacgccactatgcccaastgatttttacaaattttatttttagtagggacagggtctcgctgtgttgtccaggctggtcttgaactcctgaactcaagcaaccttcctgcctcagcct

SEQ ID NO: 65733 - DNA, 201 bp, Homo sapiens
cctacatgtattttagagaggtgtggttggaatgcatctctaggtgagttcatggttagagagtcggatgatcacagcactgcttggaccctcctggcccyctgctgcagtgctctgctgcaccgcccatatctgctccatgtggttctctaggagggaagctgatgctgcccccacaggagaggcacacggggtccctca

SEQ ID NO: 65734 - DNA, 201 bp, Homo sapiens
gcggtttagctggtggaccaagaatcatggggcagaagtctgttggtgcctcctatgtccagattccgttggtgcctcctttgtccaggcaccccaaaggwctgggccatggtgaggaaggaagcgtcacttgcctttcaggggctgtctgatggaggcacttggggagacagcaggctgtgtgcttgaagttggggtaga

SEQ ID NO: 65735 - DNA, 201 bp, Homo sapiens
cttgattaaggagcagctgtcccagttgagccttgcaggagccctggatgtcccccacgccgaactcgttccgacagagtgccaggctgtcaccgctcctrtgtcgtcctgcgatctgggaggcagagacctgtgcggtggctgcacgggcagctcctcagcctgctatgccttggccacggacctccctgggggcctgga

SEQ ID NO: 65736 - DNA, 201 bp, Homo sapiens
tgttatttcttactttagagtatgtgagaacgctgttctaggttaggctattttacttagggaattgcagctttgctcgtgcagtttactgagctaaacgyggtttagctggtggaccaagaatcatggggcagaagtctgttggtgcctcctatgtccagattccgttggtgcctcctttgtccaggcaccccaaaggac

SEQ ID NO: 65737 - DNA, 201 bp, Homo sapiens
aggtcccaggccacctgccccatgcccgtcagttccagctgtgccccctgactcaggccatacacttagagagccgctcctcccagcagcctggggagatyccgtcgggagcaggagaagcgtgggggtgtcacgctagagtctgtctctccacctcccaccagcccccacctcagtggtcacacagacaggccgagaggg

SEQ ID NO: 65738 - DNA, 201 bp, Homo sapiens
ccgagctgaactcagcattataaattagttggttaaactgtctttgtgtttttgcattgcagatgttaatcagcttcatgttgttttctagttgttagagktggaagcttggcagttggcctcccttcttcccatggaggacgggggcttaacagcctttgaagaggaccagagatgcctttcccagagcctccccttgcc

SEQ ID NO: 65739 - DNA, 201 bp, Homo sapiens
tcccaaaagtacagtaccatgagcccgctgggcagtggggccttcggcttcgtgtggactgctgtggacaaggaaaaaaacaaggaggtaacctggctgtsgggggggagtggcgccgggcaccacttcacatggctctcgacttttggtcccagttctcaaacctggggtttttggaggagtcctctaggtatggcacca

SEQ ID NO: 65740 - DNA, 201 bp, Homo sapiens
tagcaccactttgggtggaccattctcccattgcgggttctgacccaggatggcggttggtggtgtatgtcttttggggccgagctgaactcagcattatraattagttggttaaactgtctttgtgtttttgcattgcagatgttaatcagcttcatgttgttttctagttgttagagttggaagcttggcagttggcct

SEQ ID NO: 65741 - DNA, 201 bp, Homo sapiens
atagtgaccctcccgtcaaagggtcttcagaatttgtctcctttcacctctcacaggctggcacccaagttgcccccttctctcctgatgacggtgagagrcctggatgttgcccaggctccgatgattcttcctgctcccgccctggccccgatgccctcccgatgcccacttacgttgcctgcccagccccccgcctcc

SEQ ID NO: 65742 - DNA, 201 bp, Homo sapiens
tcctcagcctcccaaagtgctgggatgacaggcgtgcgccaccgtgcctggcccggaaagagcttcttttagcaccactttgggtggaccattctcccatygcgggttctgacccaggatggcggttggtggtgtatgtcttttggggccgagctgaactcagcattataaattagttggttaaactgtctttgtgttttt

SEQ ID NO: 65743 - DNA, 201 bp, Homo sapiens
atcctgtggttggcacccgctgggttgcccatcgctccttcagctgcgtgccgacacccacgtagcagcaggcgttgtgttgggcgaccagattttcagcracttgcagtgttctttcttttgtgaatggtatctttttctgttacactttgactatcattgactgtggtagcactgtttttcttatatttaccttatgtc

SEQ ID NO: 65744 - DNA, 201 bp, Homo sapiens
gagtgcagtggtgtgatctcggctcactgcaagctctgcctcccgggttcacaccattcttctgcctcagcctcccgagtagctgggactacaggcacccrccaccatgcccggctaattttttgtatttttagtggagacggagtttcacagtgttagtcaggatggtctcgatctcctcgatctcctgacctcgtgatc

SEQ ID NO: 65745 - DNA, 201 bp, Homo sapiens
gtggctcccaccctctccctgagcgcctgccctgccagggctctgccctgcctcctggcctctcctttctggctgtgagcggtgtactgctcctgggcctrcggggctgcaggcctcctctcaggagctccttcctccctcctgcgtcctctccccatctccctggatgaaagggtttctgagttcttattctcaatccca

SEQ ID NO: 65746 - DNA, 201 bp, Homo sapiens
cttttgtgaatggtatctttttctgttacactttgactatcattgactgtggtagcactgtttttcttatatttaccttatgtctgtcagtcttgctaaastctgattaatctcagagtcaatgttgaaaacatgtctaagagtgatagcttttctttgtattttctagttttctggcttcttcgtttattctcttggcca

SEQ ID NO: 65747 - DNA, 201 bp, Homo sapiens
cctatgtatttttcttggaaagagcttctttttttttttctttttttttgacatggagtctctctctatcgcccaggctggagtgcagtggtgtgatctcrgctcactgcaagctctgcctcccgggttcacaccattcttctgcctcagcctcccgagtagctgggactacaggcacccgccaccatgcccggctaattt

SEQ ID NO: 65748 - DNA, 201 bp, Homo sapiens
atctcagagtcaatgttgaaaacatgtctaagagtgatagcttttctttgtattttctagttttctggcttcttcgtttattctcttggccagggctttcyagtccttggttgagaagtcggggtgacgtggatgttctccggggcacatgccctgaggcctctggggccctctctccagcccaggttatggctccctcag

SEQ ID NO: 65749 - DNA, 201 bp, Homo sapiens
cctgaggcctctggggccctctctccagcccaggttatggctccctcagctccacctggattctccatctcacccatctgtccaccttacagaatgggcastaatgacgctgcatttctggtcagctgctgacccccttctgtgcttccttgtgctgcaggcgtttatcactttgtttcttctttcatgtccgtgggactt

SEQ ID NO: 65750 - DNA, 201 bp, Homo sapiens
ctcaagcaattatcctgccttagcttctagagtggctcggactataggtgcaggccacgagacctgcctggctaaaaagtttagtgttttgacttccacasatcagatcttttatgccctgggcaccatagtgagacctcatctcctagttaaaaaaaaagatggccatgtgaagatacatacaaacagggagaagtcggc

SEQ ID NO: 65751 - DNA, 201 bp, Homo sapiens
tgcaggcgtttatcactttgtttcttctttcatgtccgtgggacttaggggaggtaaatgcaggggatgtgtctgccgcatggaccaatggtggccctggygtaatgggatgcttgaggactgggtggccctggtggaatgggatgcttgaggactgggtggccctggtgtaatgggatgcttgaggattgggtgtccctg

SEQ ID NO: 65752 - DNA, 201 bp, Homo sapiens
cactttgtttcttctttcatgtccgtgggacttaggggaggtaaatgcaggggatgtgtctgccgcatggaccaatggtggccctggtgtaatgggatgcytgaggactgggtggccctggtggaatgggatgcttgaggactgggtggccctggtgtaatgggatgcttgaggattgggtgtccctggtgtaatgggatg

SEQ ID NO: 65753 - DNA, 201 bp, Homo sapiens
aatcgggcttagctaacctgtgattattgctcctgatttgaaagatactcatttgtaaatataaatttgtctcaaaagatcaacatgatacatccatgaartcactaagttgattggtataatgggtgtccaaattatgacagtcagacgtttaattcatcctagttgagctaaactgaaaggccgatgttgctggcctct

SEQ ID NO: 65754 - DNA, 201 bp, Homo sapiens
gaagggcctcgtgtgggcatcctgctagcttgtccaagctcgctattcctggaaggctgctcctcagccagttcacggctataggtgtgccagtgtgggargacctgggtggaaagaggcctgtgtgtgtcttagaagtgggcaccagaccctttggctgggaactctggggttctggatacccagaaggtggtccagaag

SEQ ID NO: 65755 - DNA, 201 bp, Homo sapiens
ggcctcgtgtgggcatcctgctagcttgtccaagctcgctattcctggaaggctgctcctcagccagttcacggctataggtgtgccagtgtgggaagacytgggtggaaagaggcctgtgtgtgtcttagaagtgggcaccagaccctttggctgggaactctggggttctggatacccagaaggtggtccagaagaggg

SEQ ID NO: 65756 - DNA, 201 bp, Homo sapiens
cagatgcacaattttataaagtatatgatcgcacatcaatgtatgtaggaatcatgctggttctcagggcattgcctgtcagctccagattcatcaggacytgctcagcagcggggtcggggagctgggcctgggaacagccctggcttggttcaggccgctccagggcagcatggccagtccagggcacagaagcatctg

SEQ ID NO: 65757 - DNA, 201 bp, Homo sapiens
accctttggctgggaactctggggttctggatacccagaaggtggtccagaagagggtatatggggtgtggttgggcttgccttggccccagggtctcctmatttcgtgggggaaactccagccatggttctggtattggccacagcctcctcttgctgtttatctaaagcctggatgaccaggtgggggcttcctgccag

SEQ ID NO: 65758 - DNA, 201 bp, Homo sapiens
ccccataggaagaagtgtggtgctcccagagcacagtgcagtgggggtgcagggccttccttgttctggggtctgatggggtttcaccctggaatagtgtyagcagaaatcatgttttcaaggagaatgcatatcatccacccctagaaaattaagattacgaatgtgtgtgcctggggagggtggcgcccaaggtcccag

SEQ ID NO: 65759 - DNA, 201 bp, Homo sapiens
attcgtgctgaaggtggagcccttggctggaggggctgtcgctgaccagccagactccatgtcactggagtgggccagctgagcctctgctctgctgtggrgagaagcggcgtccttgggtgtgtggctgagtttgcatctctgcagtctggggagcctgtgagtcgggggccggcctgggcagggcctcctctcggggga

SEQ ID NO: 65760 - DNA, 201 bp, Homo sapiens
gacaagactgcatggaacacgtgctcacatgcgcgcacacacacacgctcatgtacacatgtgcacacgcacacacacgcacggacacacacgcacacccmcacacacacacacctgcaggtaaatgccttgaaatctggacgaggctgatggatggtatcaagtcagtttcctggctgtgacactctcctgtaagatgtc

SEQ ID NO: 65761 - DNA, 201 bp, Homo sapiens
ggacacctactctagatgagccgtggctgggagtggaaaacgaccgagaagagctgcagacctgcttgattaaggagcagctgtcccagttgagccttgcrggagccctggatgtcccccacgccgaactcgttccgacagagtgccaggctgtcaccgctcctgtgtcgtcctgcgatctgggaggcagagacctgtgcg

SEQ ID NO: 65762 - DNA, 201 bp, Homo sapiens
aagtcatatttatcttgctaggttgttgtgaggatttgggttaagccatgtaaaatgctggtacagcattggcatctctaggtacccaatagatggtagcrtggatgaggatgtttacggtgacaggaaataaatggtagcatggatgaggatgtttacggtgacaggaaataaatggtagcgtggatgaggatgtttacg

SEQ ID NO: 65763 - DNA, 201 bp, Homo sapiens
cacatgaatgtatacatgtgacaagactgcatggaacacgtgctcacatgcgcgcacacacacacgctcatgtacacatgtgcacacgcacacacacgcayggacacacacgcacacccacacacacacacacctgcaggtaaatgccttgaaatctggacgaggctgatggatggtatcaagtcagtttcctggctgtga

SEQ ID NO: 65764 - DNA, 201 bp, Homo sapiens
tccaggtcacctccacgcccgtgatcgtgatgcgcggggctgctggcctgcagcgggagatccaggagggtgcctactccgggagctgctaccatcgagayggcttacggctgagtatgtcccgggccccataggaagaagtgtggtgctcccagagcacagtgcagtgggggtgcagggccttccttgttctggggtctg

SEQ ID NO: 65765 - DNA, 201 bp, Homo sapiens
ctggcattagagacagccctcatatgtgaactgggatgttattaatgagctgtggtgtgggccaggctcctgaagaacaagaaggcccacaatttaggtaygtctctggtagaaggagacagatgatgaagctcttatcaaattcatgtgtatatgtctcttgcccttccgatggagaagtcatgttggggtcttgctttt

SEQ ID NO: 65766 - DNA, 201 bp, Homo sapiens
tacatgtattttagagaggtgtggttggaatgcatctctaggtgagttcatggttagagagtcggatgatcacagcactgcttggaccctcctggccctcygctgcagtgctctgctgcaccgcccatatctgctccatgtggttctctaggagggaagctgatgctgcccccacaggagaggcacacggggtccctcaca

SEQ ID NO: 65767 - DNA, 201 bp, Homo sapiens
ttgcctcggcctcccaaagtgctgggattacaggtgtgatgtgttctcaattttaatgttaaacttattaatcttattttatagctagagttttttgtgcsttgtttaagaaaactttccctaccccaaagtcttacagatagcctcttttctcctaaaaacttagtgattttattttatattttatttggtttgacaggt

SEQ ID NO: 65768 - DNA, 201 bp, Homo sapiens
ttttagagaggtgtggttggaatgcatctctaggtgagttcatggttagagagtcggatgatcacagcactgcttggaccctcctggccctctgctgcagygctctgctgcaccgcccatatctgctccatgtggttctctaggagggaagctgatgctgcccccacaggagaggcacacggggtccctcacagacctgct

SEQ ID NO: 65769 - DNA, 201 bp, Homo sapiens
cacattggtcaggatggtcttgatctcttgacctcgtgatctgcttgcctcggcctcccaaagtgctgggattacaggtgtgatgtgttctcaattttaaygttaaacttattaatcttattttatagctagagttttttgtgccttgtttaagaaaactttccctaccccaaagtcttacagatagcctcttttctccta

SEQ ID NO: 65770 - DNA, 201 bp, Homo sapiens
aggcctcattggtgtagaggaggcccttggagggtgggcacatgatgcccaactagccagccaaggccaacgtcccaggggtagggcggaagtggggtggygtgcacagggcacgcagcccaggcctctgctgtccccacctccctccccaccctccgaaagaaaagacagtttgggcctcagccatggacggacgccgtt

SEQ ID NO: 65771 - DNA, 201 bp, Homo sapiens
cgtgggacttaggggaggtaaatgcaggggatgtgtctgccgcatggaccaatggtggccctggtgtaatgggatgcttgaggactgggtggccctggtgkaatgggatgcttgaggactgggtggccctggtgtaatgggatgcttgaggattgggtgtccctggtgtaatgggatgctggaggactgggtgtctctggt

SEQ ID NO: 65772 - DNA, 201 bp, Homo sapiens
taaatgcaggggatgtgtctgccgcatggaccaatggtggccctggtgtaatgggatgcttgaggactgggtggccctggtggaatgggatgcttgaggaytgggtggccctggtgtaatgggatgcttgaggattgggtgtccctggtgtaatgggatgctggaggactgggtgtctctggtgtaatgggatgcttgagg

SEQ ID NO: 65773 - DNA, 201 bp, Homo sapiens
aggggatgtgtctgccgcatggaccaatggtggccctggtgtaatgggatgcttgaggactgggtggccctggtggaatgggatgcttgaggactgggtgkccctggtgtaatgggatgcttgaggattgggtgtccctggtgtaatgggatgctggaggactgggtgtctctggtgtaatgggatgcttgaggactgggt

SEQ ID NO: 65774 - DNA, 201 bp, Homo sapiens
tggtggccctggtgtaatgggatgcttgaggactgggtggccctggtggaatgggatgcttgaggactgggtggccctggtgtaatgggatgcttgaggaytgggtgtccctggtgtaatgggatgctggaggactgggtgtctctggtgtaatgggatgcttgaggactgggtggccctggcgtaatgggatgcttgagg

SEQ ID NO: 65775 - DNA, 201 bp, Homo sapiens
aattttaaatagttgatcttttaaagctattctggatattaattttctgttggttatgtatgtggcaaatatcttctcccaaattgtggcttgttctttcrttttctttatggtattctttgtgaagctgtgttctcatttttttttttcttttttttgggggggacggagtctcgctgtgtcgccaggctggagtgcagt

SEQ ID NO: 65776 - DNA, 201 bp, Homo sapiens
agccactgtgcgtggcctcccagggtccttcctaatgcaggctgctttctctcatgtaaccaagagacatactttcatcccctaccacgtgccaggctgcrctgcgtgcagatgcccctgcgctcacggggactggagggagccaggtgacatggagcccaggaagtggccagagctcgggaggaaggcaaagaggggaag

SEQ ID NO: 65777 - DNA, 201 bp, Homo sapiens
cctggtgtaatgggatgcttgaggactgggtggccctggtggaatgggatgcttgaggactgggtggccctggtgtaatgggatgcttgaggattgggtgkccctggtgtaatgggatgctggaggactgggtgtctctggtgtaatgggatgcttgaggactgggtggccctggcgtaatgggatgcttgaggaccgatg

SEQ ID NO: 65778 - DNA, 201 bp, Homo sapiens
agattatattaatgtattaagagttcctgttgatccaaatcctttttgacattgggtattactagattcttcatttctgctgacttagtaggtataacatyatcatgattaggatttcctctcctgtaaaacgcttgttcctatttcttgacattttttattgggccatgtgtcttttaaaaatgtttaaattttaaatag

SEQ ID NO: 65779 - DNA, 201 bp, Homo sapiens
tgctggaggactgggtgtctctggtgtaatgggatgcttgaggactgggtggccctggcgtaatgggatgcttgaggaccgatggtggcccctggtgtaaygggatgcttgaggaccaggtggccccggcgtaatgggatgcttgaggactgatggtggcccctggtgtaacgggatgcttgaggaccgagtggcccctgg

SEQ ID NO: 65780 - DNA, 201 bp, Homo sapiens
attgagaaccatattgtcccgaacattctggtgtcttcttatctgtttgcaaaaatttctctgaaatataaatctaagtgaaaagtgctgtatccatataracaaatgtttcacttgaattgttttctaaagagattatattaatgtattaagagttcctgttgatccaaatcctttttgacattgggtattactagattc

SEQ ID NO: 65781 - DNA, 201 bp, Homo sapiens
cactgggcgatggatataggagttaataattttattttctcagcttttatttgtttggagtttcatataataaaaagccaagaaaaatattgaagagtccyccaaaatggcactcttcaaataagtgaagaggattctttttagttaggtttatttattttgatgacaggaataatatctatttcaataaaataccgcggg

SEQ ID NO: 65782 - DNA, 201 bp, Homo sapiens
gcttctgtccaagcacagctgggccctgcactagaggttcctgggccgccacctgcccagtcagaggctctgcgggggggtggtgagcacccaggaatctsagatgtgctccacttcatcccaatctggacctaccatctgtgttctttgtgtccccagaactcatgagccttgtgtctgggctgctgcagccagtccctg

SEQ ID NO: 65783 - DNA, 201 bp, Homo sapiens
tggcctgtgtgctggtcgggaagggccatggtgcttcccatgggcgggcttggcaagcctgcgctgagtgccgtggcgtcctgatgcctcctcctcctcayagctacagagggccggagctggagatgtggtctctgggagtcactctgtacacgctggtctttgaggagaaccccttctgtgagctggaggagaccgtgg

SEQ ID NO: 65784 - DNA, 201 bp, Homo sapiens
ttccactaacacctacatgtattttagagaggtgtggttggaatgcatctctaggtgagttcatggttagagagtcggatgatcacagcactgcttggacyctcctggccctctgctgcagtgctctgctgcaccgcccatatctgctccatgtggttctctaggagggaagctgatgctgcccccacaggagaggcacac

SEQ ID NO: 65785 - DNA, 201 bp, Homo sapiens
tttgctttttttccccctttccatttcatgttagttacttttacaaagaaacttctgtaacatttacaatatattctgaatagttatattacttttttatyattttattttttgagacagggtcttgctctgtggcccaggctggagtgcagtggtgctgtgtcctctcactgcagcctccgcctcctgggctgaagcgat

SEQ ID NO: 65786 - DNA, 201 bp, Homo sapiens
cctcaccaagccttgctcttctgtgcaaaatgaaagtcatatttatcttgctaggttgttgtgaggatttgggttaagccatgtaaaatgctggtacagcrttggcatctctaggtacccaatagatggtagcatggatgaggatgtttacggtgacaggaaataaatggtagcatggatgaggatgtttacggtgacagg

SEQ ID NO: 65787 - DNA, 201 bp, Homo sapiens
catcctgaaactggttctcctttttgttgtacagctgtgctgacagcaatgggagctgtttgcttcttagcttatgttctggtgggagggggacagttgcytctagaagttcgccgagatgctccctgcaaagttgtccttgcttctgtttggtctgaggtggggtcacttgtgtcttctggaatcaaaactagcaatggg

SEQ ID NO: 65788 - DNA, 201 bp, Homo sapiens
tggcccaggaggatccgccgcccgactcttagaccagcccgaccccgggtctcccgcccctgcgcccgtcgcccttcgcgcaccgccgagcccgcgtcctytccgtgcccaaatcgcggcggggttgcggccgttggccctgggccccgcgcccccagcgtcttcggggtgcccttcagtgtagcctgcccggtgggcgcc

SEQ ID NO: 65789 - DNA, 201 bp, Homo sapiens
atgtaaaatgctggtacagcattggcatctctaggtacccaatagatggtagcatggatgaggatgtttacggtgacaggaaataaatggtagcatggatraggatgtttacggtgacaggaaataaatggtagcgtggatgaggatgtttacggcgacaggaaataaatggtagcgtggatgaggatgtttacggtgaca

SEQ ID NO: 65790 - DNA, 201 bp, Homo sapiens
ggatgaggatgtttacggtgacaggaaataaatggtagcatggatgaggatgtttacggtgacaggaaataaatggtagcgtggatgaggatgtttacggygacaggaaataaatggtagcgtggatgaggatgtttacggtgacaggaaataaatggtagcgtggatgaggatgtttacggtgacaggaaataaatggta

SEQ ID NO: 65791 - DNA, 201 bp, Homo sapiens
agtttattaagaaggagaaggtcttggaggattgttggattgaggatcccaaacttgggaaagttactttagagatcgcaattctatccagggtggagcaygccaatatcatcaaggtgatggtttcctcttcagagataccctaacttggctcatgtcaaatgtcttcaatttgttgacttgaagatgttttggtagagt

SEQ ID NO: 65792 - DNA, 201 bp, Homo sapiens
ttctctttctacttttgtatatgtgcatgttttgtttcctctgacttggtatatgctcatctgagtgacggatatgtgaaatttgtagaactggttagtcmaatggccagactatttcattaatttatttcctcaaatgcttttcaaattaaagcacctttgttagtaaacagttatcctgacttggatgttgtgaactgt

SEQ ID NO: 65793 - DNA, 201 bp, Homo sapiens
atcgcaattctatccagggtggagcacgccaatatcatcaaggtgatggtttcctcttcagagataccctaacttggctcatgtcaaatgtcttcaatttkttgacttgaagatgttttggtagagttggacttggctttgtctcttcctaggtattggatatatttgaaaaccaagggttcttccagcttgtgatggaga

SEQ ID NO: 65794 - DNA, 201 bp, Homo sapiens
gcacggctgacggggggtttgggggccctgagatgaagcgagagcgctgaccaaagcattggcaagtgctcctgtactttactgttgggcttttggtagcrttctctgcaaaatcatttctaaatgtggacttaatttggagaaatttgagactaagtgctttattttttaacttggtcacaaaatttggtctttttcttg

SEQ ID NO: 65795 - DNA, 201 bp, Homo sapiens
cctagaggtgctgcatgggccagaaccagtcctatggtatctttggtttgtgggcttccctcccgacttgaatcctccctctgtccagcctctggggtggrcctcagggctgggaacgggctgctcgatggcgcaaggcccagcctgacagcccttggaggctgggggtgctgcccttgccagccacgggcagcttactca

SEQ ID NO: 65796 - DNA, 201 bp, Homo sapiens
ggtcttgcttttggcttgaacatattgaagcttagttaaatttacagctggagcacaagaagcttttatgataagcacggggcttttcctccagggcaccrtcacgtcatgtgacagtctctttgctcatcttcacgggtacgtgtctggggaggacgtggctgggcagcatatcacagacctgatcccttctgtgcagct

SEQ ID NO: 65797 - DNA, 201 bp, Homo sapiens
cagtcctggaatgactgagaaagtatgtttaatggttaaggtttatttacatacataaaatatccacaacaatcataaaaattaaccagtaagggttaggrtgcagccagagagcgtctcaaaggcatgtgtgcggcacagcggcctgcaggttgtaagtgcccactaaatggtggctgttgaggtaattaaccagcaaaa

SEQ ID NO: 65798 - DNA, 201 bp, Homo sapiens
ttgccagtggcgtggctgagccccgagcctgagccccacagtcctccctccctccctccctgctggtgcccggcccctcactggggtgtctcacttgcccyggggttgctgtgcctggggcggctctggacactgagtcctccccacccacagaagggctctttcctgggccagctgggcctgggaggagagggaaggcag

SEQ ID NO: 65799 - DNA, 201 bp, Homo sapiens
agagcagctcctggcctgggaggaaggccccacagtccttctgtcctgggtgcatgtcactgttccggccaccagtgagccgcgtgaggtgaggcttgcaracacaggctcccagatccatctaaacatggggccaaaggccagatgtctgctccaaagatgtgtcgatgtcactgtaacttgccgcagagtatgttttta

SEQ ID NO: 65800 - DNA, 201 bp, Homo sapiens
gatgttttggtagagttggacttggctttgtctcttcctaggtattggatatatttgaaaaccaagggttcttccagcttgtgatggagaagcacggctcyggcctagacctcttcgctttcatcgaccgccaccccaggctggatgagcccctggcgagctacatcttccgacaagtgagagcaggccagagccgtgtta

SEQ ID NO: 65801 - DNA, 201 bp, Homo sapiens
gcgtgcgccaccgtgcctggcccggaaagagcttcttttagcaccactttgggtggaccattctcccattgcgggttctgacccaggatggcggttggtgrtgtatgtcttttggggccgagctgaactcagcattataaattagttggttaaactgtctttgtgtttttgcattgcagatgttaatcagcttcatgttgt

SEQ ID NO: 65802 - DNA, 201 bp, Homo sapiens
gtttactaaaagtccagacagatggtaggtgaatgaggaacaagtcagagagaaatgttcagcctattattcatagtaacattgaaaactcacatgtgttsagcacctgctctcttccacacacactgactgctgggttttctgtgctgcctggctgagtccttatcagcctgtatgggagggcaccatggtgttactgtc

SEQ ID NO: 65803 - DNA, 201 bp, Homo sapiens
taggggtttatgtttgtgtgtgttttctttattcttgcttgatacttggtaagactttgatctgaatatttaaagcttccgttctttggttccgttaattstttccttctccctcctcctgacactcattttaggtgtgcatgggcccccctggaggagcctgccctcttgtctccttggccctgcagctggacaggccgc

SEQ ID NO: 65804 - DNA, 201 bp, Homo sapiens
tttctttattcttgcttgatacttggtaagactttgatctgaatatttaaagcttccgttctttggttccgttaattctttccttctccctcctcctgacrctcattttaggtgtgcatgggcccccctggaggagcctgccctcttgtctccttggccctgcagctggacaggccgcaggcctcttcacctagagtgtca

SEQ ID NO: 65805 - DNA, 201 bp, Homo sapiens
ggcgctgggttggacctgggacgcctggggtggtgagaggtggtcgatgctggtcatgctgtgaagcagtctcagtgagttccaggcgaatgagcagattygttttagggagtgcctgtgaagagcaaacgctcttttttggtgttgctgccagatccaaggattaatgtcgtgcttgctggtggccacgttgtgccccga

SEQ ID NO: 65806 - DNA, 201 bp, Homo sapiens
ccgtgggtaacacagcctgtgaatcttgctgactatacatgggaagaggtgtttcgagtaaacaagccaggtgaggcttctcagcatccctccaccccacrtgacttcacttggaataacgaggtccccaggctgccttcctaggtcaaaaggaggaaaaggaggctctctcccccatgctgtcttggacacaaatgtcag

SEQ ID NO: 65807 - DNA, 201 bp, Homo sapiens; identical to SEQ ID NO: 42822

SEQ ID NO: 65808 - DNA, 201 bp, Homo sapiens
cacccttcaggtatacagtttgaggtgaggcgggtggagctccagggccccacacctctgttctgctgctggctggtgaaagacctcctccacagccaacrcgactcagccgccaggacccgcctgttccttgccagcctgcccggctccacccactctaccgctgctgagctcaccggacccagcctggtggaagtgggt

SEQ ID NO: 65809 - DNA, 201 bp, Homo sapiens; identical to SEQ ID NO: 42825

SEQ ID NO: 65810 - DNA, 201 bp, Homo sapiens
gtatacagtttgaggtgaggcgggtggagctccagggccccacacctctgttctgctgctggctggtgaaagacctcctccacagccaacgcgactcagcygccaggacccgcctgttccttgccagcctgcccggctccacccactctaccgctgctgagctcaccggacccagcctggtggaagtgggtatttgcaatc

SEQ ID NO: 65811 - DNA, 201 bp, Homo sapiens
gtgtgctgaggctgcttggggtgccctgtggagataggctttcagacctgtctgagagcatgggaggagaggggactggagtgcagggcacacctgcctckggcggctgctgaagacgcagggggaccactgtgggtgctgcacctctgcccggtgcagttgcatgtgaccccacagaccttcttctgcattgcaggtgct

SEQ ID NO: 65812 - DNA, 201 bp, Homo sapiens
aggggttggcggcctgtgagggcgagtactcccaaaagtacagtaccatgagcccgctgggcagtggggccttcggcttcgtgtggactgctgtggacaargaaaaaaacaaggaggtaacctggctgtggggggggagtggcgccgggcaccacttcacatggctctcgacttttggtcccagttctcaaacctggggtt

SEQ ID NO: 65813 - DNA, 201 bp, Homo sapiens
caaaagtacagtaccatgagcccgctgggcagtggggccttcggcttcgtgtggactgctgtggacaaggaaaaaaacaaggaggtaacctggctgtgggsggggagtggcgccgggcaccacttcacatggctctcgacttttggtcccagttctcaaacctggggtttttggaggagtcctctaggtatggcaccaagc

SEQ ID NO: 65814 - DNA, 201 bp, Homo sapiens
atccacggcatcaaccacagcttcgcgctgacactgtttggttacggaaagacggagctcctgggcaaggtggggctgccctgggcgcctggctcccgttycctgggaggaagctgctgtgctctgcagtgcgggcttgcgtgtggcacaggcctcgcacccggcaagctctccagctcgctcctttacccaggaaggacc

SEQ ID NO: 65815 - DNA, 201 bp, Homo sapiens
gccgccaggacccgcctgttccttgccagcctgcccggctccacccactctaccgctgctgagctcaccggacccagcctggtggaagtgggtatttgcartcaatgcctgccctggacttgccttgtactgtgtggcaaatatcctagttggcatctctctctgtttccttggggacgggaatacagtctgtttgtagct

SEQ ID NO: 65816 - DNA, 201 bp, Homo sapiens
tgctttattttttaacttggtcacaaaatttggtctttttcttgttataaattggtggcattaaatgctttgtacttagttctaatggagaatcggtgcamtctctccttttgactcatctgtggccctacatgatggtcacccatgtcattatccccagggtggacaatgtcccagaaggaagcctgccagtgcacggtg

SEQ ID NO: 65817 - DNA, 201 bp, Homo sapiens
tccgaagtttagtttctcaggctcctacttgtaagtttcagatattatggttctgcaaaaaagggtcacctctctccctcttcctgtgttggaaggtgacrtcctccctttagtttgtggccaacacttgtttctgaaactttttacagcaaacagagtatctgtatgaggttatgttgagggtcgcttgttaaaagctgc

SEQ ID NO: 65818 - DNA, 201 bp, Homo sapiens
gttctgcaaaaaagggtcacctctctccctcttcctgtgttggaaggtgacgtcctccctttagtttgtggccaacacttgtttctgaaactttttacagyaaacagagtatctgtatgaggttatgttgagggtcgcttgttaaaagctgctgcctgacagctgttaattctggggctagtgagacacataattatggtg

SEQ ID NO: 65819 - DNA, 201 bp, Homo sapiens
tatgtggcaaatatcttctcccaaattgtggcttgttctttcgttttctttatggtattctttgtgaagctgtgttctcatttttttttttcttttttttkggggggacggagtctcgctgtgtcgccaggctggagtgcagtggcgtgatctcagctcattgcaacctccacctgccaggttgtgtcgccaggctggagg

SEQ ID NO: 65820 - DNA, 201 bp, Homo sapiens
aatatgcaggatggaactcttaagtatctccactctgcagggtggtcacatgaatgtatacatgtgacaagactgcatggaacacgtgctcacatgcgcgcacacacacacgctcatgtacacatgtgcacacgcacacacacgcacggacacacacgcacacccacacacacacacacctgcaggtaaatgccttgaaat

SEQ ID NO: 65821 - DNA, 201 bp, Homo sapiens
ctgagaaagtatgtttaatggttaaggtttatttacatacataaaatatccacaacaatcataaaaattaaccagtaagggttaggatgcagccagagagygtctcaaaggcatgtgtgcggcacagcggcctgcaggttgtaagtgcccactaaatggtggctgttgaggtaattaaccagcaaaactgagatcctgaca

SEQ ID NO: 65822 - DNA, 201 bp, Homo sapiens
ccaccccaggctggatgagcccctggcgagctacatcttccgacaagtgagagcaggccagagccgtgttagtgtgaacgcaggcctgggtgcctgggtcyggtggctgcaaagatcagtgatccatactcggttctctctctgagctggatctagccttctgtgtggggatttcatggagtaggatatatattttgagaa

SEQ ID NO: 65823 - DNA, 201 bp, Homo sapiens
cagattctgatgtggtggaggccctcagcgaggagcacatggaggccgacggccacgctgcggtggtgtttggcacggtggtgagtggatgcgggtgcagygttcagtctggcctcaagaccagcagtgtgtggcaggaacagctcagtgttccctaccaggagctctgctgggggttgggtggcaccaggacatctcagc

SEQ ID NO: 65824 - DNA, 201 bp, Homo sapiens
tgtacaccacacagcttggtgtacacgctggcctgttccttggccaggctgtctgccctgcgccgtgggcccctgccagcccctgggctttgcactggggrctcctgaagactgggaagcagaaacattttaaatggatgacgtttagttggtctcttttaccgtttgtcacttgtgttttggtgttatatctaggaagac

SEQ ID NO: 65825 - DNA, 201 bp, Homo sapiens
tattgtttctggatatttctgtgctttgttattttcccctctatttttcctactttctgttgactatattttattatgtcatgtttttgtttcttgttagyttttaatatttcatcatgatttttggcatcggtattgagatatagttcacataccatataattcacccatttagagtgaacagttcagtagattttagta

SEQ ID NO: 65826 - DNA, 201 bp, Homo sapiens
tgaggtgtttataccgttgatgtttaatgaaattactgatatggctggatttaaatctataatctaaatctagatgttttctattgtttctggatatttcygtgctttgttattttcccctctatttttcctactttctgttgactatattttattatgtcatgtttttgtttcttgttagtttttaatatttcatcatga

SEQ ID NO: 65827 - DNA, 201 bp, Homo sapiens
ccatgagcccgctgggcagtggggccttcggcttcgtgtggactgctgtggacaaggaaaaaaacaaggaggtaacctggctgtggggggggagtggcgcygggcaccacttcacatggctctcgacttttggtcccagttctcaaacctggggtttttggaggagtcctctaggtatggcaccaagcacacaacctggca

SEQ ID NO: 65828 - DNA, 201 bp, Homo sapiens
cccctagaaaattaagattacgaatgtgtgtgcctggggagggtggcgcccaaggtcccaggccacctgccccatgcccgtcagttccagctgtgcccccygactcaggccatacacttagagagccgctcctcccagcagcctggggagatcccgtcgggagcaggagaagcgtgggggtgtcacgctagagtctgtctc

SEQ ID NO: 65829 - DNA, 201 bp, Homo sapiens
gtcacccatgtcattatccccagggtggacaatgtcccagaaggaagcctgccagtgcacggtgaacaggcgctgcccaaggaccagcaaatcactgcctyggggagagaggaacctgtggcaatagagagccccggacaggatcttctgggagaaagcaggtctgaaccagtggatgtgaagccatttgcttcctgcgaa

SEQ ID NO: 65830 - DNA, 201 bp, Homo sapiens
ggcctgaggccagggcatttgctcgcagtcacgcacgagctccatgccgtgccttgggctctcgggagggcctcagcattggggagaggagtggctgggcyctggatcctggtgtctgcttaggccatatttcattaggaggtgcaggttccaggctgcacaccctgagtcctcagagcccagcagcctcagcctgcgcca

SEQ ID NO: 65831 - DNA, 201 bp, Homo sapiens
ggggaggacgtggctgggcagcatatcacagacctgatcccttctgtgcagctccctccttctggccagcacatcccaaaggtagggctcctgacctcccrcactgtgtgatggggtggagttcttagctctgaatccataactggagacgcagaccaagggtttctgaaggcaagggtggccttaggggtgggacatgct

SEQ ID NO: 65832 - DNA, 201 bp, Homo sapiens
tggagtgggccagctgagcctctgctctgctgtggggagaagcggcgtccttgggtgtgtggctgagtttgcatctctgcagtctggggagcctgtgagtygggggccggcctgggcagggcctcctctcgggggactttagagaggaaagcaaaacggaaaggaagattgtggttcatttgtagggcctgagtggagact

SEQ ID NO: 65833 - DNA, 201 bp, Homo sapiens
agctgatgctgcccccacaggagaggcacacggggtccctcacagacctgctgcacctgacctggtggcctgaggccagggcatttgctcgcagtcacgcrcgagctccatgccgtgccttgggctctcgggagggcctcagcattggggagaggagtggctgggctctggatcctggtgtctgcttaggccatatttcat

SEQ ID NO: 65834 - DNA, 201 bp, Homo sapiens
ctgcttggaccctcctggccctctgctgcagtgctctgctgcaccgcccatatctgctccatgtggttctctaggagggaagctgatgctgcccccacagragaggcacacggggtccctcacagacctgctgcacctgacctggtggcctgaggccagggcatttgctcgcagtcacgcacgagctccatgccgtgcctt

SEQ ID NO: 65835 - DNA, 201 bp, Homo sapiens
gacggagtttcacagtgttagtcaggatggtctcgatctcctcgatctcctgacctcgtgatccgccctcctcagcctcccaaagtgctgggatgacaggygtgcgccaccgtgcctggcccggaaagagcttcttttagcaccactttgggtggaccattctcccattgcgggttctgacccaggatggcggttggtggt

SEQ ID NO: 65836 - DNA, 201 bp, Homo sapiens; identical to SEQ ID NO: 42833

SEQ ID NO: 65837 - DNA, 201 bp, Homo sapiens
atatgcaggatggaactcttaagtatctccactctgcagggtggtcacatgaatgtatacatgtgacaagactgcatggaacacgtgctcacatgcgcgcacacacacacgctcatgtacacatgtgcacacgcacacacacgcacggacacacacgcacacccacacacacacacacctgcaggtaaatgccttgaaatc

SEQ ID NO: 65838 - DNA, 201 bp, Homo sapiens
tatgcaggatggaactcttaagtatctccactctgcagggtggtcacatgaatgtatacatgtgacaagactgcatggaacacgtgctcacatgcgcgcacacacacacgctcatgtacacatgtgcacacgcacacacacgcacggacacacacgcacacccacacacacacacacctgcaggtaaatgccttgaaatct

SEQ ID NO: 65839 - DNA, 201 bp, Homo sapiens
atgcaggatggaactcttaagtatctccactctgcagggtggtcacatgaatgtatacatgtgacaagactgcatggaacacgtgctcacatgcgcgcacacacacacgctcatgtacacatgtgcacacgcacacacacgcacggacacacacgcacacccacacacacacacacctgcaggtaaatgccttgaaatctg

SEQ ID NO: 65840 - DNA, 201 bp, Homo sapiens
gaagggctttgtttcctgtttgcttccaatcatatcttcagcattgaaaaatctttcctgtccccagttcattatgagtcggaggtttattttttctttgkgtttttttttgttccagtttattttaaatgcatattttagttgaattgcttttttaaaaagccccctctggcctcctgattccagctagtgtcagcagtg

SEQ ID NO: 65841 - DNA, 201 bp, Homo sapiens
agctgctgagccccagacagccccatgcctctgagacagggctgggaggagcaggagctactgtccctccagaggctcaggggtggtggggggcggagtagggggtgactgttttctggtttgatgttcctctctgtctcgggggctgtgacatattcttataaacatatgagcatagagaagagaatagaaaacccccca

SEQ ID NO: 65842 - DNA, 201 bp, Homo sapiens
aaaaatgcctcttggagaagttatgccgaaccacccaactgtcctggtcacagagcaggcttctctcggcttggggctagggttctttctggggtcgtccttttttttttttttttttgagacagagtttcgctcttgttgctgaggctggagtgcagtggcaccatctcgtctcactgcaacctctgcctcctgggttca

SEQ ID NO: 65843 - DNA, 201 bp, Homo sapiens
aaaatgcctcttggagaagttatgccgaaccacccaactgtcctggtcacagagcaggcttctctcggcttggggctagggttctttctggggtcgtccttttttttttttttttttgagacagagtttcgctcttgttgctgaggctggagtgcagtggcaccatctcgtctcactgcaacctctgcctcctgggttcag

SEQ ID NO: 65844 - DNA, 201 bp, Homo sapiens
tcagctccagattcatcaggacctgctcagcagcggggtcggggagctgggcctgggaacagccctggcttggttcaggccgctccagggcagcatggccrgtccagggcacagaagcatctgcaggaagagcagctttcttcaagtcgctctttagccctttgtggttaatctctcagtactagttaataaatcttaatg

SEQ ID NO: 65845 - DNA, 201 bp, Homo sapiens
agaactgatggaatcataattttatcattttccttttttttttttttttttttttttttagacagagtctcgctgtgtcacccaggctggagtgcagtggygcgatctcagctcattgctcattgcattgcaagctccgcctcctgggttcacaccattctcctgcctcagcctcccgagtagctggggactacaggcgcc

SEQ ID NO: 65846 - DNA, 201 bp, Homo sapiens
tatatatgtaagtatgtatgcatgcatgcttgtatatgtgtatttatgtgtgtacctatgtacaagtatatgttatgtgtataggtatgcacacgtgtgtrtgcaggtgtgtatatatgtgcacatgtatgtatctaaatgtatgtataaatatgcaggtatgtatatataaatatgcaggtatgtatatataaatatgca

SEQ ID NO: 65847 - DNA, 201 bp, Homo sapiens
gttcacaccattctcctgcctcagcctcccgagtagctggggactacaggcgcccgccaccacgcccggttacttttttgtattttttttagtttcaccaygttggccaggatggtctcgatttcctgactttgttatccacccgccttggcctcccaaagtgctgggattaattttatcattttcaaagtcatatgaagc

SEQ ID NO: 65848 - DNA, 201 bp, Homo sapiens
ctcagcccacagacacctgagcagaaggaatgggctttccagactctgccagagcaggacagcgctctctggtaatgaccttcgaccactgcaggccttakcgcgtggaaatacaaatgtggagttgctctgtgttctcatggaaaccctctcaccagggattgaagtcactctattcctgcagagaaaagttcgtggttt

SEQ ID NO: 65849 - DNA, 201 bp, Homo sapiens
gcccacagacacctgagcagaaggaatgggctttccagactctgccagagcaggacagcgctctctggtaatgaccttcgaccactgcaggccttagcgcrtggaaatacaaatgtggagttgctctgtgttctcatggaaaccctctcaccagggattgaagtcactctattcctgcagagaaaagttcgtggtttaagt

SEQ ID NO: 65850 - DNA, 201 bp, Homo sapiens
ggaactcaccttcacatttcagggtcaagttacaacaaaatgttatttcttactttagagtatgtgagaacgctgttctaggttaggctattttacttagrgaattgcagctttgctcgtgcagtttactgagctaaacgcggtttagctggtggaccaagaatcatggggcagaagtctgttggtgcctcctatgtccag

SEQ ID NO: 65851 - DNA, 201 bp, Homo sapiens
ggtacaatctcagctcactgcaacctctgcctcccaggctcaaaccattctcctgcctcagcctccaagtagctgggattataggtgcctgccacctcacygggctaatttttgtatttttagtagagacaggactttgccatgttggccagtctggtctcgaacctcctgacctcaagtgatctgcccacctcggcctcc

SEQ ID NO: 65852 - DNA, 201 bp, Homo sapiens
caggtgtgggccactgtgcccgatcctgtcctctttctgagcctctggtatacctttattaggttgctgatgttaacctgtgtgtctgtccccgagtgagktggtgcggtcacattctgtgcatctggtgcccagtgtcagtctgtcatgtggaggccagtggctgggctgacaggaggcctgggtcccttggctctgtga

SEQ ID NO: 65853 - DNA, 201 bp, Homo sapiens
gtctccacgggggtcaggtcctggtgcttccccactggaggacctacggtccctggggctgccctgggttgaggtcccagcagctcaaggcctgtgtgcastcggcagatcacatccttcatgccctgactgcatgctggccagaactgagtggcgtggcgatgcctggctgccagggcagctggaggatgtcctcatgtt

SEQ ID NO: 65854 - DNA, 201 bp, Homo sapiens
ctctggcagctgtgtgaagtctaaagcttcgcttcgcttctcttttcagaagacagatggagctcctattgtctatcatcactggctgcccagaatatttrtacaagtaaactgcactgccctgctgcccctgagcacacggacccgtccgaaccgcggggcagtgtgtcctgctgctccctgctgcggggactgtcctca

SEQ ID NO: 65855 - DNA, 201 bp, Homo sapiens
tgtctcctttagttctcctggtaatcctgggagtgtagtctgatttttagcaaatggatgctgaagctgagtgaattgttacactgggcatcaggtcctcraagagaccccaggtgatgtgctcagacagcaggtgggggtctcgggtctccacgggggtcaggtcctggtgcttccccactggaggacctacggtccctg

SEQ ID NO: 65856 - DNA, 201 bp, Homo sapiens
tatttaaaaaatatgtaatagatacatataaagtatgtatgtatgtttaaaaatatgtaatgcatgggccaggcgcggtggatcacgcctataatcccagyactttgggaggctgaagtgggtggatcatgaggtcggcagatggagaccatcctggctaacacggtgcaaccccgtctctactaaaaatacaaaaaatta

SEQ ID NO: 65857 - DNA, 201 bp, Homo sapiens
cagaatcttttcttatgcacagcatgcagtaaaggtgcccaaactgtaggtgcccaggtggcccaggaccctttcttggctgcctgcagaccctgggtccyttcctgcactgtgccccctacaccctgctgccctgggtcagggcagaggttagactgcctgccgttgagcctgacgcatgcatttccttctgtctgcctt

SEQ ID NO: 65858 - DNA, 201 bp, Homo sapiens
cttgtttgcttagcctccctgattttccctttgccactgtgggtccgcgttgagtggcgtgagagggtagctgttggctctatttgctctacttccactgygagtggaacagagcaggcgctcaacacgtgagttttcaatattactatgaataatattgctgtgcgcacctctccagaggtgccaccaagctgaagtggg

SEQ ID NO: 65859 - DNA, 201 bp, Homo sapiens
tgttgctgccagatccaaggattaatgtcgtgcttgctggtggccacgttgtgccccgagatgagatccggaagctgatggaaagccaagacatcttcacygggactcagactgagctgattgctggaggccagctcctttcctgcctctcacctcagcctgctccagggtaagtcccttggtgggaggttgcaggtttac

SEQ ID NO: 65860 - DNA, 201 bp, Homo sapiens
acctggaggagtgaggccacagagttggggggccatggccgagacttcggcttctatccagagtcagatgggagctgttggagggttgtcagccgatgagkgccgtgctctgacttgggtgttaataggatcatggtagctggctgcaggtgtcctgggccaaggagcagggagacaggaggcagagaagagggcgctggg

SEQ ID NO: 65861 - DNA, 201 bp, Homo sapiens
gagagacctggaggagtgaggccacagagttggggggccatggccgagacttcggcttctatccagagtcagatgggagctgttggagggttgtcagccgrtgagggccgtgctctgacttgggtgttaataggatcatggtagctggctgcaggtgtcctgggccaaggagcagggagacaggaggcagagaagagggcg

SEQ ID NO: 65862 - DNA, 201 bp, Homo sapiens
tggagagacctggaggagtgaggccacagagttggggggccatggccgagacttcggcttctatccagagtcagatgggagctgttggagggttgtcagcmgatgagggccgtgctctgacttgggtgttaataggatcatggtagctggctgcaggtgtcctgggccaaggagcagggagacaggaggcagagaagaggg

SEQ ID NO: 65863 - DNA, 201 bp, Homo sapiens
cctgagtggagactgtctgctgacgtgcccgatcactgtctcatctgcctgtaaaccaaatgtgtctatgtgtatgaaatagactttattaagtcagaaayagatagcaggtgttttccactaacacctacatgtattttagagaggtgtggttggaatgcatctctaggtgagttcatggttagagagtcggatgatcac

SEQ ID NO: 65864 - DNA, 201 bp, Homo sapiens
caggagaggcacacggggtccctcacagacctgctgcacctgacctggtggcctgaggccagggcatttgctcgcagtcacgcacgagctccatgccgtgycttgggctctcgggagggcctcagcattggggagaggagtggctgggctctggatcctggtgtctgcttaggccatatttcattaggaggtgcaggttcc

SEQ ID NO: 65865 - DNA, 201 bp, Homo sapiens
tgccccgagatgagatccggaagctgatggaaagccaagacatcttcaccgggactcagactgagctgattgctggaggccagctcctttcctgcctctcmcctcagcctgctccagggtaagtcccttggtgggaggttgcaggtttactaaaagtccagacagatggtaggtgaatgaggaacaagtcagagagaaatg

SEQ ID NO: 65866 - DNA, 201 bp, Homo sapiens
tgtaatagatacatataaagtatgtatgtatgtttaaaaatatgtaatgcatgggccaggcgcggtggatcacgcctataatcccagcactttgggaggcygaagtgggtggatcatgaggtcggcagatggagaccatcctggctaacacggtgcaaccccgtctctactaaaaatacaaaaaattagccaggcatggtg

SEQ ID NO: 65867 - DNA, 201 bp, Homo sapiens
gagctctgattgcgccgctgcagtgagctctgattgcgccactgcactccagcctgggcaacagagtgagaccctgtctgtcaggaaaaggctggcttctrcatggtcgtcctgggctgttctgggcagctggtggagctgctggggatgtctgcatccttgctcctctttgtgattcctcagatcctggttgctaacgac

SEQ ID NO: 65868 - DNA, 201 bp, Homo sapiens
cctatgtacaagtatatgttatgtgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaa

SEQ ID NO: 65869 - DNA, 201 bp, Homo sapiens
tatatgttatgtgtataggtatgcacacgtgtgtatgcaggtgtgtatatatgtgcacatgtatgtatctaaatgtatgtataaatatgcaggtatgtatrtataaatatgcaggtatgtatatataaatatgcaggtatgtatatataaatatgcaggtatgtatatgtttgtatatatgtgtataaatatgcgtatatt

SEQ ID NO: 65870 - DNA, 201 bp, Homo sapiens
tgcatgtgcatatgtgtgctcacatgtaactgcttctgttccctgagcacggctgggattataccatacacagtgtcctaaatgtgtgtgtatgtgtacgyacacacatgtcctgcagatcttcctctacaggcctcctcggaaccgaagcctcctggatggcaccctagctcatgggccactttcccactggccgatgtg

SEQ ID NO: 65871 - DNA, 201 bp, Homo sapiens
cagctgcacagaccactgctgagcccagcaggtcgttttcctcagcccacagacacctgagcagaaggaatgggctttccagactctgccagagcaggacrgcgctctctggtaatgaccttcgaccactgcaggccttagcgcgtggaaatacaaatgtggagttgctctgtgttctcatggaaaccctctcaccaggga

SEQ ID NO: 65872 - DNA, 201 bp, Homo sapiens
tgttatgtgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttatt

SEQ ID NO: 65873 - DNA, 201 bp, Homo sapiens
cggtgctttctcttgtttgcttagcctccctgattttccctttgccactgtgggtccgcgttgagtggcgtgagagggtagctgttggctctatttgctcyacttccactgcgagtggaacagagcaggcgctcaacacgtgagttttcaatattactatgaataatattgctgtgcgcacctctccagaggtgccaccaa

SEQ ID NO: 65874 - DNA, 201 bp, Homo sapiens
tatgtgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatataaatatgcaggtatgtatatgtttgtatatatgtgtataaatatgcgtatatttattaaa

SEQ ID NO: 65875 - DNA, 201 bp, Homo sapiens
tggcaaatgtttctgtgagtctgggactaggagatagaattcctgagagtgctcattttaactatataacatagattacagtacctttttcaaatcctaaratgatgacatcctacctctggaggaaaccagagtgaaggccatggagaaagggctgccatccctgtccatctttcacccagccatgagagaagacagggt

SEQ ID NO: 65876 - DNA, 201 bp, Homo sapiens
tgagaaaggttagaacatcgtgttgcattttgaatttctaccattgttggaaccaggtctagtattataagcccctgacccagcctgtgtgtgaggcctaracaaagcctgagcacttcagctaagaccacccaccaaggtgacacctttagcctcacgcctttgataagctggcccaggtcccagtaactccattgtcag

SEQ ID NO: 65877 - DNA, 201 bp, Homo sapiens
tgtagttctcggggccaggggagccggcacggaagcggctgtgcgcatgagcagatgaggcctagccgaggcggcgggacccccaagtttggaaagctctkttaacggtgagaacgcgttaacacttgccaaggggagtggttggtgcctgtgcggagctagcagccggcctgaggagggagggagaatgtgatccggtgg

SEQ ID NO: 65878 - DNA, 201 bp, Homo sapiens
tcctgttctgctttgatattcatgaacattttagctctccatgagtctgaaagtttttcctctattctgatgtcacaatctccaaagttatcagaaacctkcattcaagagcccctgttagagttttaagatgatgattattatttatttatttatttttagactactcttgctctgtcgcgcagggtgaagtgcaagtgg

SEQ ID NO: 65879 - DNA, 201 bp, Homo sapiens
agcagtatactaaattgttaaaagctgtcaatagctcaaaagagaagtttgaagactctgaaaaacaaaacaaaggatcagcaacgttttaagcaaaaggycaaaaaaattagttcaatccatgcagttaattcctgttctgctttgatattcatgaacattttagctctccatgagtctgaaagtttttcctctattctg

SEQ ID NO: 65880 - DNA, 201 bp, Homo sapiens
gccaagccttgccatggatttgtaccatcaaatatctatgagttgggtgaatttcctctcctcttgaggttccaggataaacctggggctcctgggcctgycataaagtaacattctttacttaacacaagtcagaaaccctgttcagggactgtgtacacaaaatatgaggccagtttcccaagggcgttattggcttca

SEQ ID NO: 65881 - DNA, 201 bp, Homo sapiens
gcaaataatggctgataatacctacgcttggggatgtctttcaccttgcaaaaaatctgggagctggaagagcctggctctagagactcaacaggtgcctygcagcttctgcctccttcccttggcccaaaggccagccagatagctgggggagttactttctgcaagcactgcctctggtctgagcctgatgggaagttg

SEQ ID NO: 65882 - DNA, 201 bp, Homo sapiens
gaacaaaggaaggaagaaataacttgtggaatgctgagaaaggtaaaaacaccttcaaataaggaagaagaataggctatgacttaatgcttgcttggacyagtataagcatgccagggcaaatatttaggctaaattgtgggagctaagaacataaagtacagtgacttcttcattatggctagcagatatttaagaatg

SEQ ID NO: 65883 - DNA, 201 bp, Homo sapiens
cagcttctagaggccacctccattcttccatcttcaaagccagaaacagcatctctctgagcccgattcctcacatctctttctctggctctgggcttccrcctttcttttccacttttaaggacccttctgatgacattgggcccacccagacagtccaggatcatctccctctctgctgatcagcaaccttaattctac

SEQ ID NO: 65884 - DNA, 201 bp, Homo sapiens
gtctcagccttcatccaccgctgagcaggtcaccttgcctttttcctgcagagagtgtaatcggcagcagaaggtcatccccgtggtgaacagcttctatrccgccacattcctccacctcgcacatgtctggaggacacagcggaagaccatctcagactcgggctttgtcctcaaaggtgtgctctttcttctggggag

SEQ ID NO: 65885 - DNA, 201 bp, Homo sapiens
gtggctgaggtggagatgaaagtgacaggaggaaagatcacttggtggtcttttaggctgttgtaaacatttactgtaagtgatatggaaaacactggagtgatgtgacagaatctggcatttttgggttttttcctctctaaaaaatatttatgaaaattttatcatatattattttactttctgagtgaaacagaatca

SEQ ID NO: 65886 - DNA, 201 bp, Homo sapiens
ccttccattccctcaaggaaccagaagctatttaggaatttaagaaagatataagctggaaaaagaaggaatatttgggggaataaacgctaggggtgggstgggtgctgggcatagtggctcacacatgtaataccagctctttcggaggaggctgaggtgaggggtcacttgaacccaggagttcaaggctgcagtaag

SEQ ID NO: 65887 - DNA, 201 bp, Homo sapiens
aacagaggtgtatggttgggggttcctatacagggtgtaagaagggaaaagtggaaattaggaaaggcccttaaacaaactggttgcatgctcttatgtgrgtacccaccccaggcagtgacttgccccctcgtagatgagagcatttagggatcacctcgtggggcagatccgccccatacccaccacagaggctgacct

SEQ ID NO: 65888 - DNA, 201 bp, Homo sapiens
gatcatatttttggtattaaactggagtctctccatccttcacattgttgatgtcctctgtagcaaaccggaaaagtcagtgacagaagatgccgctagcrgtttgagccagagaatgacagctctggtttggagaaaagggccggatggtggctctagaaagcccatccttctgctcttctttttttctcccccttatat

SEQ ID NO: 65889 - DNA, 201 bp, Homo sapiens
ctctgcctagcacataccaaaactctggaatcacagagggaaagctggtgttctgcataaagtatcttttttgtgtttgtttttttgaaaaaaaaaaaaawtttttgtagagacaggatctcaccatgttgcccaggctggtcttgaactcctagactcaagtgatccatccgcctgtaatcccaaagtgttggattgtga

SEQ ID NO: 65890 - DNA, 201 bp, Homo sapiens
caatctggcagagagtgtgggtgtgttttggggcaggtggcctggatagccaagacccagtgcatggccgagtcctccagaccatctataagaagctgacyggctccaagtttgactgtgcccttcatggaaaccactgggaggacctgggctttcagggtaagagggaggagtagctcatcttctttttcatgcctctga

SEQ ID NO: 65891 - DNA, 201 bp, Homo sapiens
aggtggtcagagcccaagaagaatgggaagctgtggacaccatccagccagagacaggtaactgtacgaatgctgctgtctccccatagcccctctgccascaaaggcaccatccacacatgtggcaaatgtttctgtgagtctgggactaggagatagaattcctgagagtgctcattttaactatataacatagattac

SEQ ID NO: 65892 - DNA, 201 bp, Homo sapiens
ggagacagaggttgcagtgaaccgagatcacgccactgccctgcactccagcctgggcgacagagcaagactccatctcaaaaaaaaaaaaaaaaaaaaaatctgtctcttggagttgttgtaatgattagtgacttaactctacccagtgtggcactagcgctggatttccaagaccacctgcaggttcaatgattcctg

SEQ ID NO: 65893 - DNA, 201 bp, Homo sapiens
gatgggaagttgattaagggaaatgaaccagcattctgcccattgcctgcaacttcttccccagaaaagaatccagccaactattcgaaggactgggctcrccgccctccgacactacctcttcgggcctccaaagctccaccagcgccttcgggaagaaagggacttggtcctgaccattgctcagtgtgagtgcaatgc

SEQ ID NO: 65894 - DNA, 201 bp, Homo sapiens
gagcccaagaagaatgggaagctgtggacaccatccagccagagacaggtaactgtacgaatgctgctgtctccccatagcccctctgccagcaaaggcaycatccacacatgtggcaaatgtttctgtgagtctgggactaggagatagaattcctgagagtgctcattttaactatataacatagattacagtaccttt

SEQ ID NO: 65895 - DNA, 201 bp, Homo sapiens
ccagagagcccaaggtggttgctagactggttttggctgcagttcttccccatccacactttctcaaattccagcttaccaaaatctccatcacccacccsctggagtctgctagttctcctttctctgccctgactgtcgcccttttctggtcttatacttatgacaagcatatattctgatcaaaaattgggagccagg

SEQ ID NO: 65896 - DNA, 201 bp, Homo sapiens
tgcaccggtctccccaggacatcccttctcccacccctggccttagatgtcaggctcctggggaatggtgggggcatcctgggtttgggctggctcccctsgggaaatggggaaggaaggcgggagggaacctaggtctcagccttcatccaccgctgagcaggtcaccttgcctttttcctgcagagagtgtaatcggca

SEQ ID NO: 65897 - DNA, 201 bp, Homo sapiens
ctatcctcaagctaaaggtcagctgcctctacagatctcagagttgaagaaccatggcattctccaggctctgaccacagaagcttatgaatgggagccaygtggtaaggttcccttcagggcccttggagtctgggtgggacccaagtcagaccttcccatgcatctgctgttcatcatttgaatttctctcactccttg

SEQ ID NO: 65898 - DNA, 201 bp, Homo sapiens
ctgagacaggtctcagttaatttagaaagtttgtttttccaaggttgggaatgcgcacctgtgacacagcctcaggaggtgctgatgacatgtgcctaagktcatcagagcacagcttggttttacagttttagggagatatgagacatcaattaacacatgtaagatgagcattggttcctccggaaaggtgggaggact

SEQ ID NO: 65899 - DNA, 201 bp, Homo sapiens
ggacacatagaagggaacaacacacactggggcctattggaaagtggagggttggccgggcccggtggctcacgcctgtaatctcagcactttgggaggcygaggcgggtggatcatgaggtcaggagatcgagaccatcctggctaacacggtgaaaccccgtctctactaaaaatacaaaaaaaattagtcgggcctgg

SEQ ID NO: 65900 - DNA, 201 bp, Homo sapiens
gattttaaaagaacacgttgaaaaattagctctgtatctgtgaaatgagttacaaacaattggccgagtattttggtcggttttttgtttttcatctgtarcaggggataggtttggctgagcagaaaggccataggaaactgcttcactaaacttcgctcactcagaaccctcagactttcaaagagccaggaaatcggt

SEQ ID NO: 65901 - DNA, 201 bp, Homo sapiens
aggcaggcggatcacgaggtcaggagttcaagaccagcctaaccaacatagtgaaaccccatctctactaaaaatacaaaaattagcagggtgtggtggcrcacgcctgtaattccagctactcgggagactgggacaggagaatcgcttgaacccgggaggcggaggttgcagtgagccgagatcgcacggctgcactcc

SEQ ID NO: 65902 - DNA, 201 bp, Homo sapiens
cggagctagcagccggcctgaggagggagggagaatgtgatccggtggaaattatcactatggggcgagacaaggccgagagttgtaagactgaaagagartcccgactgggagacaggagtcctgagttctggtcctggctctgccctggactcgctgccttgaggtgttaaattgctttcctcgtcttacgcctccagg

SEQ ID NO: 65903 - DNA, 201 bp, Homo sapiens
cctctgcctagcacataccaaaactctggaatcacagagggaaagctggtgttctgcataaagtatcttttttgtgtttgtttttttgaaaaaaaaaaaawatttttgtagagacaggatctcaccatgttgcccaggctggtcttgaactcctagactcaagtgatccatccgcctgtaatcccaaagtgttggattgtg

SEQ ID NO: 65904 - DNA, 201 bp, Homo sapiens
gagactcaagggactctacgtatagttatacttaacagttctgatttagtacaacagaagcaaaatcagcaaagggaagaattacatgggacaaattccayaggaaaccaggtggtgatgtccaagaggcctctcccagtggaatcacacagaacacacttcattcttccactgccaaattgtgcaatacgtataaaatgt

SEQ ID NO: 65905 - DNA, 201 bp, Homo sapiens
tacgaatgctgctgtctccccatagcccctctgccagcaaaggcaccatccacacatgtggcaaatgtttctgtgagtctgggactaggagatagaattcstgagagtgctcattttaactatataacatagattacagtacctttttcaaatcctaagatgatgacatcctacctctggaggaaaccagagtgaaggcca

SEQ ID NO: 65906 - DNA, 201 bp, Homo sapiens
cccaaacaccagctggttagagtgacccagcaaagccttgttcgtccccactctggcttaattttccccagctctactccacctgctggctcctggagggyctggacaaagtccccatgcaccggtctccccaggacatcccttctcccacccctggccttagatgtcaggctcctggggaatggtgggggcatcctgggt

SEQ ID NO: 65907 - DNA, 201 bp, Homo sapiens
ccgctgagcaggtcaccttgcctttttcctgcagagagtgtaatcggcagcagaaggtcatccccgtggtgaacagcttctatgccgccacattcctccayctcgcacatgtctggaggacacagcggaagaccatctcagactcgggctttgtcctcaaaggtgtgctctttcttctggggaggcctaggctgaatgcac

SEQ ID NO: 65908 - DNA, 201 bp, Homo sapiens
cttcagctggctcattgggaaaattagagacaatgtacaaaagtagcaagcacagctgtgctgttgctgtttcaactctctgccctccctgaggaaatgcyttgcacaggggtagcatctcttggccctgaaagagaagagttagcctccacgggcccaagaggaggagatggacctccatgggttatgtgagccacagac

SEQ ID NO: 65909 - DNA, 201 bp, Homo sapiens
cacagaggctgacctagcaagactgaatagcctcgtccaaaaagagagtcctcttcgccgacaatgccagcctcttgaaagaagattggttgtagctgtargtgtctgatgttcaactggaagccagtgcttggcttggaagtgacaagtaggagggcctcagtaaatgtttgttgacagaatgactcctataaatcctgg

SEQ ID NO: 65910 - DNA, 201 bp, Homo sapiens
ggcaccatccacacatgtggcaaatgtttctgtgagtctgggactaggagatagaattcctgagagtgctcattttaactatataacatagattacagtayctttttcaaatcctaagatgatgacatcctacctctggaggaaaccagagtgaaggccatggagaaagggctgccatccctgtccatctttcacccagcc

SEQ ID NO: 65911 - DNA, 201 bp, Homo sapiens
ggcccaaggcaggcagacaaggctggggtctgcagtagaggcccagacatacctagatctcagagggtctccttttctcctactattgcagttgtgagtayagaggtggtcagagcccaagaagaatgggaagctgtggacaccatccagccagagacaggtaactgtacgaatgctgctgtctccccatagcccctctgc

SEQ ID NO: 65912 - DNA, 201 bp, Homo sapiens
cagttcttccccatccacactttctcaaattccagcttaccaaaatctccatcacccaccccctggagtctgctagttctcctttctctgccctgactgtygcccttttctggtcttatacttatgacaagcatatattctgatcaaaaattgggagccagggtccaatagttggactattcaaagttgcaattgtgcaga

SEQ ID NO: 65913 - DNA, 201 bp, Homo sapiens
cggccaatcttacttttcaaaagctcactctagcaaacctgtgaggagaggatcagagggtgttaagatccaaggcagccagatgtggtagtgcgtgcctrtagttccaggtactcaggaggctgaggcaggaggattgcttgagtccaggaattctgggctgtagtgtgccatgctgatcatgtggccccactaagttca

SEQ ID NO: 65914 - DNA, 201 bp, Homo sapiens
gtcaggagcctggccaggccgcaccccttgctgtctcagcagatgggatataggaagctcctgggcttagctgtgggaagccaagtaccctcaccggcatkggacatgaggggcagctagacttcacccccttcccgcagacctgcctccagagcaaggagaattctgccttaatctgttgggctccagtctccgggttga

SEQ ID NO: 65915 - DNA, 201 bp, Homo sapiens
ggggcccgttgggtgggggggcgggacagcattaggaaaaatagctaacgcatgccgggcttaatacctgatgagttgataggtacagcaaaccaccatgrccacatgtttacctatgtaacctgcacatcctgcacatgtaccctggaacttaaaataaaaattataattaaaaaaagaattgagtagctgcaccactag

SEQ ID NO: 65916 - DNA, 201 bp, Homo sapiens
agcattaggaaaaatagctaacgcatgccgggcttaatacctgatgagttgataggtacagcaaaccaccatggccacatgtttacctatgtaacctgcamatcctgcacatgtaccctggaacttaaaataaaaattataattaaaaaaagaattgagtagctgcaccactagaaagatggcagtagcaagacagaagaa

SEQ ID NO: 65917 - DNA, 201 bp, Homo sapiens
cctatgtaacctgcacatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacga

SEQ ID NO: 65918 - DNA, 201 bp, Homo sapiens
ggctgtgccggaagcttctgcctcccccaaacagcggcgctccatcatccgtgaccggggacccatgtatgatgaccccaccctgcctgaaggctggacayggaagcttaagcaaaggaaatctggccgctctgctgggaagtatgatgtgtatttgatcaagtaagtaagagcaactcctatctctacagggcagggagg

SEQ ID NO: 65919 - DNA, 201 bp, Homo sapiens
aggcagggtgtctgccccctcctgagttgaagtcatgctcccctgtgccagcccagaggccgagagctatggacagcattgccagtaacacaggccacccwgtgcagaagggagctggctccagcctggaaacctgtctgaggttgggagaggtgcacttggggcacagggagaggccgggacacacttagctggagatgt

SEQ ID NO: 65920 - DNA, 201 bp, Homo sapiens
ctcccaaagtgctgggattacaggtgtgagctaccatgccaagcccacatttctctgtaaattttaaacagtattttagtccatatgtcagttcccctctktttaagataaggatattaataaccctacttttccttccactttccctccttaacttctgcgtcttaaaagctgtacttgaccatacccattcttgcattt

SEQ ID NO: 65921 - DNA, 201 bp, Homo sapiens
cctcctgagttgaagtcatgctcccctgtgccagcccagaggccgagagctatggacagcattgccagtaacacaggccaccctgtgcagaagggagctgrctccagcctggaaacctgtctgaggttgggagaggtgcacttggggcacagggagaggccgggacacacttagctggagatgtctctaaaagccctgtat

SEQ ID NO: 65922 - DNA, 201 bp, Homo sapiens
gtggcgtgcacccgtagtccatagtcccagctactcgggaagcagaggcaggaggattgcttgatcccaaggaggtcaaggctgcagtgagctgaggtcgygccaccgcaccccagcctgggtgactgagtgagaccctgtctcaaagaaaatgaaaagacaagtccaccaagaaaacagttgagaccagtcatagaaaaa

SEQ ID NO: 65923 - DNA, 201 bp, Homo sapiens
acaaaacattaagaagtgaaagtatctttgattatgctcttgaagacaactttttgtttgtttgttttgtttgagacggagtttcactcttgttgcccagsctggagtgcaatggtgtgatctcggctcactgcaacctccgcattcccgggttcaagcgattctcctgcctcagcctcccaagtagccaggattacaggc

SEQ ID NO: 65924 - DNA, 201 bp, Homo sapiens
attcgattgtgtcatcccttcagtctcctttatcagaaatgttcccccacccccttgttttctctcatcatcttgagtccagaccgtggttgcatggcacrccctctctggactcttcctgctgtctcctcacggtaagcttcagtctcctactcgtgatgctggttcatctcagcagcactgaggggcctgagctcagtt

SEQ ID NO: 65925 - DNA, 201 bp, Homo sapiens
cattcccaagaaacggggccgaaagccggggagtgtggtggcagccgctgccgccgaggccaaaaagaaagccgtgaaggagtcttctatccgatctgtgyaggagaccgtactccccatcaagaagcgcaagacccgggagacggtcagcatcgaggtcaaggaagtggtgaagcccctgctggtgtccaccctcggtga

SEQ ID NO: 65926 - DNA, 201 bp, Homo sapiens
tctggcctggcatgccctgagccctctgtcccacctgtggaactcataagccctgacagcccactcactcctgattcattatccacacccctgtgcttccrctgtgcctggagcaagctttcttcagggggaagggaggctggaactatgttgtagttacctatttgtcctcccttccaaactgtgagttcttggaggtgg

SEQ ID NO: 65927 - DNA, 201 bp, Homo sapiens
actccccagaatacaccttgcttctgtagaccagctccaacaggattccatggtagctgggatgttagggctcaggtaagtaaccttcctttttttttttwtagtatatgtcctggtttggccatctgttttttttttttttaaaaaaaaaaaaaaaaggaaaagaggaaaaaaatatactactcttggacagtataaaag

SEQ ID NO: 65928 - DNA, 201 bp, Homo sapiens
tctggaggaagatacaggatagggaggaactcaggggtgagtcatggtggggacaagacattccctcactctaagaccttgtcactagattggaacatctsttgcctccctacacctgacctgatggttctggagagatacgtccttgcagcttctgagtcccagcactaagcagcctttggtaacttccctacatcattt

SEQ ID NO: 65929 - DNA, 201 bp, Homo sapiens
cccccgtgccactgctcccacccctgcccccacctccacctgagcccgagagctccgaggaccccaccagcccccctgagccccaggacttgagcagcagygtctgcaaagaggagaagatgcccagaggaggctcactggagagcgacggctgccccaaggagccagctaagactcagcccgcggttgccaccgccgcca

SEQ ID NO: 65930 - DNA, 201 bp, Homo sapiens
tctgcaaagaggagaagatgcccagaggaggctcactggagagcgacggctgccccaaggagccagctaagactcagcccgcggttgccaccgccgccacrgccgcagaaaagtacaaacaccgaggggagggagagcgcaaagacattgtttcatcctccatgccaaggccaaacagagaggagcctgtggacagccgga

SEQ ID NO: 65931 - DNA, 201 bp, Homo sapiens
attaactgaaataaaaaatatttttttttctttcagtaaacttagagtttcgtggcttcagggtgggagtagttggagcattggggatgtttttcttaccracaagcacagtcaggttgaagacctaaccagggccagaagtagctttgcacttttctaaactaggctccttcaacaaggcttgctgcagatactactgac

SEQ ID NO: 65932 - DNA, 201 bp, Homo sapiens
ctcaggccagaaacctggcgctggttacctcatttgttcacaaatactgttactccacctgcaagatggatacaaaatctcatgagttcccctgcctccayggcccccaccctggtccaggtgtccagcttccctgcctctgcccttgccccctggttctttgtttagtcctgcaatattgtgctcttctgttcagaaccc

SEQ ID NO: 65933 - DNA, 201 bp, Homo sapiens
agctttgcgaaacaagagaaatgaattttaaaggctgtcaggtgcctttgcaatctgtggcttagtatttgtgtaacaacatttgtgttttgccaacagakgtactgcttaaagtacccatgagaatggcctctgtggttttctactttctcggatggaaccttaggaactgattattgagaagaggctgatactgcccac

SEQ ID NO: 65934 - DNA, 201 bp, Homo sapiens
atattttaaattttctttgtttcttcctttgactcacatattattttaaaatgtgtttttcaatttccaagcacatggctttgggtttgtttttttttttycctagttgctctagaaaaaaaaattgactgcatgaggtggctcatgcctgtaatcccagcactttgggaggccgaggcgggcagatcacctgaggtcagg

SEQ ID NO: 65935 - DNA, 201 bp, Homo sapiens
atgctagaacttaaaactgagttcagctaggctcaagtgccccacaatttttgtcccaccagacaatttcatgaatatctacagattgttccctcaatatrcctcaatattgaggcatattgatttggggagcacagacaagtcaaggttgatgtgcatccgctgaacatgatcttaagttgttgaagtaggtattattaa

SEQ ID NO: 65936 - DNA, 201 bp, Homo sapiens
ctgacattgctatggagagcctctaattgttccttgtgtctttctgtttgtccccacagtccccagggaaaagcctttcgctctaaagtggagttgattgygtacttcgaaaaggtaggcgacacatccctggaccctaatgattttgacttcacggtaactgggagagggagcccctcccggcgagagcagaaaccacct

SEQ ID NO: 65937 - DNA, 201 bp, Homo sapiens
aaaggtaggcgacacatccctggaccctaatgattttgacttcacggtaactgggagagggagcccctcccggcgagagcagaaaccacctaagaagcccwaatctcccaaagctccaggaactggcagaggccggggacgccccaaagggagcggcaccacgagacccaaggcggccacgtcagagggtgtgcaggtgaa

SEQ ID NO: 65938 - DNA, 201 bp, Homo sapiens
aaagccggggagtgtggtggcagccgctgccgccgaggccaaaaagaaagccgtgaaggagtcttctatccgatctgtgcaggagaccgtactccccatcmagaagcgcaagacccgggagacggtcagcatcgaggtcaaggaagtggtgaagcccctgctggtgtccaccctcggtgagaagagcgggaaaggactgaa

SEQ ID NO: 65939 - DNA, 201 bp, Homo sapiens
aagaaagccgtgaaggagtcttctatccgatctgtgcaggagaccgtactccccatcaagaagcgcaagacccgggagacggtcagcatcgaggtcaaggmagtggtgaagcccctgctggtgtccaccctcggtgagaagagcgggaaaggactgaagacctgtaagagccctgggcggaaaagcaaggagagcagcccc

SEQ ID NO: 65940 - DNA, 201 bp, Homo sapiens
cagaggaggctcactggagagcgacggctgccccaaggagccagctaagactcagcccgcggttgccaccgccgccacggccgcagaaaagtacaaacacygaggggagggagagcgcaaagacattgtttcatcctccatgccaaggccaaacagagaggagcctgtggacagccggacgcccgtgaccgagagagttag

SEQ ID NO: 65941 - DNA, 201 bp, Homo sapiens
tagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatt

SEQ ID NO: 65942 - DNA, 201 bp, Homo sapiens; identical to SEQ ID NO: 51377

SEQ ID NO: 65943 - DNA, 201 bp, Homo sapiens
tgaggggggtggggccaccacatccacccaggtcatggtgatcaaacgccccggcaggaagcgaaaagctgaggccgaccctcaggccattcccaagaaayggggccgaaagccggggagtgtggtggcagccgctgccgccgaggccaaaaagaaagccgtgaaggagtcttctatccgatctgtgcaggagaccgtact

SEQ ID NO: 65944 - DNA, 201 bp, Homo sapiens
cagtgcaggttggctggctccaaacctgtgtgtgctttccatgacactgtactgtgtgcctcattgagcctcattctagaaaaccaaaaacacacccaagscccggccttcacaaaggagacccctcccccatttggctccctttccagcagtcgacggcctcttgtcagccatcgagcccagagtcccttgaagtgcgac

SEQ ID NO: 65945 - DNA, 201 bp, Homo sapiens
acggatatctgtttggttactggttttggttttttgtttgtttgttttggttttttgagacaaggtcttgctctgtcgcccaggctggattacagtggcaygatctctgctcactgcaacctccacctcccaggttcaagcaattctcctgcctcagtctcctgagtagctgggactacaggtagcactcaccaccatgcc

SEQ ID NO: 65946 - DNA, 201 bp, Homo sapiens
gtgacagagcaagactccgtctcaaaaaaaaaaaaaaaaaagttcattcattgtacacttagaaatagttaaaaaggtaaactttgttttgtgtgtgtgtrtatatatatatatatatatatatgtatttttttttgagacatatatgtgtctggtttgttcgcccaggcaggagtgcagtggcatgatcaacggctcact

SEQ ID NO: 65947 - DNA, 201 bp, Homo sapiens
ctgactcacccttgcccctcacccccacactaatccacctgcgagctctgttgcttcaccacctagaccagccccaaatcctcaactgcccccaccctggkccacacctggaccactgctagaggcctctcatgggccctccctgtttttctcttgcactccccgggctttctggcacaagatgccccagaagcagaatca

SEQ ID NO: 65948 - DNA, 201 bp, Homo sapiens
gaccccaccgggccaaagtgatgtgtagagaaggagctgcttcggtcaccagaaaagaacggggaagcctcccacactagaataggtagggtgctcttctscaccggcaggaaggggatgtatggctctgcctggaccacacctttttccttgctcttccctccgcatctgctgtggccgaggccattcctcatcagggaa

SEQ ID NO: 65949 - DNA, 201 bp, Homo sapiens
tgaactttggagaggcctgggggggtcagcggcaggcagacgagtgagtggctttggtgacaggtcctcaggggcagccaggcagtgtgactctcgttcartagtaacgtttgtcagagcgttgtcaccaccatccgctctgccctatctctgacattgctatggagagcctctaattgttccttgtgtctttctgtttgt

SEQ ID NO: 65950 - DNA, 201 bp, Homo sapiens
gtggctatggcctgtgcgatcccacccgtggtggctcaagtctggccccacaccagccccaatccaaaactggcaaggacgcttcacaggacaggaaagtrgcacctgtctgctccagctctggcatggctaggaggggggagtcccttgaactactgggtgtagactggcctgaaccacaggagaggatggcccagggtg

SEQ ID NO: 65951 - DNA, 201 bp, Homo sapiens
ggccatggaggcagtaggacaaggtgcaggcaggctggcctggggtcaggccgggcagagcacagcggggtgagagggattcctaatcactcagagcagtstgtgacttagtggacaggggagggggcaaagggggaggagaagaaaatgttcttccagttactttccaattctcctttagggacagcttagaattatttg

SEQ ID NO: 65952 - DNA, 201 bp, Homo sapiens
cttctcttccaggcagccgcggtgcccaaccacacttgtcggctccagtccccagaactctgcctgccctttgtcctcctgctgccagtaccagccccacsctgttttgagccctgaggaggccttgggctctgctgagtccgacctggcctgtctgtgaagagcaagagagcagcaaggtcttgctctcctaggtagccc

SEQ ID NO: 65953 - DNA, 201 bp, Homo sapiens
ccctcaggccattcccaagaaacggggccgaaagccggggagtgtggtggcagccgctgccgccgaggccaaaaagaaagccgtgaaggagtcttctatcygatctgtgcaggagaccgtactccccatcaagaagcgcaagacccgggagacggtcagcatcgaggtcaaggaagtggtgaagcccctgctggtgtccac

SEQ ID NO: 65954 - DNA, 201 bp, Homo sapiens
gggccgaaagccggggagtgtggtggcagccgctgccgccgaggccaaaaagaaagccgtgaaggagtcttctatccgatctgtgcaggagaccgtactcsccatcaagaagcgcaagacccgggagacggtcagcatcgaggtcaaggaagtggtgaagcccctgctggtgtccaccctcggtgagaagagcgggaaagg

SEQ ID NO: 65955 - DNA, 201 bp, Homo sapiens
ggccgaaagccggggagtgtggtggcagccgctgccgccgaggccaaaaagaaagccgtgaaggagtcttctatccgatctgtgcaggagaccgtactccscatcaagaagcgcaagacccgggagacggtcagcatcgaggtcaaggaagtggtgaagcccctgctggtgtccaccctcggtgagaagagcgggaaagga

SEQ ID NO: 65956 - DNA, 201 bp, Homo sapiens
aggaagcgaaaagctgaggccgaccctcaggccattcccaagaaacggggccgaaagccggggagtgtggtggcagccgctgccgccgaggccaaaaagaragccgtgaaggagtcttctatccgatctgtgcaggagaccgtactccccatcaagaagcgcaagacccgggagacggtcagcatcgaggtcaaggaagtg

SEQ ID NO: 65957 - DNA, 201 bp, Homo sapiens
aaacctctctcttgagctccagatttgatggcctcgtcagcatttacttgagttgctcataagtgtctcaaatttaacaagtcccagtcttgatttttttyccccttcaaacctattcctcatgttgtctctatttcagtaaacaatatcaacatccacccagttactcagtccaaaattctaggagtcatccttgattct

SEQ ID NO: 65958 - DNA, 201 bp, Homo sapiens
ggggagtgtggtggcagccgctgccgccgaggccaaaaagaaagccgtgaaggagtcttctatccgatctgtgcaggagaccgtactccccatcaagaagygcaagacccgggagacggtcagcatcgaggtcaaggaagtggtgaagcccctgctggtgtccaccctcggtgagaagagcgggaaaggactgaagacctg

SEQ ID NO: 65959 - DNA, 201 bp, Homo sapiens; identical to SEQ ID NO: 51356

SEQ ID NO: 65960 - DNA, 201 bp, Homo sapiens
gggagtgtggtggcagccgctgccgccgaggccaaaaagaaagccgtgaaggagtcttctatccgatctgtgcaggagaccgtactccccatcaagaagcrcaagacccgggagacggtcagcatcgaggtcaaggaagtggtgaagcccctgctggtgtccaccctcggtgagaagagcgggaaaggactgaagacctgt

SEQ ID NO: 65961 - DNA, 201 bp, Homo sapiens
gactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatcca

SEQ ID NO: 65962 - DNA, 201 bp, Homo sapiens
agtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcct

SEQ ID NO: 65963 - DNA, 201 bp, Homo sapiens
ggattgccggtcttgacagctcagtgagctggagatacttggtcacagccaggcgctagcacagctcccttctgttgatgctgtattcccatatcaaaagrcacaggggacacccagaaacgccacatcccccaatccatcagtgccaaactagccaacggccccagcttctcagctcgctggatggcggaagctgctact

SEQ ID NO: 65964 - DNA, 201 bp, Homo sapiens
cttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggc

SEQ ID NO: 65965 - DNA, 201 bp, Homo sapiens
ttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggcc

SEQ ID NO: 65966 - DNA, 201 bp, Homo sapiens
tttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggcca

SEQ ID NO: 65967 - DNA, 201 bp, Homo sapiens
ggaggctgaggcaggtgaatccttgaaaccaagaggcggaggttgcagtaagctgagatcacgccaatgcattctagcctgggcaacagtgagacccagtwtccaaaaaaaaaaaaaaaaaaaaaaaagataataaaggagaaaaaccatatagtctattcaataaatacagaaaacgcatctgacaaaattcagtgccct

SEQ ID NO: 65968 - DNA, 201 bp, Homo sapiens
actctgttgcccaggctggagtgcagtggtgcgatctcagctcactgcaacctctgcctcccgagttcaagcgattcccatgcctcagccttccaagtagstgggattacaggtgtgcgccaccatgcctggctaatttttgtatttttagtagaggcagggttttgccatgttggccaggctggtctcaaactcctgacc

SEQ ID NO: 65969 - DNA, 201 bp, Homo sapiens
ttcaaacttcgccagggggcaaggctgaggggggtggggccaccacatccacccaggtcatggtgatcaaacgccccggcaggaagcgaaaagctgaggcygaccctcaggccattcccaagaaacggggccgaaagccggggagtgtggtggcagccgctgccgccgaggccaaaaagaaagccgtgaaggagtcttcta

SEQ ID NO: 65970 - DNA, 201 bp, Homo sapiens
ggggcgcagcagcagcgcctcctcaccccccaagaaggagcaccaccaccatcaccaccactcagagtccccaaaggcccccgtgccactgctcccacccytgcccccacctccacctgagcccgagagctccgaggaccccaccagcccccctgagccccaggacttgagcagcagcgtctgcaaagaggagaagatgcc

SEQ ID NO: 65971 - DNA, 201 bp, Homo sapiens
gctcacttgttctgcagactggcatgttctctgtgatacttacatacttgtttaacacttcagggaagaaaagtcagaagaccaggacctccagggcctcwaggacaaacccctcaagtttaaaaaggtgaagaaagataagaaagaagagaaagagggcaagcatgagcccgtgcagccatcagcccaccactctgctga

SEQ ID NO: 65972 - DNA, 201 bp, Homo sapiens
caggacctccagggcctcaaggacaaacccctcaagtttaaaaaggtgaagaaagataagaaagaagagaaagagggcaagcatgagcccgtgcagccatmagcccaccactctgctgagcccgcagaggcaggcaaagcagagacatcagaagggtcaggctccgccccggctgtgccggaagcttctgcctcccccaaa

SEQ ID NO: 65973 - DNA, 201 bp, Homo sapiens
catcagaagggtcaggctccgccccggctgtgccggaagcttctgcctcccccaaacagcggcgctccatcatccgtgaccggggacccatgtatgatgamcccaccctgcctgaaggctggacacggaagcttaagcaaaggaaatctggccgctctgctgggaagtatgatgtgtatttgatcaagtaagtaagagcaa

SEQ ID NO: 65974 - DNA, 201 bp, Homo sapiens
ctccagtccccagaactctgcctgccctttgtcctcctgctgccagtaccagccccaccctgttttgagccctgaggaggccttgggctctgctgagtccracctggcctgtctgtgaagagcaagagagcagcaaggtcttgctctcctaggtagccccctcttccctggtaagaaaaagcaaaaggcatttcccaccct

SEQ ID NO: 65975 - DNA, 201 bp, Homo sapiens
gaaggagtcttctatccgatctgtgcaggagaccgtactccccatcaagaagcgcaagacccgggagacggtcagcatcgaggtcaaggaagtggtgaagsccctgctggtgtccaccctcggtgagaagagcgggaaaggactgaagacctgtaagagccctgggcggaaaagcaaggagagcagccccaaggggcgcag

SEQ ID NO: 65976 - DNA, 201 bp, Homo sapiens
ggcctgccagtcatcgagtggcccaacaggggctccatgccagccgaccttgacctcactcagaagtccagagtctagcgtagtgcagcagggcagtagcrgtaccaatgcagaactcccaagacccgagctgggaccagtacctgggtccccagcccttcctctgctcccccttttccctcggagttcttcttgaatggc

SEQ ID NO: 65977 - DNA, 201 bp, Homo sapiens
ccattgagagctgtaagactcagagacttgaaaaggaagctctggctgggcacggtggctcacgcctgtaatcccagcactttgggaggctgaggcgggtygatcacctgaggtcaggagttcgagaccagcctgcccaacatggtgaaaccccgtctccactaaacatacaaaaattagcctggcgtggtagcacacgcc

SEQ ID NO: 65978 - DNA, 201 bp, Homo sapiens
ctgactcttccccaggaagggaaggggggtcagaagagagggtgagtcctccagaactcttcctccaaggacagaaggctcctgcccccatagtggcctcraactcctggcactaccaaaggacacttatccacgagagcgcagcatccgaccaggttgtcactgagaagatgtttattttggtcagttgggtttttatgt

SEQ ID NO: 65979 - DNA, 201 bp, Homo sapiens
aaggagtcttctatccgatctgtgcaggagaccgtactccccatcaagaagcgcaagacccgggagacggtcagcatcgaggtcaaggaagtggtgaagcycctgctggtgtccaccctcggtgagaagagcgggaaaggactgaagacctgtaagagccctgggcggaaaagcaaggagagcagccccaaggggcgcagc

SEQ ID NO: 65980 - DNA, 201 bp, Homo sapiens
accctcggtgagaagagcgggaaaggactgaagacctgtaagagccctgggcggaaaagcaaggagagcagccccaaggggcgcagcagcagcgcctcctmaccccccaagaaggagcaccaccaccatcaccaccactcagagtccccaaaggcccccgtgccactgctcccacccctgcccccacctccacctgagccc

SEQ ID NO: 65981 - DNA, 201 bp, Homo sapiens
ggggacccatgtatgatgaccccaccctgcctgaaggctggacacggaagcttaagcaaaggaaatctggccgctctgctgggaagtatgatgtgtatttsatcaagtaagtaagagcaactcctatctctacagggcagggagggcagggacaaggatccctcatggagcaggaaaatgtatgtgcccagggtggggtcg

SEQ ID NO: 65982 - DNA, 201 bp, Homo sapiens
tgtcagagcgttgtcaccaccatccgctctgccctatctctgacattgctatggagagcctctaattgttccttgtgtctttctgtttgtccccacagtcyccagggaaaagcctttcgctctaaagtggagttgattgcgtacttcgaaaaggtaggcgacacatccctggaccctaatgattttgacttcacggtaact

SEQ ID NO: 65983 - DNA, 201 bp, Homo sapiens
caccatccgctctgccctatctctgacattgctatggagagcctctaattgttccttgtgtctttctgtttgtccccacagtccccagggaaaagcctttygctctaaagtggagttgattgcgtacttcgaaaaggtaggcgacacatccctggaccctaatgattttgacttcacggtaactgggagagggagcccctc

SEQ ID NO: 65984 - DNA, 201 bp, Homo sapiens
ctacaggcttgtgccaccacgactagctggcccacattttagatgtctctcttttcttgtgatataatttaacttgtttgtccatatatattacttgtagrcaagaagttaggtctacaggcatgttcaggttaaacattttgggcaagaatatttcataggcagtactgtgtacttcatatagcatcagctcaccaggca

SEQ ID NO: 65985 - DNA, 201 bp, Homo sapiens
tcattgtgaaggtattgggacataatttgggaaagcgtcctggtctaagcttttgattggctctccatcatttgggtaatgggatagtgatttaggagtaycatagcagctcaaggggcccttctggaaagggtatgaggaaggtcagggacaagtctgaaatgaatcatcctaggcttaatgcctgtgactgggcagtgg

SEQ ID NO: 65986 - DNA, 201 bp, Homo sapiens
ctttaccaggacccagttccaccccgtcctttgtgcattgtccaagactgctctcctgtacaacagcaggtgggctggttgtgacagatactgtctggccyacaaggtggaaaatactatctggccccttacagaaagaaattacctgagttctacacgagggtgtaggtatgtaccctggcctctgccagtcagactcac

SEQ ID NO: 65987 - DNA, 201 bp, Homo sapiens
tctttctctgtctcctctgctgattctttctcctcatcacaactccaaatagcagggggagggttgtttacacttatattcagcacgccctcacgcactcrcctggctcttcagacctctcccctgaactccagattcatacatccagctgccctttaggcctctagaaagctaaatacctcagtatcaaaaacatgagaa

SEQ ID NO: 65988 - DNA, 201 bp, Homo sapiens
cacagtccccagggaaaagcctttcgctctaaagtggagttgattgcgtacttcgaaaaggtaggcgacacatccctggaccctaatgattttgacttcayggtaactgggagagggagcccctcccggcgagagcagaaaccacctaagaagcccaaatctcccaaagctccaggaactggcagaggccggggacgcccc

SEQ ID NO: 65989 - DNA, 201 bp, Homo sapiens
cccgggttcatgccattctcctgcttcagcctccagagtagctgggactacaggtgcccgccaccacgcgtggctgattttttttttttttttttttttgkatttttagtagagacggggtttcaccgtgtcagccaggatggtctcgatctcctgacctcgtgatccgcccgcctcagcctcccaaagtgctgggattac

SEQ ID NO: 65990 - DNA, 201 bp, Homo sapiens
gtcaggctccgccccggctgtgccggaagcttctgcctcccccaaacagcggcgctccatcatccgtgaccggggacccatgtatgatgaccccaccctghctgaaggctggacacggaagcttaagcaaaggaaatctggccgctctgctgggaagtatgatgtgtatttgatcaagtaagtaagagcaactcctatctc

SEQ ID NO: 65991 - DNA, 201 bp, Homo sapiens
tcaggctccgccccggctgtgccggaagcttctgcctcccccaaacagcggcgctccatcatccgtgaccggggacccatgtatgatgaccccaccctgcstgaaggctggacacggaagcttaagcaaaggaaatctggccgctctgctgggaagtatgatgtgtatttgatcaagtaagtaagagcaactcctatctct

SEQ ID NO: 65992 - DNA, 201 bp, Homo sapiens
tgaccaaacccctgggattagatctccatcgggtccctcccctcaccctaacctcacatgcagtggttcctgagaagctgctgtttatctgatcacgggakccagcaggatctgagggctcattcactgaatctgtactacccaacaaggcaggcttgtccttacccacacttttcaggtgaaaacttaatcagattcaag

SEQ ID NO: 65993 - DNA, 201 bp, Homo sapiens
taagttgttgaagtaggtattattaatgaacgaacgtctattttagctccaagagcccctggtcttccagaagagactcccaatgatcttccagaagcagstgggcttcttttggtcctcccccacccaggtgcagtcccgttctccctgcctgggtgagtttgattcctctgccgtggaataggctaggctgctacctct

SEQ ID NO: 65994 - DNA, 201 bp, Homo sapiens
tatcaacaagaaatggagaaagccagcagctgaggacagaaaagtcatgcacagtgtcagtgtctatggaaacaggccacttggaccttgaggactaggtatttggaattggaggtgagcttggcctggtgagtctctaaccacttgtgtgtaggatcagtgtgagaaccctgctagaatatagtggcagagatgcaaggg

SEQ ID NO: 65995 - DNA, 201 bp, Homo sapiens
tgtccccacagtccccagggaaaagcctttcgctctaaagtggagttgattgcgtacttcgaaaaggtaggcgacacatccctggaccctaatgattttgrcttcacggtaactgggagagggagcccctcccggcgagagcagaaaccacctaagaagcccaaatctcccaaagctccaggaactggcagaggccgggga

SEQ ID NO: 65996 - DNA, 201 bp, Homo sapiens
ggctcaagtgatcctcccacctctgccccccaaagtgctgggccaccacgcctggtgtggtgtcaccagagatgagccaccatgccctgcctgatactttwcttttatcatctgtttatttcttgtttatgggtgtttctgttctgattttatgactattctgtattctaagatttctctgagaatattatttgtttcctc

SEQ ID NO: 65997 - DNA, 201 bp, Homo sapiens
gctgtgccggaagcttctgcctcccccaaacagcggcgctccatcatccgtgaccggggacccatgtatgatgaccccaccctgcctgaaggctggacacrgaagcttaagcaaaggaaatctggccgctctgctgggaagtatgatgtgtatttgatcaagtaagtaagagcaactcctatctctacagggcagggaggg

SEQ ID NO: 65998 - DNA, 201 bp, Homo sapiens
ctctaaagtggagttgattgcgtacttcgaaaaggtaggcgacacatccctggaccctaatgattttgacttcacggtaactgggagagggagcccctccyggcgagagcagaaaccacctaagaagcccaaatctcccaaagctccaggaactggcagaggccggggacgccccaaagggagcggcaccacgagacccaa

SEQ ID NO: 65999 - DNA, 201 bp, Homo sapiens
ttctgcctcccccaaacagcggcgctccatcatccgtgaccggggacccatgtatgatgaccccaccctgcctgaaggctggacacggaagcttaagcaarggaaatctggccgctctgctgggaagtatgatgtgtatttgatcaagtaagtaagagcaactcctatctctacagggcagggagggcagggacaaggatc

SEQ ID NO: 66000 - DNA, 201 bp, Homo sapiens
aagggtcctggagaaaagtcctgggaagctccttgtcaagatgccttttcaaacttcgccagggggcaaggctgaggggggtggggccaccacatccaccyaggtcatggtgatcaaacgccccggcaggaagcgaaaagctgaggccgaccctcaggccattcccaagaaacggggccgaaagccggggagtgtggtggc

SEQ ID NO: 66001 - DNA, 201 bp, Homo sapiens
ccccggcaggaagcgaaaagctgaggccgaccctcaggccattcccaagaaacggggccgaaagccggggagtgtggtggcagccgctgccgccgaggccraaaagaaagccgtgaaggagtcttctatccgatctgtgcaggagaccgtactccccatcaagaagcgcaagacccgggagacggtcagcatcgaggtcaa

SEQ ID NO: 66002 - DNA, 201 bp, Homo sapiens
ccggggagtgtggtggcagccgctgccgccgaggccaaaaagaaagccgtgaaggagtcttctatccgatctgtgcaggagaccgtactccccatcaagargcgcaagacccgggagacggtcagcatcgaggtcaaggaagtggtgaagcccctgctggtgtccaccctcggtgagaagagcgggaaaggactgaagacc

SEQ ID NO: 66003 - DNA, 201 bp, Homo sapiens
caccaccaccatcaccaccactcagagtccccaaaggcccccgtgccactgctcccacccctgcccccacctccacctgagcccgagagctccgaggaccycaccagcccccctgagccccaggacttgagcagcagcgtctgcaaagaggagaagatgcccagaggaggctcactggagagcgacggctgccccaaggag

SEQ ID NO: 66004 - DNA, 201 bp, Homo sapiens; identical to SEQ ID NO: 51350

SEQ ID NO: 66005 - DNA, 201 bp, Homo sapiens; identical to SEQ ID NO: 51352

SEQ ID NO: 66006 - DNA, 201 bp, Homo sapiens
gagctccgaggaccccaccagcccccctgagccccaggacttgagcagcagcgtctgcaaagaggagaagatgcccagaggaggctcactggagagcgacrgctgccccaaggagccagctaagactcagcccgcggttgccaccgccgccacggccgcagaaaagtacaaacaccgaggggagggagagcgcaaagacat

SEQ ID NO: 66007 - DNA, 201 bp, Homo sapiens; identical to SEQ ID NO: 51354

SEQ ID NO: 66008 - DNA, 201 bp, Homo sapiens
tcctgggaagctccttgtcaagatgccttttcaaacttcgccagggggcaaggctgaggggggtggggccaccacatccacccaggtcatggtgatcaaaygccccggcaggaagcgaaaagctgaggccgaccctcaggccattcccaagaaacggggccgaaagccggggagtgtggtggcagccgctgccgccgaggc

SEQ ID NO: 66009 - DNA, 201 bp, Homo sapiens
aaggctggacacggaagcttaagcaaaggaaatctggccgctctgctgggaagtatgatgtgtatttgatcaagtaagtaagagcaactcctatctctacrgggcagggagggcagggacaaggatccctcatggagcaggaaaatgtatgtgcccagggtggggtcggggggaacataaacaatgaacactgagaccagg

SEQ ID NO: 66010 - DNA, 201 bp, Homo sapiens
agaggaggctcactggagagcgacggctgccccaaggagccagctaagactcagcccgcggttgccaccgccgccacggccgcagaaaagtacaaacaccraggggagggagagcgcaaagacattgtttcatcctccatgccaaggccaaacagagaggagcctgtggacagccggacgcccgtgaccgagagagttagc

SEQ ID NO: 66011 - DNA, 201 bp, Homo sapiens
ctcatgctgcccctgccttggggtcaggttgacaggaggttggagggaaagccttaagctgcaggattctcaccagctgtgtccggcccagttttggggtstgacctcaatttcaattttgtctgtacttgaacattatgaagatgggggcctctttcagtgaatttgtgaacagcagaattgaccgacagctttccagta

SEQ ID NO: 66012 - DNA, 201 bp, Homo sapiens
gtttgctgcaattttataaggacttcctgattggtttctcttctccccttccatttctgccttttgttcatttcatcctttcacttctttcccttcctccrtcctcctccttcctagttcatcccttctcttccaggcagccgcggtgcccaaccacacttgtcggctccagtccccagaactctgcctgccctttgtcct

SEQ ID NO: 66013 - DNA, 201 bp, Homo sapiens
cattgctatggagagcctctaattgttccttgtgtctttctgtttgtccccacagtccccagggaaaagcctttcgctctaaagtggagttgattgcgtasttcgaaaaggtaggcgacacatccctggaccctaatgattttgacttcacggtaactgggagagggagcccctcccggcgagagcagaaaccacctaaga

SEQ ID NO: 66014 - DNA, 201 bp, Homo sapiens
atggagagcctctaattgttccttgtgtctttctgtttgtccccacagtccccagggaaaagcctttcgctctaaagtggagttgattgcgtacttcgaawaggtaggcgacacatccctggaccctaatgattttgacttcacggtaactgggagagggagcccctcccggcgagagcagaaaccacctaagaagcccaa

SEQ ID NO: 66015 - DNA, 201 bp, Homo sapiens
tgtctttctgtttgtccccacagtccccagggaaaagcctttcgctctaaagtggagttgattgcgtacttcgaaaaggtaggcgacacatccctggaccstaatgattttgacttcacggtaactgggagagggagcccctcccggcgagagcagaaaccacctaagaagcccaaatctcccaaagctccaggaactggc

SEQ ID NO: 66016 - DNA, 201 bp, Homo sapiens
aaaccaggttttgttccgcccagtggattcttgttttgcttcccctccccccgagattattaccaccatcccgtgcttttaaggaaaggcaagattgatgwttccttgaggggagccaggaggggatgtgtgtgtgcagagctgaagagctggggagaatggggctgggcccacccaagcaggaggctgggacgctctgct

SEQ ID NO: 66017 - DNA, 201 bp, Homo sapiens
tgtttgtccccacagtccccagggaaaagcctttcgctctaaagtggagttgattgcgtacttcgaaaaggtaggcgacacatccctggaccctaatgatwttgacttcacggtaactgggagagggagcccctcccggcgagagcagaaaccacctaagaagcccaaatctcccaaagctccaggaactggcagaggccg

SEQ ID NO: 66018 - DNA, 201 bp, Homo sapiens
tgcagctcttcctggacaggccaggtggtgggcattctctctccaaggtgtgccccgtgggcattactgtttaagacacttccgtcacatcccaccccatyctccagggctcaacactgtgacatctctattccccaccctccccttcccagggcaataaaatgaccatggagggggcttgcactctcttggctgtcaccc

SEQ ID NO: 66019 - DNA, 201 bp, Homo sapiens
aggcagttcgcagcaagagttgtagttcccttgctttgccctgagggccaggactttacactagatttttttgttgcattcctgcactcataaagtacacstaaacttagaggtggtgtgttaaatgctagaacttaaaactgagttcagctaggctcaagtgccccacaatttttgtcccaccagacaatttcatgaata

SEQ ID NO: 66020 - DNA, 201 bp, Homo sapiens
gacatcagaagggtcaggctccgccccggctgtgccggaagcttctgcctcccccaaacagcggcgctccatcatccgtgaccggggacccatgtatgatkaccccaccctgcctgaaggctggacacggaagcttaagcaaaggaaatctggccgctctgctgggaagtatgatgtgtatttgatcaagtaagtaagagc

SEQ ID NO: 66021 - DNA, 201 bp, Homo sapiens
aagataaggtagatcagaagaccaaatagacaaatgccatgtccactgttttctgtcacagttgatagccataccagtcacccaagctggaaacccaacasgcccctgcccttcactgcccacatccaagggagccaccaagtcccacaaattgttcctttaactgtttgtccctcttttgtcttctgtcatcccttctac

SEQ ID NO: 66022 - DNA, 201 bp, Homo sapiens
agggtcaggctccgccccggctgtgccggaagcttctgcctcccccaaacagcggcgctccatcatccgtgaccggggacccatgtatgatgaccccaccstgcctgaaggctggacacggaagcttaagcaaaggaaatctggccgctctgctgggaagtatgatgtgtatttgatcaagtaagtaagagcaactcctat

SEQ ID NO: 66023 - DNA, 201 bp, Homo sapiens
gctcaacactgtgacatctctattccccaccctccccttcccagggcaataaaatgaccatggagggggcttgcactctcttggctgtcacccgatcgccmgcaaaacttagatgtgagaaaaccccttcccattccatggcgaaaacatctccttagaaaagccattaccctcattaggcatggttttgggctcccaaaa

SEQ ID NO: 66024 - DNA, 201 bp, Homo sapiens
tgatagccataccagtcacccaagctggaaacccaacaggcccctgcccttcactgcccacatccaagggagccaccaagtcccacaaattgttcctttawctgtttgtccctcttttgtcttctgtcatcccttctaccgctgtcctggttcaatccctcatcttgctctgggactcccatgataacttatgatctttcc

SEQ ID NO: 66025 - DNA, 201 bp, Homo sapiens
catcatccgtgaccggggacccatgtatgatgaccccaccctgcctgaaggctggacacggaagcttaagcaaaggaaatctggccgctctgctgggaagkatgatgtgtatttgatcaagtaagtaagagcaactcctatctctacagggcagggagggcagggacaaggatccctcatggagcaggaaaatgtatgtgc

SEQ ID NO: 66026 - DNA, 201 bp, Homo sapiens
cgccccggctgtgccggaagcttctgcctcccccaaacagcggcgctccatcatccgtgaccggggacccatgtatgatgaccccaccctgcctgaaggcyggacacggaagcttaagcaaaggaaatctggccgctctgctgggaagtatgatgtgtatttgatcaagtaagtaagagcaactcctatctctacagggca

SEQ ID NO: 66027 - DNA, 201 bp, Homo sapiens
ccttctgttgctgctgcttttcttatggacatagccctcagcagtccaggactgcttgtagttcctcccaggtaccatgtttcttgcactcctggcctttstcattggctcccctgcccaagtccccttctcttctcctttccttcccctgtggccttgccttgtcgtgcttatccttgaagaccctgtcaggtatctctt

SEQ ID NO: 66028 - DNA, 201 bp, Homo sapiens
taggatgcctttgtgtatgcagtggctctaggtgactctggcagccacactctgggccctaaacttctggaggaagatacaggatagggaggaactcaggsgtgagtcatggtggggacaagacattccctcactctaagaccttgtcactagattggaacatctcttgcctccctacacctgacctgatggttctggaga

SEQ ID NO: 66029 - DNA, 201 bp, Homo sapiens
cccatgtatgatgaccccaccctgcctgaaggctggacacggaagcttaagcaaaggaaatctggccgctctgctgggaagtatgatgtgtatttgatcargtaagtaagagcaactcctatctctacagggcagggagggcagggacaaggatccctcatggagcaggaaaatgtatgtgcccagggtggggtcgggggg

SEQ ID NO: 66030 - DNA, 201 bp, Homo sapiens
accatccgctctgccctatctctgacattgctatggagagcctctaattgttccttgtgtctttctgtttgtccccacagtccccagggaaaagcctttckctctaaagtggagttgattgcgtacttcgaaaaggtaggcgacacatccctggaccctaatgattttgacttcacggtaactgggagagggagcccctcc

SEQ ID NO: 66031 - DNA, 201 bp, Homo sapiens
atacatgtttctaagttgggcgtggtagctcatctgtagtcccagctacttgagagcctgaggcaggaggatcgcttgagcccagcctgggcagcacagcragaccctatctccctaaaaaaaactttttcgttgtttagttttgggatttttttttttcctggtcttttttccccctttttgtgaataacgggatctcac

SEQ ID NO: 66032 - DNA, 201 bp, Homo sapiens
cagggaaaagcctttcgctctaaagtggagttgattgcgtacttcgaaaaggtaggcgacacatccctggaccctaatgattttgacttcacggtaactgkgagagggagcccctcccggcgagagcagaaaccacctaagaagcccaaatctcccaaagctccaggaactggcagaggccggggacgccccaaagggagc

SEQ ID NO: 66033 - DNA, 201 bp, Homo sapiens
tatcttgtatccggagagaatttgcacgctggagggagctgcagccatgtagtcttcagccctatctggattcttctctttgttctaagaactgtgttggwtgtcttactaaggctcactctagctgcacgagggatgtgtgtgccatttccatggggatagggggcacctcagtctctgggtggttccataatctgtgta

SEQ ID NO: 66034 - DNA, 201 bp, Homo sapiens
ggcaccacgagacccaaggcggccacgtcagagggtgtgcaggtgaaaagggtcctggagaaaagtcctgggaagctccttgtcaagatgccttttcaaasttcgccagggggcaaggctgaggggggtggggccaccacatccacccaggtcatggtgatcaaacgccccggcaggaagcgaaaagctgaggccgaccct

SEQ ID NO: 66035 - DNA, 201 bp, Homo sapiens
tcgagaccagcctggccaacatgccaaaacctcgtctctactaaaaatacaaaattagccgggcatggtggcacacacctgtagttccagctactcgggakgctgaggcaggagaatcacttgaaccgggaggcagtggtcacagtgagccaagattgtgccagtgtactccagcctgggcaacaagagcaatactccgtc

SEQ ID NO: 66036 - DNA, 201 bp, Homo sapiens
ttcgccagggggcaaggctgaggggggtggggccaccacatccacccaggtcatggtgatcaaacgccccggcaggaagcgaaaagctgaggccgaccctyaggccattcccaagaaacggggccgaaagccggggagtgtggtggcagccgctgccgccgaggccaaaaagaaagccgtgaaggagtcttctatccgatc

SEQ ID NO: 66037 - DNA, 201 bp, Homo sapiens
taaggacagacttggtctctcttccatggggctggttcttgagccgccagggatggggggaggacctgggtagctgctgcgctgccccttctctgctgtgrtggagtggcccgttgcctgcggggtctgtctctgaagggtggtttggagaagttctgtggaggcgaggcaggggtcagctcttgccccatggaccctcag

SEQ ID NO: 66038 - DNA, 201 bp, Homo sapiens
aaaagcaaggagagcagccccaaggggcgcagcagcagcgcctcctcaccccccaagaaggagcaccaccaccatcaccaccactcagagtccccaaaggsccccgtgccactgctcccacccctgcccccacctccacctgagcccgagagctccgaggaccccaccagcccccctgagccccaggacttgagcagcagc

SEQ ID NO: 66039 - DNA, 201 bp, Homo sapiens
gtggtcttcctgcctcagcctcctgcgtagctaggactacaagcacgtgccactatgcctggctaatttttaaattttttgtagacatgggctggtgtgtstctgtgttgtctaggctggtcttgaactcctgggctcaagtgatcctcccacctctgccccccaaagtgctgggccaccacgcctggtgtggtgtcacca

SEQ ID NO: 66040 - DNA, 201 bp, Homo sapiens
tctactaaaccatgttggccaggctggttttgaactcctgacctcaagtgatctgcccgcctcggcctcccaaagttctaggattataggcgtgagccacyatgcccagcccctttgtctcttttaacaagaacagcctacccacctctccttcacttgtgatactgactttttgaagcagtcagcccaattgtcatctag

SEQ ID NO: 66041 - DNA, 201 bp, Homo sapiens
agcattgccagtaacacaggccaccctgtgcagaagggagctggctccagcctggaaacctgtctgaggttgggagaggtgcacttggggcacagggagargccgggacacacttagctggagatgtctctaaaagccctgtatcgtattcaccttcagtttttgtgttttgggacaattactttagaaaataagtaggtc

SEQ ID NO: 66042 - DNA, 201 bp, Homo sapiens
gtccccacagtccccagggaaaagcctttcgctctaaagtggagttgattgcgtacttcgaaaaggtaggcgacacatccctggaccctaatgattttgamttcacggtaactgggagagggagcccctcccggcgagagcagaaaccacctaagaagcccaaatctcccaaagctccaggaactggcagaggccggggac

SEQ ID NO: 66043 - DNA, 201 bp, Homo sapiens
cccacagtccccagggaaaagcctttcgctctaaagtggagttgattgcgtacttcgaaaaggtaggcgacacatccctggaccctaatgattttgacttsacggtaactgggagagggagcccctcccggcgagagcagaaaccacctaagaagcccaaatctcccaaagctccaggaactggcagaggccggggacgcc

SEQ ID NO: 66044 - DNA, 201 bp, Homo sapiens
ccacagtccccagggaaaagcctttcgctctaaagtggagttgattgcgtacttcgaaaaggtaggcgacacatccctggaccctaatgattttgacttcrcggtaactgggagagggagcccctcccggcgagagcagaaaccacctaagaagcccaaatctcccaaagctccaggaactggcagaggccggggacgccc

SEQ ID NO: 66045 - DNA, 201 bp, Homo sapiens
ccagggaaaagcctttcgctctaaagtggagttgattgcgtacttcgaaaaggtaggcgacacatccctggaccctaatgattttgacttcacggtaactdggagagggagcccctcccggcgagagcagaaaccacctaagaagcccaaatctcccaaagctccaggaactggcagaggccggggacgccccaaagggag

SEQ ID NO: 66046 - DNA, 201 bp, Homo sapiens
taaagtggagttgattgcgtacttcgaaaaggtaggcgacacatccctggaccctaatgattttgacttcacggtaactgggagagggagcccctcccggygagagcagaaaccacctaagaagcccaaatctcccaaagctccaggaactggcagaggccggggacgccccaaagggagcggcaccacgagacccaaggc

SEQ ID NO: 66047 - DNA, 201 bp, Homo sapiens
aagccggggagtgtggtggcagccgctgccgccgaggccaaaaagaaagccgtgaaggagtcttctatccgatctgtgcaggagaccgtactccccatcargaagcgcaagacccgggagacggtcagcatcgaggtcaaggaagtggtgaagcccctgctggtgtccaccctcggtgagaagagcgggaaaggactgaag

SEQ ID NO: 66048 - DNA, 201 bp, Homo sapiens
ggagttgattgcgtacttcgaaaaggtaggcgacacatccctggaccctaatgattttgacttcacggtaactgggagagggagcccctcccggcgagagyagaaaccacctaagaagcccaaatctcccaaagctccaggaactggcagaggccggggacgccccaaagggagcggcaccacgagacccaaggcggccac

SEQ ID NO: 66049 - DNA, 201 bp, Homo sapiens
cccctcccggcgagagcagaaaccacctaagaagcccaaatctcccaaagctccaggaactggcagaggccggggacgccccaaagggagcggcaccacgwgacccaaggcggccacgtcagagggtgtgcaggtgaaaagggtcctggagaaaagtcctgggaagctccttgtcaagatgccttttcaaacttcgccagg

SEQ ID NO: 66050 - DNA, 201 bp, Homo sapiens
aaaccacctaagaagcccaaatctcccaaagctccaggaactggcagaggccggggacgccccaaagggagcggcaccacgagacccaaggcggccacgtmagagggtgtgcaggtgaaaagggtcctggagaaaagtcctgggaagctccttgtcaagatgccttttcaaacttcgccagggggcaaggctgaggggggt

SEQ ID NO: 66051 - DNA, 201 bp, Homo sapiens
ggcctttgtcattggctcccctgcccaagtccccttctcttctcctttccttcccctgtggccttgccttgtcgtgcttatccttgaagaccctgtcaggyatctcttccccaaagagccctgcctaaccaccgcccccctcccccccgcgacacacacacctgggttaggccctgcctctccacgcctgtgcctcctgcc

SEQ ID NO: 66052 - DNA, 201 bp, Homo sapiens
accacctaagaagcccaaatctcccaaagctccaggaactggcagaggccggggacgccccaaagggagcggcaccacgagacccaaggcggccacgtcakagggtgtgcaggtgaaaagggtcctggagaaaagtcctgggaagctccttgtcaagatgccttttcaaacttcgccagggggcaaggctgaggggggtgg

SEQ ID NO: 66053 - DNA, 201 bp, Homo sapiens
gtcgtgcttatccttgaagaccctgtcaggtatctcttccccaaagagccctgcctaaccaccgcccccctcccccccgcgacacacacacctgggttagkccctgcctctccacgcctgtgcctcctgccaagtcctcagaggtctctgatcccatgtgcctccaggcatggcatagggggactgtgacacagcctctcg

SEQ ID NO: 66054 - DNA, 201 bp, Homo sapiens
gtttgtccccacagtccccagggaaaagcctttcgctctaaagtggagttgattgcgtacttcgaaaaggtaggcgacacatccctggaccctaatgattbtgacttcacggtaactgggagagggagcccctcccggcgagagcagaaaccacctaagaagcccaaatctcccaaagctccaggaactggcagaggccgg

SEQ ID NO: 66055 - DNA, 201 bp, Homo sapiens
gtgcctccaggcatggcatagggggactgtgacacagcctctcggcccacagacccctgattgtgggcttgctcactgccccagtcagtcctcttattgakgattccgtgccagttcctgactccagcacacacacgcatgtaggccgccctcctagtgcctggctccttccctgtctcttctgccactcattcccatggt

SEQ ID NO: 66056 - DNA, 201 bp, Homo sapiens
tgtcaagatgccttttcaaacttcgccagggggcaaggctgaggggggtggggccaccacatccacccaggtcatggtgatcaaacgccccggcaggaagygaaaagctgaggccgaccctcaggccattcccaagaaacggggccgaaagccggggagtgtggtggcagccgctgccgccgaggccaaaaagaaagccgt

SEQ ID NO: 66057 - DNA, 201 bp, Homo sapiens
gagtgggaagttctcaaggtagcaggccctctatcctctccacacctcaagtctttatctggggatggaatagctgcggaagcagaggaacttgcagagcyaggggttcagaggggtgaagaagcatgtttcagttctgccttttaaatgatcccaaaaaggttagcagttttcaaatgacatttgcagacagcctcattt

SEQ ID NO: 66058 - DNA, 201 bp, Homo sapiens
agcagcagcgcctcctcaccccccaagaaggagcaccaccaccatcaccaccactcagagtccccaaaggcccccgtgccactgctcccacccctgccccyacctccacctgagcccgagagctccgaggaccccaccagcccccctgagccccaggacttgagcagcagcgtctgcaaagaggagaagatgcccagagga

SEQ ID NO: 66059 - DNA, 201 bp, Homo sapiens
tggagagactgagcaccgtacctgagttcaaacttgggaatgttctagatggtgactcaggcccaggcaccaaccagcagaatgggcctcagcctgacaayccttctgtaccaggcctgactctttggttgctgaactttggagaggcctgggggggtcagcggcaggcagacgagtgagtggctttggtgacaggtcctc

SEQ ID NO: 66060 - DNA, 201 bp, Homo sapiens
gggggactgtgacacagcctctcggcccacagacccctgattgtgggcttgctcactgccccagtcagtcctcttattgaggattccgtgccagttcctgwctccagcacacacacgcatgtaggccgccctcctagtgcctggctccttccctgtctcttctgccactcattcccatggtcgtatcctggagttggtcat

SEQ ID NO: 66061 - DNA, 201 bp, Homo sapiens
agtgatcaggaaccatagttgacagttccaatcagtagcttaagaaaaaaccgtgtttgtctcttctggaatggttagaagtgagggagtttgccccgttstgtttgtagagtctcatagttggactttctagcatatatgtgtccatttccttatgctgtaaaagcaagtcctgcaaccaaactcccatcagcccaatcc

SEQ ID NO: 66062 - DNA, 201 bp, Homo sapiens
ataaagtgttttgcaaatttactggatgatatcctactatgtggaacatcctacaacttactcttttcactcaacatttgacttttgaacctggtctgtaytgctccgtgcagaccaatgttcattcatttgatatgtctccttgtgccatagaaatagttttacaatagaagcctgtccagagccatgagggagaagggg

SEQ ID NO: 66063 - DNA, 201 bp, Homo sapiens
ctcagagtccccaaaggcccccgtgccactgctcccacccctgcccccacctccacctgagcccgagagctccgaggaccccaccagcccccctgagcccyaggacttgagcagcagcgtctgcaaagaggagaagatgcccagaggaggctcactggagagcgacggctgccccaaggagccagctaagactcagcccgc

SEQ ID NO: 66064 - DNA, 201 bp, Homo sapiens
cctatgctgggctctgtatccttgtctccaagcagtctcgtgtgacagggaagttacctattattgtatggtcccctcttcttgtcacctctggtgtggcwcttgttccatttcttgttcaatgaatgtgatttgtgaatgtgccacatctgtgggaggaaggcagttcgcagcaagagttgtagttcccttgctttgccc

SEQ ID NO: 66065 - DNA, 201 bp, Homo sapiens; identical to SEQ ID NO: 51360

SEQ ID NO: 66066 - DNA, 201 bp, Homo sapiens; identical to SEQ ID NO: 51361

SEQ ID NO: 66067 - DNA, 201 bp, Homo sapiens
cgaggtcaggagatcgagaccatcctggcgagcacggtgaaacctcgtctttactaaaaatacaaaaaattagccgggcatggtggcgggcgcctgtagtyccagctactctgagagcctgaggcaggagaatggcgtgaacccaggaggcggagcttgcagtgagccgagatcgcgtcactgcactccagcctgggcgac

SEQ ID NO: 66068 - DNA, 201 bp, Homo sapiens
gaagcccaaatctcccaaagctccaggaactggcagaggccggggacgccccaaagggagcggcaccacgagacccaaggcggccacgtcagagggtgtgyaggtgaaaagggtcctggagaaaagtcctgggaagctccttgtcaagatgccttttcaaacttcgccagggggcaaggctgaggggggtggggccaccac

SEQ ID NO: 66069 - DNA, 201 bp, Homo sapiens
catcttggccacgctggtcttgaactcctgacctcgtgatccacccgcttcagcctcccaaagtgcagggattacaggcgtgagccaccgcacccagcctytggctcttttctttttgacatgaaatcttaagttaattatcttaaactttaagaactagaaggattcttagtccagcaccatcagtttacaaacaaaaaa

SEQ ID NO: 66070 - DNA, 201 bp, Homo sapiens
aaatctcccaaagctccaggaactggcagaggccggggacgccccaaagggagcggcaccacgagacccaaggcggccacgtcagagggtgtgcaggtgawaagggtcctggagaaaagtcctgggaagctccttgtcaagatgccttttcaaacttcgccagggggcaaggctgaggggggtggggccaccacatccacc

SEQ ID NO: 66071 - DNA, 201 bp, Homo sapiens
gaaacggggccgaaagccggggagtgtggtggcagccgctgccgccgaggccaaaaagaaagccgtgaaggagtcttctatccgatctgtgcaggagaccrtactccccatcaagaagcgcaagacccgggagacggtcagcatcgaggtcaaggaagtggtgaagcccctgctggtgtccaccctcggtgagaagagcgg

SEQ ID NO: 66072 - DNA, 201 bp, Homo sapiens
gtggctttcttgttagcactggcctatcacaccttcctattgcctgttaactaaaattttgcctggaatgctttaagcttagagtactgggtctttgtttyacccgattgataggagagtgtcatgcagtcagccgaactccgacttctgtgctgtttaaatccttaggtaggtctggggcaaggcacaaaccactgtgta

SEQ ID NO: 66073 - DNA, 201 bp, Homo sapiens
aaagggagcggcaccacgagacccaaggcggccacgtcagagggtgtgcaggtgaaaagggtcctggagaaaagtcctgggaagctccttgtcaagatgcsttttcaaacttcgccagggggcaaggctgaggggggtggggccaccacatccacccaggtcatggtgatcaaacgccccggcaggaagcgaaaagctgag

SEQ ID NO: 66074 - DNA, 201 bp, Homo sapiens
atcttctcttgctgttttcccctctgagctatcgcgtgcaggcttgttatcttgtatccggagagaatttgcacgctggagggagctgcagccatgtagtyttcagccctatctggattcttctctttgttctaagaactgtgttggatgtcttactaaggctcactctagctgcacgagggatgtgtgtgccatttccat

SEQ ID NO: 66075 - DNA, 201 bp, Homo sapiens
ctagggcactggtggttcaggtccttctatttgccaccggcaaaccgtacttctgccagtctggctcttaggcccagtttctctgatcttgcagattttcytgggctctgctacggaatcctcatacctccggcaggtccctcctttgcccatgtgtttaactgtggtggaatcgtgtgagagctgcttctctcgcatgga

SEQ ID NO: 66076 - DNA, 201 bp, Homo sapiens
caagatgccttttcaaacttcgccagggggcaaggctgaggggggtggggccaccacatccacccaggtcatggtgatcaaacgccccggcaggaagcgawaagctgaggccgaccctcaggccattcccaagaaacggggccgaaagccggggagtgtggtggcagccgctgccgccgaggccaaaaagaaagccgtgaa

SEQ ID NO: 66077 - DNA, 201 bp, Homo sapiens
tttgtctcttctggaatggttagaagtgagggagtttgccccgttctgtttgtagagtctcatagttggactttctagcatatatgtgtccatttccttaygctgtaaaagcaagtcctgcaaccaaactcccatcagcccaatccctgatccctgatcccttccacctgctctgctgatgacccccccagcttcacttct

SEQ ID NO: 66078 - DNA, 201 bp, Homo sapiens
gggtggggccaccacatccacccaggtcatggtgatcaaacgccccggcaggaagcgaaaagctgaggccgaccctcaggccattcccaagaaacggggcygaaagccggggagtgtggtggcagccgctgccgccgaggccaaaaagaaagccgtgaaggagtcttctatccgatctgtgcaggagaccgtactccccat

SEQ ID NO: 66079 - DNA, 201 bp, Homo sapiens
ccccctcccaccctttccctcaagtccccaaagtccattgtatcattctgatgcctttgcatcctcatagcttagctcccacttatgagtgagaacatacrgtgtttggttttccattcctgagttacttcacttagaataatagtctctagttccatccaggttgctgtgaatgccattaagtcattcctttttatggct

SEQ ID NO: 66080 - DNA, 201 bp, Homo sapiens
gagagactgagcaccgtacctgagttcaaacttgggaatgttctagatggtgactcaggcccaggcaccaaccagcagaatgggcctcagcctgacaaccsttctgtaccaggcctgactctttggttgctgaactttggagaggcctgggggggtcagcggcaggcagacgagtgagtggctttggtgacaggtcctcag

SEQ ID NO: 66081 - DNA, 201 bp, Homo sapiens
ggggggtcagcggcaggcagacgagtgagtggctttggtgacaggtcctcaggggcagccaggcagtgtgactctcgttcaatagtaacgtttgtcagagygttgtcaccaccatccgctctgccctatctctgacattgctatggagagcctctaattgttccttgtgtctttctgtttgtccccacagtccccagggaa

SEQ ID NO: 66082 - DNA, 201 bp, Homo sapiens
tgtatttggggagggttctgcttttggttggcaagaactgcattttatttaagcttagcaaaacataactggtttctcgcatcttctcaaaagtggaggaytaagaaatggactgcgaattcagagcagggcagctgaacctcaggctccacccttgtagccttcaagctgaacctcattctctcttgctccctggagacc

SEQ ID NO: 66083 - DNA, 201 bp, Homo sapiens
gcagacgagtgagtggctttggtgacaggtcctcaggggcagccaggcagtgtgactctcgttcaatagtaacgtttgtcagagcgttgtcaccaccatcygctctgccctatctctgacattgctatggagagcctctaattgttccttgtgtctttctgtttgtccccacagtccccagggaaaagcctttcgctctaa

SEQ ID NO: 66084 - DNA, 201 bp, Homo sapiens
ccttacttcatattttgtaggtattttaagattttgtaaaggcctttctgcttcaacgtgtgatgtgtgcattcttagaaaaagatcttgtgttctgtaawtcacacaataaaaacatgagttcgtgcaggaaaaactggggcggggtggatcactccaaacttgtgtggtgtggtaactggagctcactgatgaaaccat

SEQ ID NO: 66085 - DNA, 201 bp, Homo sapiens
tgcctgaaggctggacacggaagcttaagcaaaggaaatctggccgctctgctgggaagtatgatgtgtatttgatcaagtaagtaagagcaactcctatstctacagggcagggagggcagggacaaggatccctcatggagcaggaaaatgtatgtgcccagggtggggtcggggggaacataaacaatgaacactgag

SEQ ID NO: 66086 - DNA, 201 bp, Homo sapiens
ggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctc

SEQ ID NO: 66087 - DNA, 201 bp, Homo sapiens
gggcctacaggcgcacatcaccacgcccagttaatttattataataataataataattattttgagacggaatctcgctttgtcaccaggctggagtgcartggtgccatctcggctcactgcaacctccaactcctgggtttaagcgattctcctgcctcagcctccccagtagctgggattacaggcatgcgccaccac

SEQ ID NO: 66088 - DNA, 201 bp, Homo sapiens
tagctgttcatggaagggtaagaggtctgagacaggcactgaagagggccagttgctgggacagtgtccattcctacgctgccagacgtgagggatggctragtccttttggactctattgctgtgggtgttctgggctgtgggaatcagtaggtctgatcccaaatggcagtttctgtgccgtcccacacggtctgctgg

SEQ ID NO: 66089 - DNA, 201 bp, Homo sapiens
gaatcactggagtttccttgggtgaggccctagagctggtagtttggcttctaatgctgaggcctaaagcataattgttgacgggtggttctggagcgatktgtgcaaaaccagtgaaagatgaacactgggccattttaagatggaaacaaggtgggggttggatagagagttatatgcagcctcttttgcacctcgttg

SEQ ID NO: 66090 - DNA, 201 bp, Homo sapiens
agtgcagcaacacatttctctgacatcagctgcttgaggaatgaatttttgaaaggagttactaaactgtaactgaatatttgtattaacttaaaaaaaawtgaatcgtaagcctgctgctgttgagacagatgatccgaattggtctttttatctttcctgtgttttggttgtcttcagttattttctggtcacttttta

SEQ ID NO: 66091 - DNA, 201 bp, Homo sapiens
taatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctt

SEQ ID NO: 66092 - DNA, 201 bp, Homo sapiens
agtgacttaaaaaattttactgttggtctgtgttaatgagaaactgtccttttttgagagggagcctccctctgttccccagggtggagtgcagtggtgcratcttggctgactgcaacctccgcctcccaggttcaagtgattctcctgcttcagcttcccaagtagctgggattagaggcgcccaccaccacgcccggc

SEQ ID NO: 66093 - DNA, 201 bp, Homo sapiens
tgatgtgatctcggctcactgcagcctcgatctctcaggctcaagtgattctctcgcctcagtctcccttaaaaattgttaaaaaataatttggaacttcrtgtgtcttttgtattgcttgatagcagcatagaatatgtgaggtatttttggctactttgtgaattagccttttcatctctcatttctgagtgctagatc

SEQ ID NO: 66094 - DNA, 201 bp, Homo sapiens
taccagagaaacggagtctgaaactcttgaagagccacaatctcaatgtgaattggtacatgtactgccccgagagcgccgtgatcttgctgtctaccacrgtcctggagaatgtcctgcagccttttcactttagggtaagaggaagcctcccctgaaaaaaacacctttccccagttgtcccctgttcctgtagcatcc

SEQ ID NO: 66095 - DNA, 201 bp, Homo sapiens
cctttccagtgttaagtgagtcagacagagcatcgctgcccgtgatagccactgtttttgataaactcaaccatgagtataaaaagtacctggatgccgascagagttatgcgatggtgagttacatggagtatgacaaagggtcctcctcccccaccccctcccgggtattttctaagtaattatgatgcaaaattgttt

SEQ ID NO: 66096 - DNA, 201 bp, Homo sapiens
gggtccacatcgaagaattcagtccttgtggatgaactgtaaacagcacccttcctctaagatgccgaagatcatagtttgtggtttttttctttcaggcrgtggaagcagggcagagccgaagcagcccgctcctcaagaggccggtgcggacccaggcggtgctggaccagtcagatgtgtacacccatgtcctgtcag

SEQ ID NO: 66097 - DNA, 201 bp, Homo sapiens
ggtcctgaagtcctcctccgggcagctgtgaataacactccgagagccaccccgcaggcagcttccctgactgtccaggggcctcgcgtttagcgtggacycagtacatggtgggcaggggcgagtgctagcggaaactgggtttgctttttgttttcatcttttcctggtttagaatttcctataacatgtggattcttc

SEQ ID NO: 66098 - DNA, 201 bp, Homo sapiens
cctgctatagcttttttttttttttttttttttaaccgtaaccagaaaggggttgcgaatgacatctagctgtcaggtctttaaagtattgtatttcttaragtgtcctttaaaggtacttttgcattggtaaccttttgagattagtttttatcatagcaacgtgtggaaattctgaagctgacatgaagttggtttgat

SEQ ID NO: 66099 - DNA, 201 bp, Homo sapiens
atctaagtagagaaagtgttttccgctcatatcctgggtccacatcgaagaattcagtccttgtggatgaactgtaaacagcacccttcctctaagatgcygaagatcatagtttgtggtttttttctttcaggcggtggaagcagggcagagccgaagcagcccgctcctcaagaggccggtgcggacccaggcggtgct

SEQ ID NO: 66100 - DNA, 201 bp, Homo sapiens
aaaaaattgaatcgtaagcctgctgctgttgagacagatgatccgaattggtctttttatctttcctgtgttttggttgtcttcagttattttctggtcaytttttaagttaatatttatttttcttgtcttgtagtatgccaacgtaggttggcagtatgctgcctaatccaaatttgtgtgtgtctgtgtgtttttcct

SEQ ID NO: 66101 - DNA, 201 bp, Homo sapiens
taggtcactttgagtgagctcatcaaaggaagcatgtcataaatgcaggaaatacttgtgagaggagataaaaatattaaaagagagttgtgatgttaatsacaaattccttctcaagtaagagctagcctgtagggaggaaatgcaaacacaggcttttaaactgatttaaacagcaagatgggatggaatgaaagcaac

SEQ ID NO: 66102 - DNA, 201 bp, Homo sapiens
cctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcag

SEQ ID NO: 66103 - DNA, 201 bp, Homo sapiens
aaacgagtgagcccgtgataatctagattgggggctctaagaagtttgtgggtggggggaaggtactgaatttaacttaaaaagagtttttagactgggcrcggtggctcatgcctgtaatcccagcactttgggaggccgaggcgggtggatcacttgagatcaggagttcgagaccagcctggccagcatggtgaaacc

SEQ ID NO: 66104 - DNA, 201 bp, Homo sapiens
gaaaaaaaaaaaaaattggcaaaatgtctgaataagactagaaagtgcatttttatgctaagagttttggtcttccagatggaaatgggtttggtagtctyaagtagtttagaaaaaagtgattgtgtcagttgattaaagataattcaaaactatttcagaaactaacgcttgagatttgaccttggaagaaggtgggaa

SEQ ID NO: 66105 - DNA, 201 bp, Homo sapiens
acttctgattcttctgtggcctaaaacagtggcccaaactttcaaactttatggtagttagtataatgttctttcatttcttcttcctttttttttaaacrtactcttctgtggcattcctgtttatttttaaattttttttggagagtgtcgctctgttgcccaggctggagtgcagtgttacaatctcagctcaccaca

SEQ ID NO: 66106 - DNA, 201 bp, Homo sapiens
cctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagtt

SEQ ID NO: 66107 - DNA, 201 bp, Homo sapiens
ttagctgttcatggaagggtaagaggtctgagacaggcactgaagagggccagttgctgggacagtgtccattcctacgctgccagacgtgagggatggcygagtccttttggactctattgctgtgggtgttctgggctgtgggaatcagtaggtctgatcccaaatggcagtttctgtgccgtcccacacggtctgctg

SEQ ID NO: 66108 - DNA, 201 bp, Homo sapiens
aagagttatgggcaaaaatcagggaacattgtatttaaaagaaaatttgttttgttaattagtaaacattccggggaacgttcattaaagaatgacaaacygcagagtttgtgaagcttttgaagagagttatatgtgttttttcttattaattaaaaatatttttaaaaaatttttcttagactaagaatgccaacattc

SEQ ID NO: 66109 - DNA, 201 bp, Homo sapiens
ccccgaaaagtttccttgggcccttctgtaatccatcccttgagttttttttttttaaatgaatttttaatttaaaaaatgtatgtattggaatagagacrgggtctcactgtgttgctgaggctggtctcgaattcctgtgatcctcctgcttcatcctctcacagtgctgggattacaggtgtaggccgctgtgcccag

SEQ ID NO: 66110 - DNA, 201 bp, Homo sapiens
actctgtatcctttactaaggtgtggcaccgtgcacaacagggcaagtggtcaccctcagagagtggtcctgaagtcctcctccgggcagctgtgaataamactccgagagccaccccgcaggcagcttccctgactgtccaggggcctcgcgtttagcgtggactcagtacatggtgggcaggggcgagtgctagcggaa

SEQ ID NO: 66111 - DNA, 201 bp, Homo sapiens
aggcgaaccctgtcaactgcgtcttcttcgatgaggccaacaagcaggtccggcgcgcccgcgcttcctcccccgcgcggccctgccggggtcgtgggcgygccaaggccggtcccgcgcgaccaggcccgagcgtcccctcctgtcctgtcccgtcccgtcccagcgcgggaggcggcgcgcgctccttccttgttgggt

SEQ ID NO: 66112 - DNA, 201 bp, Homo sapiens
cagcccgctcctcaagaggccggtgcggacccaggcggtgctggaccagtcagatgtgtacacccatgtcctgtcagccttcgtggaaaagaaggtgggcygcagctttccgcctcttctggactgagaatgctcaaaacaaggaagttgctgaaaacgaggagacttcatgtgattagagtcacttgaagtgattagaat

SEQ ID NO: 66113 - DNA, 201 bp, Homo sapiens
tcaagggtttagacgtcgagattttcattttccttgaaattttgtaaagggggaaaagactgtacttcaggcgtatcagcggcgccgatgcgcgaaccggygttagaacttggagcctcgggaacccgacccggtgtcacggtggcatccttttcgctctctgctcttggtttttaaaattcacctgagcagccaaacatc

SEQ ID NO: 66114 - DNA, 201 bp, Homo sapiens
  misc_feature (1)...(201): n = A,T,C or G, or insertion/deletion polymorphism (see Tables 1-2)
aagcagggcagagccgaagcagcccgctcctcaagaggccggtgcggacccaggcggtgctggaccagtcagatgtgtacacccatgtcctgtcagccttngtggaaaagaaggtgggccgcagctttccgcctcttctggactgagaatgctcaaaacaaggaagttgctgaaaacgaggagacttcatgtgattagagt

SEQ ID NO: 66115 - DNA, 201 bp, Homo sapiens
attagaataaggtcgctgagatttgccgcctgccatagggcaaggtggcagtagtgggggatagtggaggagtagtaaattcagggtccctgcatcccackagctggcggctgcatctcacttcataccttcactgtttttgtttttcccatctgtgtttgatcttgcctgtagatccttggtctactgttatagatgaga

SEQ ID NO: 66116 - DNA, 201 bp, Homo sapiens
aggggaatgttgtatataaacttttgcagctagctttttttttttttgtccaaagtgtatcttggacatctttctatattttattctgactgggtagtatyccactgtatggatggactgcagtttaaaaattttcttgttattggacattggctggttttccatttttttgtgattacaaataacccttcagtaacatgc

SEQ ID NO: 66117 - DNA, 201 bp, Homo sapiens
gcatagtcccagttcgcactgttgaacaggtttaatgatcaacagcagggcctttcactttcagaagtgtctcgatttggatgataagctatctggccacygtaacactggtgcttacagaaggtgaaagtataatgtaggccctcaattcagtagtgacttaaaaaattttactgttggtctgtgttaatgagaaactgt

SEQ ID NO: 66118 - DNA, 201 bp, Homo sapiens
ttggatcccagttgtagccagggacgttttcaaggtgaatctcttagaaatgacccctcctttcaagcgtgggaatgggatttttttttttcactttatamgttttttactatatgtgcattttatcaagaacatatactacttttaataattaaagcaacaactaagaatgccattctcctgcttaagcccattctggaa

SEQ ID NO: 66119 - DNA, 201 bp, Homo sapiens
gctggaatacacacaggagtgcaaggtatgaccccaggccctttctcagctgctggtgtcagtggtgttgagctgggttatgtagtggagagcggggcatyggggtcgcagggagcacagacttgaagtcagactgtccctcatgttgattcccaaactggagtcaggcggggtgtttgctttgtgacactgaacagtttt

SEQ ID NO: 66120 - DNA, 201 bp, Homo sapiens
ttttctgactgcatcgttgcacttatgttttctcaatttgtaggtcctgctgccgtgaccagccagtctcctgttccatgtaaactctgtatcctttactraggtgtggcaccgtgcacaacagggcaagtggtcaccctcagagagtggtcctgaagtcctcctccgggcagctgtgaataacactccgagagccacccc

SEQ ID NO: 66121 - DNA, 201 bp, Homo sapiens
gcataattgttgacgggtggttctggagcgatgtgtgcaaaaccagtgaaagatgaacactgggccattttaagatggaaacaaggtgggggttggatagrgagttatatgcagcctcttttgcacctcgttggtatttgtaagaccacatttttttctccctaggagatgcctcataaatttgtgatagccgtgctgatg

SEQ ID NO: 66122 - DNA, 201 bp, Homo sapiens
atggatgacagtgctgggggataatggttttgaggccgtgtggaccaggacaactagaatgggtcctgtgggctgggcctctgatataaagaagctgcttmcctcctctaccctcccagagggtggtgacgctaactctgtgacacgtgaggatgtttccagttgaaatgacagagatctgcttaggtcactttgagtgag

SEQ ID NO: 66123 - DNA, 201 bp, Homo sapiens
ttgattaaagataattcaaaactatttcagaaactaacgcttgagatttgaccttggaagaaggtgggaatccgctccattccacgagtacttgaactctstgttgcaattgtgagcatggatgacagtgctgggggataatggttttgaggccgtgtggaccaggacaactagaatgggtcctgtgggctgggcctctga

SEQ ID NO: 66124 - DNA, 201 bp, Homo sapiens
cataaatgcaggaaatacttgtgagaggagataaaaatattaaaagagagttgtgatgttaatgacaaattccttctcaagtaagagctagcctgtagggwggaaatgcaaacacaggcttttaaactgatttaaacagcaagatgggatggaatgaaagcaactgggcaaaccatgattgattttggcctcagtcttgtc

SEQ ID NO: 66125 - DNA, 201 bp, Homo sapiens
caaagacatggaatcatcctaaatgcccatcagtgacagattggataaagaaaatgtggtacatatataccatggaatactatgcagccataaaaatgaayaagatcatgtcttttgtgggaacatggatggagctggaggccatcatccttagcaaactaacacaggaacagaaaaccaaataccacatgttctcacttc

SEQ ID NO: 66126 - DNA, 201 bp, Homo sapiens
gtcaccctcagagagtggtcctgaagtcctcctccgggcagctgtgaataacactccgagagccaccccgcaggcagcttccctgactgtccaggggcctygcgtttagcgtggactcagtacatggtgggcaggggcgagtgctagcggaaactgggtttgctttttgttttcatcttttcctggtttagaatttcctat

SEQ ID NO: 66127 - DNA, 201 bp, Homo sapiens
gcaagactccgtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaa

SEQ ID NO: 66128 - DNA, 201 bp, Homo sapiens
gacctccaacagcacaggagcggaggtggtcctctatcatctaccacggtagatttcatgctttgttttccctctctctctgattttaaaatgtgaactgyagcttgttgatctgttttttgctttctatcctacagagaaggtgcctgtaaaaagatgcacatattgaagttaaataggacgggaaagtttgccctgaac

SEQ ID NO: 66129 - DNA, 201 bp, Homo sapiens
aatttagaatgtatggttagagaaaatacacctgtgtgttaatgccatggtgctttgctgtaaggccatcatcgaaatcttagtaatgactggctgggcayggtggctcatgcctgtaatcctagcactttgggaggccgaggtgggcgatcatctgaggtcaggagttcgagaccagcctggccgccatggcgaaacccc

SEQ ID NO: 66130 - DNA, 201 bp, Homo sapiens
ctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccat

SEQ ID NO: 66131 - DNA, 201 bp, Homo sapiens
tggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaatt

SEQ ID NO: 66132 - DNA, 201 bp, Homo sapiens
tcatctttggagaaatgactaattcgggtcattgtgcctatttttaaaatcaaattactattatttgttgaattgtagttctttatatattctgatattarcaccttcttagagatacaatttgcaagtattttctccgaatccggaggttgcctttccactctgtggattgtgtcctttgatgtacctgcctgtttcttt

SEQ ID NO: 66133 - DNA, 201 bp, Homo sapiens
tgtgttggttagaatagccagtccttggggagcctctagtctgttgtagctgaatgatttggaagtgttctttcactttttacttttgtcctcagcattayctacatgaacttgttatcaaaacccttgtccagcacaacctcttttatatgctgcatcagttcctgcagtaccacgtcctcagcgactccaaacctttgg

SEQ ID NO: 66134 - DNA, 201 bp, Homo sapiens
ggcagcttccctgactgtccaggggcctcgcgtttagcgtggactcagtacatggtgggcaggggcgagtgctagcggaaactgggtttgctttttgtttycatcttttcctggtttagaatttcctataacatgtggattcttcatcttggattgtctttcaacctgacatcattatcagcgcaagccaaggtaggtcag

SEQ ID NO: 66135 - DNA, 201 bp, Homo sapiens
cattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttaga

SEQ ID NO: 66136 - DNA, 201 bp, Homo sapiens
agcccaacacaaattcttaaactttcttaaaacattatgagatttttttaatgatattttttaagctcatcagctattgttagtgttagtgtattttatgygtggcccaagaccattcttcttcttcctcttaaggcccagggaagccaaaacattggacacccctggcttagaaccttcagctctgttccggtggtacag

SEQ ID NO: 66137 - DNA, 201 bp, Homo sapiens
tgggtctcaatctgactacatattaggatcatctggggggccttaaaaatgaaagctctcacctgacagtgtgtaggtcagccacccaaaggtgagggctrtgcactcggcgcagaccttgacacttaggtccaaagcgcgagtgctcttcgccaaagcttgtctgcctgggctctttcctacctttgggtggtctgttca

SEQ ID NO: 66138 - DNA, 201 bp, Homo sapiens
gcttataatcccagcactctgggaggctgaagcaggaggattgcctgagcctaggagttcgagaccagcctggacgacaacatggcaaaaccctgtctctmcaaaaaaaaaaaaaaaaaaaaaaaaaattagctgagtttggtggtatacacctgtggccccagctactccagaggctgccgagggaggattccttgagcc

SEQ ID NO: 66139 - DNA, 201 bp, Homo sapiens
ttcagtccttgtggatgaactgtaaacagcacccttcctctaagatgccgaagatcatagtttgtggtttttttctttcaggcggtggaagcagggcagarccgaagcagcccgctcctcaagaggccggtgcggacccaggcggtgctggaccagtcagatgtgtacacccatgtcctgtcagccttcgtggaaaagaag

SEQ ID NO: 66140 - DNA, 201 bp, Homo sapiens
gtgcccttttctgttctgcatgagcccgggaggtgtgctcctctttctggccttgctgaggaagcctcctcagtctgttaattgtctcttcctgggtaatytctttattagagaaatcttttttttttttttttttttttttgagacggagttttgctcgttgcccaggctggagtgcaatggcgtgatcttggctcactg

SEQ ID NO: 66141 - DNA, 201 bp, Homo sapiens
gggtattttctaagtaattatgatgcaaaattgtttcctatatattagaataaggtcgctgagatttgccgcctgccatagggcaaggtggcagtagtggkggatagtggaggagtagtaaattcagggtccctgcatcccacgagctggcggctgcatctcacttcataccttcactgtttttgtttttcccatctgtgt

SEQ ID NO: 66142 - DNA, 201 bp, Homo sapiens
cattctcctgcttaagcccattctggaaaagccagactccaccccagggtggatggaaagccggactccaccccagggtgtctccctcatttctcccatcraccttcccaccggtgtccgtgcccttttctgttctgcatgagcccgggaggtgtgctcctctttctggccttgctgaggaagcctcctcagtctgttaat

SEQ ID NO: 66143 - DNA, 201 bp, Homo sapiens
gaacgctgaggcaggagaatcacgtgaacccgagaggcagaggttgcagtgagccgagatcatgccactgcactgtagcctgggcaacagagcaagactcygtctcaaaaaaaaaaaaaaaaagatttttaaaagcagctttattgaggcatagttgacacataataaactgtacacacttaatattatgcaatatgtgag

SEQ ID NO: 66144 - DNA, 201 bp, Homo sapiens
ttagtctcttgctggggattttattctttttttttttttttataattgcaagtaataaattaaaaaaaaaaaaaagaaaagaaaaagggcttggtggcccrtgcctgtaattccagctctttggaaggccaaggtgggtggatggcttgagtccaggagtctgagaccagccaggccaacatgatgaaatcccatctctat

SEQ ID NO: 66145 - DNA, 201 bp, Homo sapiens
tggctactttgtgaattagccttttcatctctcatttctgagtgctagatctgataggagcagatattccaagttgaagcagcctacaggcactttagccygtgtaaatgttcaccattgccgtttgtagagtagagggaaggctgttagaaacaggcagaatcctctgttagtttcttccatcagttttaagtgttaaag

SEQ ID NO: 66146 - DNA, 201 bp, Homo sapiens
ctgactgccctgtcttgctggaccagccaaaagcttagttactttctggcacagttggaggaaggagctggttcttaacagacgttcaattaggtcttttkgctttctgtgttctttcaagcttcttccttttcctttgtaaataatgttagtattgaaagaatagattttgccaagtgattgtcttgtgtctgctgccca

SEQ ID NO: 66147 - DNA, 201 bp, Homo sapiens
ttttgtccaaagtgtatcttggacatctttctatattttattctgactgggtagtattccactgtatggatggactgcagtttaaaaattttcttgttatkggacattggctggttttccatttttttgtgattacaaataacccttcagtaacatgcttgtacacacttctttatattagagggagagttgcagtatagg

SEQ ID NO: 66148 - DNA, 201 bp, Homo sapiens
tctctcccggctctcttttgaaggagattggagtgcagaattggctagtctgaggtttcagtgtgcaagacgtagtcagatggctcacatttggaaccctrgtagtaatgttttattctttgtccgatggcattgggcgggttgacccagcctgcagtcaggatttccttgtaccgttcacccgggagttcagaatcgcac

SEQ ID NO: 66149 - DNA, 201 bp, Homo sapiens
aacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccttgactacaattgaataaacatttcgtaatgacattaaa

SEQ ID NO: 66150 - DNA, 201 bp, Homo sapiens
ttttgccaggggccatttgttccagttttgttgttgttttgagacagtctcactgagtcacccaggctggtaggtagtgtcgtgatcttggctcactacartctccacctcctgggttcaagtgattatcctgcctcagcctcccaagtagtggggattacaggtgtgtgccaccgtgcccagctaatttttatatttttt

SEQ ID NO: 66151 - DNA, 201 bp, Homo sapiens
ctgagctttagaatggatagttttgattagccgttgatggtgaaatatgttttaatattgaatacacccgtaacgttttctgtttgccttagctctgtaaygctgaaattaactttggctgtaggtttgttactgtaacctgggatcacttttctctttctcacattccgtgtgacagtgatgatgaatattgcattcttt

SEQ ID NO: 66152 - DNA, 201 bp, Homo sapiens
catgctttctttttcttggtgagattttcctggattgtcagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgca

SEQ ID NO: 66153 - DNA, 201 bp, Homo sapiens
aacatttgagtgaaagtgggcagatacatattttttactaaaaggaaaccactcactattcaggtcacacaaaagcataatcacatacacacacacacacmccccccacacacaccccattgttaagctaggtcaacagtaaatgaatgaatgaatgaatgaatgaatgaatgaacaaatggacaagcaaacagcagaatt

SEQ ID NO: 66154 - DNA, 201 bp, Homo sapiens
gaaagttgagaatctgaatacagatttaattaacactctctttgcttgtgaaccccttgggaagtcagccttatcctggtttgaagaattccacttcagcrtttggaatggtgcattttgaaatgtgataggaagaacagcttgtgacacaacacaattcagagaaagcagtggggttaggttcgcaccaaagggttatcg

SEQ ID NO: 66155 - DNA, 201 bp, Homo sapiens
tatgaagggagtgaaaagcagttattccagattagccttaactctgttaacgcttcttttaattgggaggtctctgaatggaaacattttctcacaacagkcatagcatcacttcctactccaggggtgcaatgtccagccctcaccactcctgggcagggaaccatgtactgtaggcatcatccgggaacctttggtttt

SEQ ID NO: 66156 - DNA, 201 bp, Homo sapiens
tcactctgcattttgtgcaaataaacagctgtaaatcataacgttatgatactctcagtgtttaatcataggtcctgcagagatcagcagcttataagaayacaaaatatgcctacttaccaaagtcaagattcagaagctcccagatgaaaagttctaggcttatgagataactctactctctgggacacattaactggt

SEQ ID NO: 66157 - DNA, 201 bp, Homo sapiens
ttctcacaacaggcatagcatcacttcctactccaggggtgcaatgtccagccctcaccactcctgggcagggaaccatgtactgtaggcatcatccgggracctttggttttaataccacttgttactttggctgcaacgctggattcacactcataggagacagcactctcagctgcagaccttcaggacaatggacag

SEQ ID NO: 66158 - DNA, 201 bp, Homo sapiens
ttctgacactcgtggagaattcaatgttggctccacctgccatttctcttgtgacaacggctttaagctggaggggcccaataatgtggaatgcacaactkctggaagatggtcagctactccaccaacctgcaaaggtaataatatgtacttgctaagacagttctacttttggaaatttattctacaacaacaaacaat

SEQ ID NO: 66159 - DNA, 201 bp, Homo sapiens
caaccacaaccactactccaagtgtcatctcccttatgaaatccacaccaatcccattagaagtaatgtgtcacaggcatttcacttctgtccttcctcaygtcacaagctaaagctaatacacaagtactcagagacttaaaggaagaaacatttgcagatgtccaagatgtgttagaaaaatagacatattaaatgtaa

SEQ ID NO: 66160 - DNA, 201 bp, Homo sapiens
catctttgtaccagtgcagttgcaaaatagaatttttaatatgttagcatggaggaagaagcctacataggcaaagttgcctgaagtctatgaaagtcatratgcagccctggctatatcagaatgaagtctttaaggcaaaacaatgccctggaaatgtcagcaagggaggtacaagcatgactaaccctcatgcaggca

SEQ ID NO: 66161 - DNA, 201 bp, Homo sapiens
tagaagtaatgtgtcacaggcatttcacttctgtccttcctcatgtcacaagctaaagctaatacacaagtactcagagacttaaaggaagaaacatttgyagatgtccaagatgtgttagaaaaatagacatattaaatgtaaaacctgctatagaaattggtaaactagaagttgcatattatgtgacagtataaacat

SEQ ID NO: 66162 - DNA, 201 bp, Homo sapiens
ttttgtgtattaatgttctggtcggaaattcatctgagtatgcagaagcatacttgggatcacggcctcttttttggtgaggggtactaacctggcactcmctctcctttactctagaactaacaaaccagaaagaagtggcagcatggacttatcattacagcacaaaagcatactcatggaatatttcccgtaaatact

SEQ ID NO: 66163 - DNA, 201 bp, Homo sapiens
gttgcatattatgtgacagtataaacattccatattttcataataatttgaacctaaataaaaagttaagccatacatgatatttcctgaagagctatcgycctacacataaagcattgagacctatgtttctttcatttttgtatcccccacaaaacatagcacagtgctttgcaaatgtcactactgataaataacatt

SEQ ID NO: 66164 - DNA, 201 bp, Homo sapiens
aaagttgtaattctgggagattatgaaaaagttatttttgtgaaaatgttcacagatgacttcatgtctaggagttacaccagtagacatgtttcaaaaakgtttagtaaattgatttgatgtgtcagatatgaagttgttaattactcaacaatttgagagtactgaactgaaattcactgtgttattttggctatttga

SEQ ID NO: 66165 - DNA, 201 bp, Homo sapiens
attgagacctatgtttctttcatttttgtatcccccacaaaacatagcacagtgctttgcaaatgtcactactgataaataacatttatttgaattaaatytaatttcttgacctttaatttcctatccataaattagaaagaataaccctgaagttccctgaaaatgtagtttaaggaggatgacagtctacttctttca

SEQ ID NO: 66166 - DNA, 201 bp, Homo sapiens
ctgtacattggttttccatgagggagcatataggtcttgaagaggtttgtaaaaatcaaactatctaagtaaatgagacttatctgaccaaggtattgttktcagaatagccttagatttaaagaaagaatagtcacttcatttgtctataacccaacatttattgataaataatagtcttatattagagaattaatgggg

SEQ ID NO: 66167 - DNA, 201 bp, Homo sapiens
acagtgctttgcaaatgtcactactgataaataacatttatttgaattaaatctaatttcttgacctttaatttcctatccataaattagaaagaataacsctgaagttccctgaaaatgtagtttaaggaggatgacagtctacttctttcaaacttccagtgtccagatatgctgaacacttattaagtatttcaataa

SEQ ID NO: 66168 - DNA, 201 bp, Homo sapiens
gatggcaccagaggctgcagaaggccaagaatcaagctagaaggccacatgtcaccgtggaccttcctgccaccagtcactgtccctcaaatgacccaaasaccaatattcaaatgcgtaattaaaagaattttccccaaatgccgtgttcctctattttatggtttgttcagtaaggtctgtatacatcacattgtttac

SEQ ID NO: 66169 - DNA, 201 bp, Homo sapiens
cgtatatctcactataataaaaaattgaacagcaaaaaaaaaaaaaaagaaaaaacaagaaggcaatagaatagatggctatacaccatgatgctgacacytagtctgagttatggaatgtattgtatatgttatctgggagaaaaagacacaatgagctctttgacacacttaaaacggatcataagggattattcaagc

SEQ ID NO: 66170 - DNA, 201 bp, Homo sapiens
gagtgtaatggcacaatctcggcccactgcaacctccgcctcccgggttcaagcaattctcctgtctcagcttcccgagtagctgggactacaggtgcccrccactgcacccagctaatttttgtatttttggtagagatgaggtttcaccatcttagctaggctggtctcaaactcctgacctcaggtgatctgcctgac

SEQ ID NO: 66171 - DNA, 201 bp, Homo sapiens
cactttggccaggctggtctcaaactcccgacctcaagtgattcactcacatcagcctctcaaagtgctgggattataggtgtgagccattgtgctcagcyggatttttggttcttaaatgctctgagtctgtaaaaaccagaggtcaaagcccagagcaaagaggtagtctttacactttgaaaagtttcagaaatagcc

SEQ ID NO: 66172 - DNA, 201 bp, Homo sapiens
gagtgaaagtgggcagatacatattttttactaaaaggaaaccactcactattcaggtcacacaaaagcataatcacatacacacacacacaccccccccmcacacaccccattgttaagctaggtcaacagtaaatgaatgaatgaatgaatgaatgaatgaatgaacaaatggacaagcaaacagcagaattgaatgtc

SEQ ID NO: 66173 - DNA, 201 bp, Homo sapiens
gaaatagctttttcttcttcctttaatgctcttcttcctgcttctcactggctggtttcttgcagtcattcttctctccacttaaacattatctcattaawgaggtcttccctgacgttcctgaccaacatagtgacacagtcattctatcacataagtttcatttcctacctagcacttatggctatattctgttaatat

SEQ ID NO: 66174 - DNA, 201 bp, Homo sapiens
gtttgtttgtttgttttgagacagagtctcactctgtcgcccaggctgaagtgcagtggcacgatctcagctcactgcaacctctgcctcccaggttcaarcgattctcctgcctcagcctcccgaatagctaggattacaggcaactttttgtatttttaatagagactagggtttcaccactttggccaggctggtctc

SEQ ID NO: 66175 - DNA, 201 bp, Homo sapiens
ttgagtgaaagtgggcagatacatattttttactaaaaggaaaccactcactattcaggtcacacaaaagcataatcacatacacacacacacaccccccmcacacacaccccattgttaagctaggtcaacagtaaatgaatgaatgaatgaatgaatgaatgaatgaacaaatggacaagcaaacagcagaattgaatg

SEQ ID NO: 66176 - DNA, 201 bp, Homo sapiens
tcttaatacctataccaatatttcgaatcatctctggcatacgaatgtatttatatccaaaggcaaagctctggaataaataagaaattagtaaaaggtayaatttttctcttataaagtgggagaaaggtgtattttaggcagattgtttttaagaaagtatatatgtgaaagttgagaatctgaatacagatttaatta

SEQ ID NO: 66177 - DNA, 201 bp, Homo sapiens
tttgtttgtttgtttgtttgttttgagacagagtctcactctgtcgcccaggctgaagtgcagtggcacgatctcagctcactgcaacctctgcctcccargttcaaacgattctcctgcctcagcctcccgaatagctaggattacaggcaactttttgtatttttaatagagactagggtttcaccactttggccaggc

SEQ ID NO: 66178 - DNA, 201 bp, Homo sapiens
gtttgtttgtttgtttgtttgtttgtttgttttgagacagagtctcactctgtcgcccaggctgaagtgcagtggcacgatctcagctcactgcaacctcygcctcccaggttcaaacgattctcctgcctcagcctcccgaatagctaggattacaggcaactttttgtatttttaatagagactagggtttcaccactt

SEQ ID NO: 66179 - DNA, 201 bp, Homo sapiens
gtttttgtttgtttgtttgtttgtttgtttgtttgtttgttttgagacagagtctcactctgtcgcccaggctgaagtgcagtggcacgatctcagctcastgcaacctctgcctcccaggttcaaacgattctcctgcctcagcctcccgaatagctaggattacaggcaactttttgtatttttaatagagactagggt

SEQ ID NO: 66180 - DNA, 201 bp, Homo sapiens
tagaggattttggtgtttttgtttgtttgtttgtttgtttgtttgtttgtttgttttgagacagagtctcactctgtcgcccaggctgaagtgcagtggcrcgatctcagctcactgcaacctctgcctcccaggttcaaacgattctcctgcctcagcctcccgaatagctaggattacaggcaactttttgtattttta

SEQ ID NO: 66181 - DNA, 201 bp, Homo sapiens
agagagaaacactagaggattttggtgtttttgtttgtttgtttgtttgtttgtttgtttgtttgttttgagacagagtctcactctgtcgcccaggctgragtgcagtggcacgatctcagctcactgcaacctctgcctcccaggttcaaacgattctcctgcctcagcctcccgaatagctaggattacaggcaactt

SEQ ID NO: 66182 - DNA, 201 bp, Homo sapiens
tttcttgcctaaaacataagagagaagagagaaacactagaggattttggtgtttttgtttgtttgtttgtttgtttgtttgtttgtttgttttgagacasagtctcactctgtcgcccaggctgaagtgcagtggcacgatctcagctcactgcaacctctgcctcccaggttcaaacgattctcctgcctcagcctccc

SEQ ID NO: 66183 - DNA, 201 bp, Homo sapiens
aataaacaaaacaattagtgaggagattcaaatggaagaaatagtttgaggcagaaagcaatcattgcagttttaggtgtgttgaatttgagaagatggcrtgatatatgggagcaagtagtctcaggcaagaggaagggcggaaatgaaatcctggattgcacccattcaagtaagatagagggagctgcggcaggctac

SEQ ID NO: 66184 - DNA, 201 bp, Homo sapiens
tatgtaagatccaccttgaaatggactggaaaattcataaatactctcactcatcctcttgtcctataacccaaggatcccaaatgcaaatgcctccgggrgataggcagattacacaagtgtcaggatgtctggccatagacagtagggcatggcccttgctaactccttatcagggtctttacccagacctgaaggctc

SEQ ID NO: 66185 - DNA, 201 bp, Homo sapiens
catctgcactgagcattggcatgcctttctttatcagatattcactgagaacctactatgggccatgtcctttgtgcttgggaccagggatgagatgaaayggtgcgtgaagccagtcttaggcacatgtccactatagtatagtcaaggtgaggtttgcactgattgacacatatagggtgcattggaatgaagaagatg

SEQ ID NO: 66186 - DNA, 201 bp, Homo sapiens
tcgaatcatctctggcatacgaatgtatttatatccaaaggcaaagctctggaataaataagaaattagtaaaaggtataatttttctcttataaagtggragaaaggtgtattttaggcagattgtttttaagaaagtatatatgtgaaagttgagaatctgaatacagatttaattaacactctctttgcttgtgaacc

SEQ ID NO: 66187 - DNA, 201 bp, Homo sapiens
tatcctggtttgaagaattccacttcagcatttggaatggtgcattttgaaatgtgataggaagaacagcttgtgacacaacacaattcagagaaagcagyggggttaggttcgcaccaaagggttatcgatcactctgcattttgtgcaaataaacagctgtaaatcataacgttatgatactctcagtgtttaatcata

SEQ ID NO: 66188 - DNA, 201 bp, Homo sapiens
aactgccaaatagccatcttgtaccagagattccagagagtggtctttggaatttcccaactcctttgcttcagtgccctgatctctggtaaactttatgytaacttttcacttaggcctaagtaattagggtagagcccagatctatgtgtgagaaatttaaggattgtagccagttggtttgaggcatgggaaaactgt

SEQ ID NO: 66189 - DNA, 201 bp, Homo sapiens
tttaaataaacaggaaagaaacccatttccaggcctgattgcttgctttgtacacctcttcatgtgggaaatggcctctcctgccccgggtggactcccayagactatgataagagtgctgtagtacctttatacttttgaaacgcacattctttagttcatttggtatcaaaaacacttgtgaaaaagggctgttctgag

SEQ ID NO: 66190 - DNA, 201 bp, Homo sapiens
aaaagttgaagaattcagaggagaagagttcaggctgtggtgatcagcagagtcttcagagactttacgagttaaatcctggaggattagtgggattttaygccataaaagtggaaaaattctcaggggaatgtgagccaagaaccagaagcaataacacacaaagtcacttcagggaattccaagaaactaatctatctt

SEQ ID NO: 66191 - DNA, 201 bp, Homo sapiens
aagttgaagaattcagaggagaagagttcaggctgtggtgatcagcagagtcttcagagactttacgagttaaatcctggaggattagtgggattttacgycataaaagtggaaaaattctcaggggaatgtgagccaagaaccagaagcaataacacacaaagtcacttcagggaattccaagaaactaatctatcttga

SEQ ID NO: 66192 - DNA, 201 bp, Homo sapiens
aacacttctgaacctcacttttcttgcctaaaacataagagagaagagagaaacactagaggattttggtgtttttgtttgtttgtttgtttgtttgtttrtttgtttgttttgagacagagtctcactctgtcgcccaggctgaagtgcagtggcacgatctcagctcactgcaacctctgcctcccaggttcaaacgat

SEQ ID NO: 66193 - DNA, 201 bp, Homo sapiens
tgaagaattcagaggagaagagttcaggctgtggtgatcagcagagtcttcagagactttacgagttaaatcctggaggattagtgggattttacgccatraaagtggaaaaattctcaggggaatgtgagccaagaaccagaagcaataacacacaaagtcacttcagggaattccaagaaactaatctatcttgaccag

SEQ ID NO: 66194 - DNA, 201 bp, Homo sapiens
cattcaagtaagatagagggagctgcggcaggctacgaggtctctgaagcagagggtgtagagaaaatagggtgacattgtaagttcttgagtatggctgyctaaatctttgacttctttgtcttcgtgacttgtacctatactcttctctgtaagcttaccatcctcccactgccctttgcagcaaatgacctacatgat

SEQ ID NO: 66195 - DNA, 201 bp, Homo sapiens
ccatgtatatttggctttctgctgaatttcttatatttctgtaccatttcttgcttctttttaaaatagcaacaacaatgactcctctgatttcttctctkggccaggagaatcatctcctcaaggatgatttttaataattttcctcatctggttttctatctctgacactgatagtttttcttaacttccttaaatagc

SEQ ID NO: 66196 - DNA, 201 bp, Homo sapiens
tctgtccttcctcatgtcacaagctaaagctaatacacaagtactcagagacttaaaggaagaaacatttgcagatgtccaagatgtgttagaaaaatagrcatattaaatgtaaaacctgctatagaaattggtaaactagaagttgcatattatgtgacagtataaacattccatattttcataataatttgaacctaa

SEQ ID NO: 66197 - DNA, 201 bp, Homo sapiens
tattgttgtcagaatagccttagatttaaagaaagaatagtcacttcatttgtctataacccaacatttattgataaataatagtcttatattagagaatyaatggggagaaaagaataatgctaagaaaatatgtaactgcaataatttgtaaaaatacttttggggggaaattgtgaattaaaatttaaattcatttat

SEQ ID NO: 66198 - DNA, 201 bp, Homo sapiens
ataggtcttgaagaggtttgtaaaaatcaaactatctaagtaaatgagacttatctgaccaaggtattgttgtcagaatagccttagatttaaagaaagawtagtcacttcatttgtctataacccaacatttattgataaataatagtcttatattagagaattaatggggagaaaagaataatgctaagaaaatatgta

SEQ ID NO: 66199 - DNA, 201 bp, Homo sapiens
taatgtacttttagtagagacagggtttcactatgttggccaggctggtcttgaattcctgacctcatgatccgcccacctcagcctcccaaagtgctggsattacaggcatgagccactgtgcctggccccaaaaacattttaaaaatattcatagatttgatgaaatcccaacagaagagagttcatgagaaataatag

SEQ ID NO: 66200 - DNA, 201 bp, Homo sapiens
aaataatattttaatagctttagttaaatattccacagtttcaagaacatcctggccaacatggtgaaaccccgtttctactaaaaatacaaaaaatagcygggcatggtggtgcatgcctgtagtcccagctactcgggaggctgaggcaggagaatcgcttgaacccaggaggtggaggttgcagtgagctgagattgt

SEQ ID NO: 66201 - DNA, 201 bp, Homo sapiens
tatattccccaagctttttccccctcaatgtatccaattccttagttaacttttatagacaatgctgctttttaaacgcaagattttcatttataaaaathtgcagaaatataataaagaaatgaagaaatatcctcttaaatactcctatcctaaaatagacactgttaggcttctggtatgaattcttccaatattttc

SEQ ID NO: 66202 - DNA, 201 bp, Homo sapiens
atgaagcatcatgaaattcaaacaatcacttttagccaaataccatcgttgtatattaatcacacacacacacacacacacacacacacacacacacacasagagagagagagggagaaagagagagagagttacagagttcaggttgctgaattataaaatgatctcttcttttctcctctgccatgcccatgatagcca

SEQ ID NO: 66203 - DNA, 201 bp, Homo sapiens
tgatgaagcatcatgaaattcaaacaatcacttttagccaaataccatcgttgtatattaatcacacacacacacacacacacacacacacacacacacasacagagagagagagggagaaagagagagagagttacagagttcaggttgctgaattataaaatgatctcttcttttctcctctgccatgcccatgatagc

SEQ ID NO: 66204 - DNA, 201 bp, Homo sapiens
aggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgc

SEQ ID NO: 66205 - DNA, 201 bp, Homo sapiens
tgataaataacatttatttgaattaaatctaatttcttgacctttaatttcctatccataaattagaaagaataaccctgaagttccctgaaaatgtagtytaaggaggatgacagtctacttctttcaaacttccagtgtccagatatgctgaacacttattaagtatttcaataaacacatactgacatgccagttgat

SEQ ID NO: 66206 - DNA, 201 bp, Homo sapiens
atttcaataaacacatactgacatgccagttgatcacaaatgtagtaataacatttagactaacagtattttaagaaccaaaattttgtaaatagtatatktggaggcaagatttatcaatgcattagcaggtatttgtcggatgctactatgtgtccatctttgcatcttggttctttggatatcacccttcgagagaat

SEQ ID NO: 66207 - DNA, 201 bp, Homo sapiens
aatttttttttaatgtacttttagtagagacagggtttcactatgttggccaggctggtcttgaattcctgacctcatgatccgcccacctcagcctcccraagtgctgggattacaggcatgagccactgtgcctggccccaaaaacattttaaaaatattcatagatttgatgaaatcccaacagaagagagttcatga

SEQ ID NO: 66208 - DNA, 201 bp, Homo sapiens
ctaatttttttttaatgtacttttagtagagacagggtttcactatgttggccaggctggtcttgaattcctgacctcatgatccgcccacctcagcctcycaaagtgctgggattacaggcatgagccactgtgcctggccccaaaaacattttaaaaatattcatagatttgatgaaatcccaacagaagagagttcat

SEQ ID NO: 66209 - DNA, 201 bp, Homo sapiens
agcacccgccaccacacctgtctaatttttttttaatgtacttttagtagagacagggtttcactatgttggccaggctggtcttgaattcctgacctcakgatccgcccacctcagcctcccaaagtgctgggattacaggcatgagccactgtgcctggccccaaaaacattttaaaaatattcatagatttgatgaaa

SEQ ID NO: 66210 - DNA, 201 bp, Homo sapiens
gataactctactctctgggacacattaactggtttgagttgagttctccctggtatctggtcaggctgtagtcaaaagtgcatgaacacatgcacacacaygaccccacactgtcccatgcaccctactgggcgtgacacatacacaaccccacactgtcccatgcaccctacataatccatcactgggcgtgacacacac

SEQ ID NO: 66211 - DNA, 201 bp, Homo sapiens
ttttgcatttttagtagagacgaggttttaccatgttgccaggctgttctcgaactcctgacctcaagtgatctgcccaccttggcctcccaaagtgctgrgattagaggcatgagccactgcaccagcccagttctttattaaagtaaaattaaagataatcatggtacttaatgaaggcttacacaggcacaggatgtt

SEQ ID NO: 66212 - DNA, 201 bp, Homo sapiens
gagtgcagtagtgccatctcagctcactgcaacctctgtctcctgggttcaagcgattctcctgtctcagccttctgagtagctgggattacaggcatgcrccaccatgcccagctaatttttgtattttttagtggagttggtttcgccatgttggcaaggctggtcttgaacttctgacctcaagggatctgcctgcct

SEQ ID NO: 66213 - DNA, 201 bp, Homo sapiens
ggagtgcagtagtgccatctcagctcactgcaacctctgtctcctgggttcaagcgattctcctgtctcagccttctgagtagctgggattacaggcatghgccaccatgcccagctaatttttgtattttttagtggagttggtttcgccatgttggcaaggctggtcttgaacttctgacctcaagggatctgcctgcc

SEQ ID NO: 66214 - DNA, 201 bp, Homo sapiens
ctgggatgggagttatggaagactcaaggatgaatcattcttgggttttagacactttcccatccagtagaagagtgagggtatgacatgggacatgacarcacatcagttcagacaaaaagttgaagaattcagaggagaagagttcaggctgtggtgatcagcagagtcttcagagactttacgagttaaatcctggag

SEQ ID NO: 66215 - DNA, 201 bp, Homo sapiens
tggagtgcagtagtgccatctcagctcactgcaacctctgtctcctgggttcaagcgattctcctgtctcagccttctgagtagctgggattacaggcatrcgccaccatgcccagctaatttttgtattttttagtggagttggtttcgccatgttggcaaggctggtcttgaacttctgacctcaagggatctgcctgc

SEQ ID NO: 66216 - DNA, 201 bp, Homo sapiens
ggctggagtgcagtagtgccatctcagctcactgcaacctctgtctcctgggttcaagcgattctcctgtctcagccttctgagtagctgggattacaggsatgcgccaccatgcccagctaatttttgtattttttagtggagttggtttcgccatgttggcaaggctggtcttgaacttctgacctcaagggatctgcc

SEQ ID NO: 66217 - DNA, 201 bp, Homo sapiens
catctgggctttgctaccaacaagttgtatagttctgcatcctcaacaactctcatattcacctcccctatttgcattcccactgatgccagaccaaaccwgtccctctttaactctcactgggaccattgcaatagcctcttcttttgcagtgcaatctccctgattgtaactcatttaaaaaaaaaaaagtatcgcact

SEQ ID NO: 66218 - DNA, 201 bp, Homo sapiens
agcaggctggagtgcagtagtgccatctcagctcactgcaacctctgtctcctgggttcaagcgattctcctgtctcagccttctgagtagctgggattasaggcatgcgccaccatgcccagctaatttttgtattttttagtggagttggtttcgccatgttggcaaggctggtcttgaacttctgacctcaagggatc

SEQ ID NO: 66219 - DNA, 201 bp, Homo sapiens
atgttggctccacctgccatttctcttgtgacaacggctttaagctggaggggcccaataatgtggaatgcacaacttctggaagatggtcagctactccrccaacctgcaaaggtaataatatgtacttgctaagacagttctacttttggaaatttattctacaacaacaaacaattatctagttcttatatgtgaact

SEQ ID NO: 66220 - DNA, 201 bp, Homo sapiens
acaatgactcctctgatttcttctcttggccaggagaatcatctcctcaaggatgatttttaataattttcctcatctggttttctatctctgacactgayagtttttcttaacttccttaaatagctcttgcaggagcctcccttgttatgaagggagtgaaaagcagttattccagattagccttaactctgttaacgc

SEQ ID NO: 66221 - DNA, 201 bp, Homo sapiens
taggatctcccaatcttcagcaggctggagtgcagtagtgccatctcagctcactgcaacctctgtctcctgggttcaagcgattctcctgtctcagcctyctgagtagctgggattacaggcatgcgccaccatgcccagctaatttttgtattttttagtggagttggtttcgccatgttggcaaggctggtcttgaac

SEQ ID NO: 66222 - DNA, 201 bp, Homo sapiens
tacttctttcaaacttccagtgtccagatatgctgaacacttattaagtatttcaataaacacatactgacatgccagttgatcacaaatgtagtaataayatttagactaacagtattttaagaaccaaaattttgtaaatagtatatttggaggcaagatttatcaatgcattagcaggtatttgtcggatgctactat

SEQ ID NO: 66223 - DNA, 201 bp, Homo sapiens
aaacttcagttatggatcaatctgctctttccattgtctagagggccagttacttaatggctctgcacaaacagcatgccaagagaatggccactggtcamctaccgtgccaacctgccaaggtacaattttcatgtgggttaagaagtcactttgatgtggaaaataacaaaatcagtgtttcttccctgtgtctttctc

SEQ ID NO: 66224 - DNA, 201 bp, Homo sapiens
gacatgccagttgatcacaaatgtagtaataacatttagactaacagtattttaagaaccaaaattttgtaaatagtatatttggaggcaagatttatcawtgcattagcaggtatttgtcggatgctactatgtgtccatctttgcatcttggttctttggatatcacccttcgagagaatattttcatatatgtgctgt

SEQ ID NO: 66225 - DNA, 201 bp, Homo sapiens
gtgatggacaaaatttgtccaaggactcacactattattctgtggttggttttagctgcccagtgcccacccctgaagattcctgaacgaggaaacatgayctgccttcattctgcaaaagcattccagcatcagtctagctgcagcttcagttgtgaagagggatttgcattagttggaccggaagtggtgcaatgcaca

SEQ ID NO: 66226 - DNA, 201 bp, Homo sapiens
aaagagaccaagtagagatggatagcttgggttaaaagtttagaaaattagagttaagagggttacacaaatagttacagctttcagcaaacatgacattsctgttaattctacatggaaaataaaaatcactattttgtctcctgcagtgagagagtgtggagaacttgagctccctcaacacgtgctcatgaactgcag

SEQ ID NO: 66227 - DNA, 201 bp, Homo sapiens
atattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttg

SEQ ID NO: 66228 - DNA, 201 bp, Homo sapiens
ttaattctacatggaaaataaaaatcactattttgtctcctgcagtgagagagtgtggagaacttgagctccctcaacacgtgctcatgaactgcagccaycctctgggaaacttctcttttaactcgcagtgcagcttccactgcactgacgggtaccaagtaaatgggcccagcaagctggaatgcttggcttctggaa

SEQ ID NO: 66229 - DNA, 201 bp, Homo sapiens
tcttgcaggagcctcccttgttatgaagggagtgaaaagcagttattccagattagccttaactctgttaacgcttcttttaattgggaggtctctgaatkgaaacattttctcacaacaggcatagcatcacttcctactccaggggtgcaatgtccagccctcaccactcctgggcagggaaccatgtactgtaggcat

SEQ ID NO: 66230 - DNA, 201 bp, Homo sapiens
actgccttggtagtcagtgaaaatagaacactaagcgtgcaataaatgcaaaccttatctgttttctatttttgtaattattcaggagtttttttttttttgccaaagttttagagtaggctcaagaatatgaccacttctcaaagttatgcacaaaagtcattcctgggtataactcttttcctgcatctgcactaatct

SEQ ID NO: 66231 - DNA, 201 bp, Homo sapiens
tacacttcttatgtcttgcatgtgtgtgtgtttgttttgtagcaggaccattgactatccaggaagccctgacttactttggtggagcggtggcttctacrataggtctgataatgggtgggacgctcctggctttgctaagaaagcgtttcagacaaaaaggtaaataggaaagagtcttctctttgcatcttggttaca

SEQ ID NO: 66232 - DNA, 201 bp, Homo sapiens
ccagattagccttaactctgttaacgcttcttttaattgggaggtctctgaatggaaacattttctcacaacaggcatagcatcacttcctactccagggktgcaatgtccagccctcaccactcctgggcagggaaccatgtactgtaggcatcatccgggaacctttggttttaataccacttgttactttggctgcaa

SEQ ID NO: 66233 - DNA, 201 bp, Homo sapiens
agtgcccagaactctttgccccagagcagggcagcctggattgttctgacactcgtggagaattcaatgttggctccacctgccatttctcttgtgacaayggctttaagctggaggggcccaataatgtggaatgcacaacttctggaagatggtcagctactccaccaacctgcaaaggtaataatatgtacttgctaa

SEQ ID NO: 66234 - DNA, 201 bp, Homo sapiens
catcaagtgcccagaactctttgccccagagcagggcagcctggattgttctgacactcgtggagaattcaatgttggctccacctgccatttctcttgtracaacggctttaagctggaggggcccaataatgtggaatgcacaacttctggaagatggtcagctactccaccaacctgcaaaggtaataatatgtactt

SEQ ID NO: 66235 - DNA, 201 bp, Homo sapiens
ttgatactctagccatcaagtgcccagaactctttgccccagagcagggcagcctggattgttctgacactcgtggagaattcaatgttggctccacctgycatttctcttgtgacaacggctttaagctggaggggcccaataatgtggaatgcacaacttctggaagatggtcagctactccaccaacctgcaaaggta

SEQ ID NO: 66236 - DNA, 201 bp, Homo sapiens
tacggtgaggcttcctttttgttgatattattttggttttatgctagagatgatgccaagaagtaaataaatcatgttgaagtctctccagtgagaatagratggtaccagcccccctctatcatctgtctcctccactcagtgtccctagacacacactctaggtaaaaacattttattcttgggagaaaacattgactc

SEQ ID NO: 66237 - DNA, 201 bp, Homo sapiens
gtgtaacatttccattattaactgctaggtggtgatgatgtggccttgcctgcaaagcagaagtcaggactgctgaaaaatgtttacgaactgttatggartcaattccctatgctacctgctggaaaaacaaaaataatctgatgctatccctctcccaaaaagtgggtagttgagtgtcctacaaaaagcctgaatggc

SEQ ID NO: 66238 - DNA, 201 bp, Homo sapiens
tgttttatctaagcttcactgttaggctacatgatgttgggatctggggcctgtcctctggctccgcagctgctgttcctcctactagaatttataggggmtctctgagaatagatcatggtaaacctgtcaccccattttccaagactgtacttctctctgggataaatgatggaataaatggaagactgggtaggtgcc

SEQ ID NO: 66239 - DNA, 201 bp, Homo sapiens
caaataaagccatcgtggtttacagaggctgtgttttatctaagcttcactgttaggctacatgatgttgggatctggggcctgtcctctggctccgcagstgctgttcctcctactagaatttataggggctctctgagaatagatcatggtaaacctgtcaccccattttccaagactgtacttctctctgggataaat

SEQ ID NO: 66240 - DNA, 201 bp, Homo sapiens
gtaagcagtctgggttgggcagaaggcagaaaaccagcagagtcacagaggagatggtgagtttatttttttctgcatgggaagtggttgaagtgagttgragtggtatggagtaaagtcaggcaggtaaaggttcagaaagtgaggaacagcgatagccatggagttttatgttgaattgcctattagattttgtgagta

SEQ ID NO: 66241 - DNA, 201 bp, Homo sapiens
cctcctttttacaatgtcttttgcaatgtcttcttttctactctgaagtaaaatacacagataacaaatattctaattaaaatataaagtaggaataaaaygaaaagtaatttataataaaaacaagatgcaaaaacttaggcgctgtgccagtagatgcaatgaggtcatcagaagcgtgcaccttccacagaatcacta

SEQ ID NO: 66242 - DNA, 201 bp, Homo sapiens
aatagattttttggtatgcatcttgattacatacttagcataaattcttgggtccaaaagcatgataacttaaaaattattgacacatgttgccaagatgytcaacaaaggtttagcatttcctaataaaatccttcatgtgccgttataattaaatgacactttttcttatcttctatgttaaacaagcccaattcagga

SEQ ID NO: 66243 - DNA, 201 bp, Homo sapiens
gggttgggcagaaggcagaaaaccagcagagtcacagaggagatggtgagtttatttttttctgcatgggaagtggttgaagtgagttggagtggtatggrgtaaagtcaggcaggtaaaggttcagaaagtgaggaacagcgatagccatggagttttatgttgaattgcctattagattttgtgagtacttttaaactt

SEQ ID NO: 66244 - DNA, 201 bp, Homo sapiens
tttttatttaacatcatacattgagacctctctcctatctttacaagttaaaatatattatttttagtgacctttaacattcttttcatggatccaccatmattaatttccaccctcaattaatggcatttgtgtttgttttcaatattccgctcttacaaataatgtcttcacaaaaatctctaaatagattttttggta

SEQ ID NO: 66245 - DNA, 201 bp, Homo sapiens
aacatggtgaaacaccatatttactaaacttacaaaaactggctgggcatgttggcatgtgcctgtaatcccagctactcaggaggctgaggcaggacaawctcttgaacccaggaggtggaggtggcagtgagttgagatcacaccactgaactccagcctgggtgacagagcaagacttgtctcaaaaacaaaacaaaa

SEQ ID NO: 66246 - DNA, 201 bp, Homo sapiens; identical to SEQ ID NO: 45944
  misc_feature (1)...(201): n = A,T,C or G, or insertion/deletion polymorphism (see Tables 1-2)

SEQ ID NO: 66247 - DNA, 201 bp, Homo sapiens
gtggggagtggtggctgccccatcttaggcattcgaagtctgaaagacttcctgcagaacagcagataaatgctaagttggcttggaagtgacctttatgktctcctatagctctgaaataacctgtaagaggtgaatcttggtatttggtgatgcatagaaacagaaaagtatgtcagattaaagcaggggatgcacact

SEQ ID NO: 66248 - DNA, 201 bp, Homo sapiens
ggcttctggtatgaattcttccaatattttctccgcttttcctcctatgcaattaatatttttatgatgtatatacaattttaacaataaagttgaatggrtaaaagactagacagttctacattatttgccatacctttcactttgtatagactttcaacatttgagtgaaagtgggcagatacatattttttactaaaa

SEQ ID NO: 66249 - DNA, 201 bp, Homo sapiens
agtggtggctgccccatcttaggcattcgaagtctgaaagacttcctgcagaacagcagataaatgctaagttggcttggaagtgacctttatgttctccyatagctctgaaataacctgtaagaggtgaatcttggtatttggtgatgcatagaaacagaaaagtatgtcagattaaagcaggggatgcacactgacttg

SEQ ID NO: 66250 - DNA, 201 bp, Homo sapiens
aagtgggtagttgagtgtcctacaaaaagcctgaatggcagaatattcgaaatctagaaagaaaagattatgctgcgcctcagggtgtagatatgatgagyaatttttttctttcttttatttttttaaggaaatgataattatttaaatttctttggtctcatttccagagacctgtccttttcctggtctcctcattca

SEQ ID NO: 66251 - DNA, 201 bp, Homo sapiens
tctgaccttttacattctgcctcatttattggcaatgttaggttacaaaagaaactataatctctttcacctccaatccacatgttgtttctcttgcattmtttcttttctgcagctgtgaaatgctcagaactacatgttaataagccaatagcgatgaactgctccaacctctggggaaacttcagttatggatcaatc

SEQ ID NO: 66252 - DNA, 201 bp, Homo sapiens
gtgcccagcttccgttggcttatcattgcacttagaataaaatctcatccccttgttttggatcccaaagcccgatgtgatctgtcactacccccggctcrtatttttctctccattgctcattccattctggccacactaatgtcttcatgttctttgaacacactgcagtttgcttccaccttaaggcctttgaaatag

SEQ ID NO: 66253 - DNA, 201 bp, Homo sapiens
gggttggccactgtgatgggagactgggagcctcaccgactccttcgccctacacactcttgtgagctggccccaaagccagggaaatccctagaaatackctgttcagggagaaaaccacttccacaggaagagtaccactaaatttaaaatcgttgcactccttctgcaatctgtctgaatagaggcaaagcccaggtt

SEQ ID NO: 66254 - DNA, 201 bp, Homo sapiens
aataaacttggagattgtgacactcttaatttgatactctagccatcaagtgcccagaactctttgccccagagcagggcagcctggattgttctgacacycgtggagaattcaatgttggctccacctgccatttctcttgtgacaacggctttaagctggaggggcccaataatgtggaatgcacaacttctggaagat

SEQ ID NO: 66255 - DNA, 201 bp, Homo sapiens
gttaaaatgtttttcttttctattgagttagcatgacaactactttcagtacacaattaaataaagtaaatatactgcaagttttgacaagtaacttaaamctttatatttaaattgctattaaagattcatctctaagacaggaggagctttccctcatttgttcatatatccatgaatgaatattacttatcaacaaaa

SEQ ID NO: 66256 - DNA, 201 bp, Homo sapiens
gaaaacggatttgctgcaatatcatttacaatattcaaattcttaatacctataccaatatttcgaatcatctctggcatacgaatgtatttatatccaarggcaaagctctggaataaataagaaattagtaaaaggtataatttttctcttataaagtgggagaaaggtgtattttaggcagattgtttttaagaaagt

SEQ ID NO: 66257 - DNA, 201 bp, Homo sapiens
ctctcagtgtttaatcataggtcctgcagagatcagcagcttataagaacacaaaatatgcctacttaccaaagtcaagattcagaagctcccagatgaaragttctaggcttatgagataactctactctctgggacacattaactggtttgagttgagttctccctggtatctggtcaggctgtagtcaaaagtgcatg

SEQ ID NO: 66258 - DNA, 201 bp, Homo sapiens
agagcccagatctatgtgtgagaaatttaaggattgtagccagttggtttgaggcatgggaaaactgtccaagtccagattgctggaagacaaatgtaccyaacgccatcatattggtagaaagggcataggaaagaacttaaaatgatatatccaggacgaatgtatccattaggcacagtagacacagacgcacaaaat

SEQ ID NO: 66259 - DNA, 201 bp, Homo sapiens
gcctttaggtaccagtcagtctgcagcttcacctgcaatgaaggcttgctcctggtgggagcaagtgtgctacagtgcttggctactggaaactggaattytgttcctccagaatgccaaggtaagagtgtattctttctaacatcatggaaataaattgtaggcagtatttttaaaggctggattttagaggtgacaact

SEQ ID NO: 66260 - DNA, 201 bp, Homo sapiens
gccatcatattggtagaaagggcataggaaagaacttaaaatgatatatccaggacgaatgtatccattaggcacagtagacacagacgcacaaaattttyaaagacccacacacgtctgaatttcttttataattattttctttgaagtcaaagaaaatgttttaatatatagtgatatattcatctttgtaccagtgca

SEQ ID NO: 66261 - DNA, 201 bp, Homo sapiens
tgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgagggtaggatttttcattagcaacctccattctgtccaagaaggaatca

SEQ ID NO: 66262 - DNA, 201 bp, Homo sapiens
agaaagggcataggaaagaacttaaaatgatatatccaggacgaatgtatccattaggcacagtagacacagacgcacaaaattttcaaagacccacacaygtctgaatttcttttataattattttctttgaagtcaaagaaaatgttttaatatatagtgatatattcatctttgtaccagtgcagttgcaaaatagaa

SEQ ID NO: 66263 - DNA, 201 bp, Homo sapiens
accattgctctctgtgtggcttttctcctttctcagtatctttctctttatccttggttattctctccagctgtgcagtgtcagcacctggaagcccccartgaaggaaccatggactgtgttcatccgctcactgcttttgcctatggctccagctgtaaatttgagtgccagcccggctacagagtgaggggcttggac

SEQ ID NO: 66264 - DNA, 201 bp, Homo sapiens
ttctgagccctatcttaataagggagtattcagacatggaagaagtagagtagttaatgaaagacaaacagccaagaagaatggaaagactataagattgyagatcaggatatctgatttcccacccgggttctgccacaaacctactgtgtttcactcattcaacaagtatttattgaaggcctattaagtgctaaactc

SEQ ID NO: 66265 - DNA, 201 bp, Homo sapiens
tgaaataatataaatcaatatgtttaagaattcagatgcaatcatgtatactttcttgatggactatagaagaacaccaatgaatacccatatgtgatagmactgccttggtagtcagtgaaaatagaacactaagcgtgcaataaatgcaaaccttatctgttttctatttttgtaattattcaggagtttttttttttt

SEQ ID NO: 66266 - DNA, 201 bp, Homo sapiens
ttattatacttctttgcaaaataaaaatataaaatttcaattttctacaactgtaagtctctatgtgttaaaatgtttttcttttctattgagttagcatkacaactactttcagtacacaattaaataaagtaaatatactgcaagttttgacaagtaacttaaacctttatatttaaattgctattaaagattcatctc

SEQ ID NO: 66267 - DNA, 201 bp, Homo sapiens
ttctacaactgtaagtctctatgtgttaaaatgtttttcttttctattgagttagcatgacaactactttcagtacacaattaaataaagtaaatatactrcaagttttgacaagtaacttaaacctttatatttaaattgctattaaagattcatctctaagacaggaggagctttccctcatttgttcatatatccatg

SEQ ID NO: 66268 - DNA, 201 bp, Homo sapiens
ggtcaatcatcatcttcctgccacatggcaagttaatgacaaagctggtgggatcattcaaatggaagaaatagtttgagacagaaagcaatcattgcagwaaatttcaactttcacattgacctttagtcagagaacagtaccatttcccaataaggcagggttgggcaggcagttggcccatgtatatttggctttctg

SEQ ID NO: 66269 - DNA, 201 bp, Homo sapiens
atctgcatggattcaacatactcagcacatggcaaattcaagttttgctttttggaactttatataatttattttttttctgaatgtttttgatccacaargagttgaatccgtagatgcagaacccttggatacagagagtcggttatttttcagccttgtctctgcctttgcccttcaggacctgaagtccttttcatg

SEQ ID NO: 66270 - DNA, 201 bp, Homo sapiens
gtcttcttgctgattttagatgatgggaaatgccccttgaatcctcacaggtaaggtagaaatgttttatgattgagtaaattttgctaccttaactttawaattcactgtaatatgtcagaatgattacatgcaatgcctgcctcctttttacaatgtcttttgcaatgtcttcttttctactctgaagtaaaatacaca

SEQ ID NO: 66271 - DNA, 201 bp, Homo sapiens
tttattgaaggcctattaagtgctaaactctaggctcagtgctaaggatccaaagctaaaaagaaaacaccgtcggagatttacaacctggcagatgtagmctgtatcatagaaacagacattaccgtacatggcaatgagcacaatggaggcagggatgaggtgctgtgggagcctggaggaaggaacacagagtccacc

SEQ ID NO: 66272 - DNA, 201 bp, Homo sapiens
cgtataatacctaatgcaaagcctacacatcacttcatctgcatggattcaacatactcagcacatggcaaattcaagttttgctttttggaactttatamaatttattttttttctgaatgtttttgatccacaacgagttgaatccgtagatgcagaacccttggatacagagagtcggttatttttcagccttgtctc

SEQ ID NO: 66273 - DNA, 201 bp, Homo sapiens
ggccccacttcccattctgttgcagtggatttatgaattccagatcttctttcatgttagcttgtcagcattcccaggacctttggtgatcctacttgatygcacatcttagagttcttgaaaactttctgggagagaaagactagtcttttgcataatacacttcttatgtcttgcatgtgtgtgtgtttgttttgtagc

SEQ ID NO: 66274 - DNA, 201 bp, Homo sapiens
ctgttttgctgagaaagtacatacagtgggcaatgaggctggaccaactggtaggctccaggtcataaagcatgttattttccatgtgaagaggtagagcytgcccttaagacattttatatgtcatttaatctgagcttgggcaaattacttatgtctccttcttttataaaaggacaggagtaagttagatgacttcca

SEQ ID NO: 66275 - DNA, 201 bp, Homo sapiens
ccctgcagataccagaatccccagatgcccaagtcacttatataaaatggcataatatttgcatataacctacatacattctcctttagacttttaaaccytctttagattacgtataatacctaatgcaaagcctacacatcacttcatctgcatggattcaacatactcagcacatggcaaattcaagttttgcttttt

SEQ ID NO: 66276 - DNA, 201 bp, Homo sapiens
tccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaaggtaggctgtgggtctgtcc

SEQ ID NO: 66277 - DNA, 201 bp, Homo sapiens
tgaagaggtagagcttgcccttaagacattttatatgtcatttaatctgagcttgggcaaattacttatgtctccttcttttataaaaggacaggagtaarttagatgacttccagggtccctcctaactttgatatcttatgattccaaacctttaacatcaaggatcctcagaagatgacattttcctattctgacatc

SEQ ID NO: 66278 - DNA, 201 bp, Homo sapiens
caggcctagtctgattatagggctagtgttttgaccactgaactacactatcacccagtggcagagcttctgaatctcaggtaagtcacttgtgaatttartcttttccactccacagattgcagctataactgctaaatgaactttagaaatggcagtgcctggtgatcagatgagagaatatgttggtagaaatctatt

SEQ ID NO: 66279 - DNA, 201 bp, Homo sapiens
atcactaattaatacaactttacctgaacacagatgggttttatctccaccaacacagtactctaagcagccactaccattgattgtcgttttgccatctragatgtaaaggatgtagagaagcatcaattatccatgggagatgagaaatagatatatttactgtaatatgaaattaagtttgattgttggaataattct

SEQ ID NO: 66280 - DNA, 201 bp, Homo sapiens
tttacaggactaggtaacagtgtcaacaataagctatgctagtccagcttttttttttttccctataagtccagcattttcctgtatatactcttttcagrttcaatttcacagataatgtcaatatttaatgagcactttcaatgtacaaaacactctgctcagctccagaataaaactatgaatgactgagcccaactt

SEQ ID NO: 66281 - DNA, 201 bp, Homo sapiens
ttatagcattcctgtttaccacaattctaaaataataaggaaaggcagtatcatctcattttatagataaggaagagacacaagcttaaagaggttaaatwactcgtccagggtcacactgttagtaagtgaaaaggctcagctctatgtcactgaaagttttacttccttacagagtcttcttcagctacattcttcatt

SEQ ID NO: 66282 - DNA, 201 bp, Homo sapiens
agataatgtcaatatttaatgagcactttcaatgtacaaaacactctgctcagctccagaataaaactatgaatgactgagcccaacttcgaggagaccayggtataatggggaagaatgacaatcatgtatgaacagcgcaagaacagaggctgtgggagcacattgcaggggcttctacccttagttaaggtgggaagg

SEQ ID NO: 66283 - DNA, 201 bp, Homo sapiens
atctaattaaactaaagagcttctgcacagcaaaagaaactaccatcagagtgaacaggcaacctacagaatgggagaacatttttgcaatctactcatcrgacaaagggctaatatccagaatctacaatgaactcaaacaaatttacaagaaaaaaacaaacaaccccatcaaaaagtgggcaaaggatatgaacagac

SEQ ID NO: 66284 - DNA, 201 bp, Homo sapiens
gcttttagttctttatttactctgaactttctcctcttgttgctgggtgcacatcaagtgaaatacccaaatgtgggctgggcaggaaggtaccatgcagwgtgcaatccactcgctgttgtaatacttctgagagagtgttatcagacaatttccctttttaatgtcctcccacccctccacatctacccctgctgtcag

SEQ ID NO: 66285 - DNA, 201 bp, Homo sapiens
tagcttcctcagctgtatgctcacatgtttgttgcgcatttaaattgtggacctcctgctcaagagaatattcagaaacggagatgctgattagaggacaytggaaacagatgaccataaggaggtcatctttacttcccaggaaagcagaagaatgagaagagaatagggccatggaggtgggaacctagagaaacactt

SEQ ID NO: 66286 - DNA, 201 bp, Homo sapiens
tggttcttaaatgctctgagtctgtaaaaaccagaggtcaaagcccagagcaaagaggtagtctttacactttgaaaagtttcagaaatagcctggaaatraaatgctttatcaaggaagagcatgaggaaaccaatctttatcagaactgaggtcactcagggcttaattgtgctcaggaattcactttggctgcactca

SEQ ID NO: 66287 - DNA, 201 bp, Homo sapiens
ttgctctttggcttagagacaacctcttttctcactgtatttctttttccacccctaagctgggctaccaatatctgtgccacaccactaacaccaccacygtccagaaacataagggaactaatgtattagctgtaatagcttgtaacatctgggctttgctaccaacaagttgtatagttctgcatcctcaacaactct

SEQ ID NO: 66288 - DNA, 201 bp, Homo sapiens
caccatgtagtctttgagggtagcctttgacaaagaagcaaaggaaggaacactgcatcgaaaaagtgtgtgatgcaatcccaggcaattacataattccrccaaaatgaattctctgcaattgcctcacaccctcagtttataaggcggacagtggtaatgggagaataggaaatttacgatagattagtgaattcccag

SEQ ID NO: 66289 - DNA, 201 bp, Homo sapiens
aaacctgtatccatttagctgctattgcctcctacatcttctctttatttgaacccttcccagtgtctcagtgcagcttcaccaaattcactggctgccayaggaacttcttcctatagaaccttgcatggtttatagaattttagtatctcagaattgagaggaaacatagagatcatgtagcacagcatatccacatat

SEQ ID NO: 66290 - DNA, 201 bp, Homo sapiens
ttctactaaaaatacaaaaaatagctgggcatggtggtgcatgcctgtagtcccagctactcgggaggctgaggcaggagaatcgcttgaacccaggaggyggaggttgcagtgagctgagattgtgccattgcactccagcctggtgacagagtgagactctgtctcaaaaaaaaattgcacagtttcaggaagtgcttt

SEQ ID NO: 66291 - DNA, 201 bp, Homo sapiens
gctttagttaaatattccacagtttcaagaacatcctggccaacatggtgaaaccccgtttctactaaaaatacaaaaaatagctgggcatggtggtgcaygcctgtagtcccagctactcgggaggctgaggcaggagaatcgcttgaacccaggaggtggaggttgcagtgagctgagattgtgccattgcactccagc

SEQ ID NO: 66292 - DNA, 201 bp, Homo sapiens
agataaaaaagttctccctctctttaaataatattttaatagctttagttaaatattccacagtttcaagaacatcctggccaacatggtgaaaccccgtytctactaaaaatacaaaaaatagctgggcatggtggtgcatgcctgtagtcccagctactcgggaggctgaggcaggagaatcgcttgaacccaggaggt

SEQ ID NO: 66293 - DNA, 201 bp, Homo sapiens
tgaagcatcatgaaattcaaacaatcacttttagccaaataccatcgttgtatattaatcacacacacacacacacacacacacacacacacacacacacmgagagagagagggagaaagagagagagagttacagagttcaggttgctgaattataaaatgatctcttcttttctcctctgccatgcccatgatagccat

SEQ ID NO: 66294 - DNA, 201 bp, Homo sapiens
aactggtgatgaagcatcatgaaattcaaacaatcacttttagccaaataccatcgttgtatattaatcacacacacacacacacacacacacacacacasacacacacagagagagagagggagaaagagagagagagttacagagttcaggttgctgaattataaaatgatctcttcttttctcctctgccatgcccat

SEQ ID NO: 66295 - DNA, 201 bp, Homo sapiens
ctaactggtgatgaagcatcatgaaattcaaacaatcacttttagccaaataccatcgttgtatattaatcacacacacacacacacacacacacacacasacacacacacagagagagagagggagaaagagagagagagttacagagttcaggttgctgaattataaaatgatctcttcttttctcctctgccatgccc

SEQ ID NO: 66296 - DNA, 201 bp, Homo sapiens
atagccttagatttaaagaaagaatagtcacttcatttgtctataacccaacatttattgataaataatagtcttatattagagaattaatggggagaaargaataatgctaagaaaatatgtaactgcaataatttgtaaaaatacttttggggggaaattgtgaattaaaatttaaattcatttattcattcacttggc

SEQ ID NO: 66297 - DNA, 201 bp, Homo sapiens
taaaaatcacctctaaagctgtttgtgattgagcacttcaggatgtcaatcaactgtaagctgctgctattttacacctctacaatctctaactggtgatraagcatcatgaaattcaaacaatcacttttagccaaataccatcgttgtatattaatcacacacacacacacacacacacacacacacacacacacacag

SEQ ID NO: 66298 - DNA, 201 bp, Homo sapiens
gacatgggacatgacagcacatcagttcagacaaaaagttgaagaattcagaggagaagagttcaggctgtggtgatcagcagagtcttcagagactttaygagttaaatcctggaggattagtgggattttacgccataaaagtggaaaaattctcaggggaatgtgagccaagaaccagaagcaataacacacaaagtc

SEQ ID NO: 66299 - DNA, 201 bp, Homo sapiens
aagccaaaattgacaaatgggatctaattaaactaaagagcttctgcacagcaaaagaaactaccatcagagtgaacaggcaacctacagaatgggagaayatttttgcaatctactcatctgacaaagggctaatatccagaatctacaatgaactcaaacaaatttacaagaaaaaaacaaacaaccccatcaaaaagt

SEQ ID NO: 66300 - DNA, 201 bp, Homo sapiens
atgggacatgacagcacatcagttcagacaaaaagttgaagaattcagaggagaagagttcaggctgtggtgatcagcagagtcttcagagactttacgarttaaatcctggaggattagtgggattttacgccataaaagtggaaaaattctcaggggaatgtgagccaagaaccagaagcaataacacacaaagtcact

SEQ ID NO: 66301 - DNA, 201 bp, Homo sapiens
cctgtgtaaattttgcttcaagttcagagagtggctttaattaacttttaggacctgagaaaatgaggataaggtttttctggtggggtattttcaatcasatagatctcagaggagtagctcttgattgggaacttatagttaaattgcactgatgtttgtcaaagttttagcgggctatggccgggctcagtggctcat

SEQ ID NO: 66302 - DNA, 201 bp, Homo sapiens
caataaaagccaaaattgacaaatgggatctaattaaactaaagagcttctgcacagcaaaagaaactaccatcagagtgaacaggcaacctacagaatgrgagaacatttttgcaatctactcatctgacaaagggctaatatccagaatctacaatgaactcaaacaaatttacaagaaaaaaacaaacaaccccatca

SEQ ID NO: 66303 - DNA, 201 bp, Homo sapiens
gggatcattcaaatggaagaaatagtttgagacagaaagcaatcattgcagtaaatttcaactttcacattgacctttagtcagagaacagtaccatttcycaataaggcagggttgggcaggcagttggcccatgtatatttggctttctgctgaatttcttatatttctgtaccatttcttgcttctttttaaaatagc

SEQ ID NO: 66304 - DNA, 201 bp, Homo sapiens
aagcaaaaacatcgacataaacaccaacctttagagacaaccacaggaggttcccagacctccatgtggatcccagggtaagaacccttctcgattgcctsctgggctttatgttcagaagcccctctcttggtaccctgaaattaggcttgagctctacagcgaagtgctaaggccccagccctggaatggtttttaata

SEQ ID NO: 66305 - DNA, 201 bp, Homo sapiens
ctcacaacaggcatagcatcacttcctactccaggggtgcaatgtccagccctcaccactcctgggcagggaaccatgtactgtaggcatcatccgggaamctttggttttaataccacttgttactttggctgcaacgctggattcacactcataggagacagcactctcagctgcagaccttcaggacaatggacagca

SEQ ID NO: 66306 - DNA, 201 bp, Homo sapiens
ataaccctgaagttccctgaaaatgtagtttaaggaggatgacagtctacttctttcaaacttccagtgtccagatatgctgaacacttattaagtatttyaataaacacatactgacatgccagttgatcacaaatgtagtaataacatttagactaacagtattttaagaaccaaaattttgtaaatagtatatttgga

SEQ ID NO: 66307 - DNA, 201 bp, Homo sapiens
gtgcaatgtccagccctcaccactcctgggcagggaaccatgtactgtaggcatcatccgggaacctttggttttaataccacttgttactttggctgcarcgctggattcacactcataggagacagcactctcagctgcagaccttcaggacaatggacagcagtaactccagcatgcagaggtaaggtgaaaaggagc

SEQ ID NO: 66308 - DNA, 201 bp, Homo sapiens
gcaagtactcaagctagccattgtgcctgtatgttgaagtctcacccaaccacaaccactactccaagtgtcatctcccttatgaaatccacaccaatccyattagaagtaatgtgtcacaggcatttcacttctgtccttcctcatgtcacaagctaaagctaatacacaagtactcagagacttaaaggaagaaacatt

SEQ ID NO: 66309 - DNA, 201 bp, Homo sapiens
acttccagtgtccagatatgctgaacacttattaagtatttcaataaacacatactgacatgccagttgatcacaaatgtagtaataacatttagactaayagtattttaagaaccaaaattttgtaaatagtatatttggaggcaagatttatcaatgcattagcaggtatttgtcggatgctactatgtgtccatcttt

SEQ ID NO: 66310 - DNA, 201 bp, Homo sapiens
ttcatttttgtatcccccacaaaacatagcacagtgctttgcaaatgtcactactgataaataacatttatttgaattaaatctaatttcttgacctttamtttcctatccataaattagaaagaataaccctgaagttccctgaaaatgtagtttaaggaggatgacagtctacttctttcaaacttccagtgtccagat

SEQ ID NO: 66311 - DNA, 201 bp, Homo sapiens
agagctactgtgaatattggaagtggctcatatcctttctgaccttttacattctgcctcatttattggcaatgttaggttacaaaagaaactataatctstttcacctccaatccacatgttgtttctcttgcattatttcttttctgcagctgtgaaatgctcagaactacatgttaataagccaatagcgatgaactg

SEQ ID NO: 66312 - DNA, 201 bp, Homo sapiens
ttttgtatcccccacaaaacatagcacagtgctttgcaaatgtcactactgataaataacatttatttgaattaaatctaatttcttgacctttaatttcytatccataaattagaaagaataaccctgaagttccctgaaaatgtagtttaaggaggatgacagtctacttctttcaaacttccagtgtccagatatgct

SEQ ID NO: 66313 - DNA, 201 bp, Homo sapiens
caaaaatcaatgagtacatgtgtattactgtttctttattccttacttcctcatcccttagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacag

SEQ ID NO: 66314 - DNA, 201 bp, Homo sapiens
agggttggccactgtgatgggagactgggagcctcaccgactccttcgccctacacactcttgtgagctggccccaaagccagggaaatccctagaaatamtctgttcagggagaaaaccacttccacaggaagagtaccactaaatttaaaatcgttgcactccttctgcaatctgtctgaatagaggcaaagcccaggt

SEQ ID NO: 66315 - DNA, 201 bp, Homo sapiens
actgaattaattaattcatagctcctgtttagttgcaaaaggtgctattgttctaatgtattgttcagtgtagagttagtaataatgagaccagtgataatggtaataattattgcttaatgtaggactacctatttcataagcatcatcacattcaatccacacaaatgacccttaagttggttattactatgcccattt

SEQ ID NO: 66316 - DNA, 201 bp, Homo sapiens
ttacctcttacacctttctaagtggaaagctacaattttttatcccaaattttaaaagcaaaagaagattggattttccagtgtattacaaaaattagackgtaaaaataaaattgttacataatttcttaaagtttatccaatggaataaagtactagcatgatctgcaatcctcatcacttaaaagaccacaagcaggc

SEQ ID NO: 66317 - DNA, 201 bp, Homo sapiens
gtattgttcagtgtagagttagtaataatgagaccagtgataatggtaataattattgcttaatgtaggactacctatttcataagcatcatcacattcartccacacaaatgacccttaagttggttattactatgcccattttaaaggtgaagaaactgaggctttgagaggttaagtagctagcaaagttcatatagc

SEQ ID NO: 66318 - DNA, 201 bp, Homo sapiens
attcatctctaagacaggaggagctttccctcatttgttcatatatccatgaatgaatattacttatcaacaaaattagacaagtttggcatcaatattaytcccatatttcattttcaaggatttaaacattgagaaacttcattcatatgaataagtaaatggaattagaagttttattatagcaatgtctcaattcct

SEQ ID NO: 66319 - DNA, 201 bp, Homo sapiens
gcttaatgtaggactacctatttcataagcatcatcacattcaatccacacaaatgacccttaagttggttattactatgcccattttaaaggtgaagaarctgaggctttgagaggttaagtagctagcaaagttcatatagcttgaagtatggagacaggatgcaaacccaggcctagtctgattatagggctagtgtt

SEQ ID NO: 66320 - DNA, 201 bp, Homo sapiens
aagtaaatggaattagaagttttattatagcaatgtctcaattccttgaagtccttccaagttatatgccccaaattatatagtgatttactatcaaaatktagtcagacttgacaacttaatcgggtgctccctcaaagctgatgaaaggaaataaatggaaatcactagacttgaaaacggatttgctgcaatatcatt

SEQ ID NO: 66321 - DNA, 201 bp, Homo sapiens
cctgaacgaggaaacatgacctgccttcattctgcaaaagcattccagcatcagtctagctgcagcttcagttgtgaagagggatttgcattagttggacyggaagtggtgcaatgcacagcctcgggggtatggacagccccagccccagtgtgtaaaggtgagtttcaggtagttgggatgtataatgtccattgcacc

SEQ ID NO: 66322 - DNA, 201 bp, Homo sapiens
aaatggttcctcttattttcccatatgcctgaacccattaatttttaaccctcagcactgccccctagaaccccaattttcacatggtgttttgcagagtwctaggatacatcagatggactcaggggcctccaagtaagcagaggcagtgtggcaggtggagttctcaagctgtctcttcagagtgcaatgtgagatttc

SEQ ID NO: 66323 - DNA, 201 bp, Homo sapiens
agaattccacttcagcatttggaatggtgcattttgaaatgtgataggaagaacagcttgtgacacaacacaattcagagaaagcagtggggttaggttcrcaccaaagggttatcgatcactctgcattttgtgcaaataaacagctgtaaatcataacgttatgatactctcagtgtttaatcataggtcctgcagaga

SEQ ID NO: 66324 - DNA, 201 bp, Homo sapiens
cagcaaacatgacattgctgttaattctacatggaaaataaaaatcactattttgtctcctgcagtgagagagtgtggagaacttgagctccctcaacacrtgctcatgaactgcagccaccctctgggaaacttctcttttaactcgcagtgcagcttccactgcactgacgggtaccaagtaaatgggcccagcaagct

SEQ ID NO: 66325 - DNA, 201 bp, Homo sapiens
cttgcccttaagacattttatatgtcatttaatctgagcttgggcaaattacttatgtctccttcttttataaaaggacaggagtaagttagatgacttcyagggtccctcctaactttgatatcttatgattccaaacctttaacatcaaggatcctcagaagatgacattttcctattctgacatcattcacactttta

SEQ ID NO: 66326 - DNA, 201 bp, Homo sapiens
gagcaccttgaagaatataagatcagaattagagaaaactagctgcttaaaactagagggaaattttaatatcatccagctcacctgtctcatcttataamtgatgaaaaggacactcacgaggttttagtttctcaaggccgtggagcaggacagaagcaaagtgaggaccagaaaccagtctcccaaattttaggtgta

SEQ ID NO: 66327 - DNA, 201 bp, Homo sapiens
cttatatttctgtaccatttcttgcttctttttaaaatagcaacaacaatgactcctctgatttcttctcttggccaggagaatcatctcctcaaggatgmtttttaataattttcctcatctggttttctatctctgacactgatagtttttcttaacttccttaaatagctcttgcaggagcctcccttgttatgaagg

SEQ ID NO: 66328 - DNA, 201 bp, Homo sapiens
ggtcttgaagaggtttgtaaaaatcaaactatctaagtaaatgagacttatctgaccaaggtattgttgtcagaatagccttagatttaaagaaagaatartcacttcatttgtctataacccaacatttattgataaataatagtcttatattagagaattaatggggagaaaagaataatgctaagaaaatatgtaact

SEQ ID NO: 66329 - DNA, 201 bp, Homo sapiens
aaatacttttggggggaaattgtgaattaaaatttaaattcatttattcattcacttggcaagtggttactgagcactgcctcttgagatcctgggatggsagttatggaagactcaaggatgaatcattcttgggttttagacactttcccatccagtagaagagtgagggtatgacatgggacatgacagcacatcagt

SEQ ID NO: 66330 - DNA, 201 bp, Homo sapiens
ggaaatgaaatcctggattgcacccattcaagtaagatagagggagctgcggcaggctacgaggtctctgaagcagagggtgtagagaaaatagggtgacwttgtaagttcttgagtatggctgcctaaatctttgacttctttgtcttcgtgacttgtacctatactcttctctgtaagcttaccatcctcccactgccc

SEQ ID NO: 66331 - DNA, 201 bp, Homo sapiens
ccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacaggtagggccttctctactttgaaactttcctgttaaa

SEQ ID NO: 66332 - DNA, 201 bp, Homo sapiens
gtagaaagtgttcttgaaacctcatgctgtttaagtcagtggctgaaaaatgaccctaggagcaaggacttcatgtctaaaacaccaaaagcaatggcaayaaaagccaaaattgacaaatgggatctaattaaactaaagagcttctgcacagcaaaagaaactaccatcagagtgaacaggcaacctacagaatgggag

SEQ ID NO: 66333 - DNA, 201 bp, Homo sapiens; identical to SEQ ID NO: 46147

SEQ ID NO: 66334 - DNA, 201 bp, Homo sapiens; identical to SEQ ID NO: 46114

SEQ ID NO: 66335 - DNA, 201 bp, Homo sapiens; identical to SEQ ID NO: 46035

SEQ ID NO: 66336 - DNA, 201 bp, Homo sapiens; identical to SEQ ID NO: 45989

SEQ ID NO: 66337 - DNA, 201 bp, Homo sapiens
tatccatattgctggattcaatttgctgatattttgatgaggatttttgcaaatagagtcttattggatccttgaaacaaccctatgtgattagggtccayatgaagaaactgaggcataagttgtttgcctgtgaccacatagtgtcaaactggaacaggaatgcaagacttttgaatttagtctaactttttttccact

SEQ ID NO: 66338 - DNA, 201 bp, Homo sapiens
cattcctgggataaatcccacttggtcatggtaaagaatcctttatccatattgctggattcaatttgctgatattttgatgaggatttttgcaaatagartcttattggatccttgaaacaaccctatgtgattagggtccatatgaagaaactgaggcataagttgtttgcctgtgaccacatagtgtcaaactggaac

SEQ ID NO: 66339 - DNA, 201 bp, Homo sapiens
caggaggaaagatgtgacaggattaaaggagggattagagtcaagaagagaagtcagtttttaaagtgggccagggcgggggcgggggcataattcatggyaagagaagaatggaagcttgaggacccagataagagtgcagtgatgatgaggcttcttggtatttctgcactacaagatgtatttggcaaagtgtcttgt

SEQ ID NO: 66340 - DNA, 201 bp, Homo sapiens
tccaggagcttcctgaggatgggactggcacaggcattggctgttgtagtcgacactgcttcctctcatttcttgtggttccattgtgtgtaggttccctyttaagcacttttttatgttctggtctggacaatcaaatatttcatacttgagtggtagctgaagaaggcctcatttgggatgtgggacttaaggcagacc

SEQ ID NO: 66341 - DNA, 201 bp, Homo sapiens
tcagcaaggataagaccttgggtatgtgccaggggactgggactgagcaggaacctgtagtgggtgggcctccctgggctcttctgtctttcccaagcatkgaaacatgactggaggtgatagctcaggacatgggaagggaataatcagagagagaaatggggtcaccagactcccaggacttcctagagcctccaagag

SEQ ID NO: 66342 - DNA, 201 bp, Homo sapiens
aagcttccactgccatccagctgctttggccatgttcaggaggagaacctgtggcacggaggcatctttgagatggagccacaggtaagagttagccaggrtgtaagcatggcccactgacttcccaagtcccaaagtcttttgtcccttccccccagttcacgctcagagattcgcctgggccgctctgaaagcctcaag

SEQ ID NO: 66343 - DNA, 201 bp, Homo sapiens
gtgaggacacatcactaagcagtgagagatggtggttctgagagtggtttccccttgagtgaaacgagttcattctctcagcttcagagagggatcttttyagggaagtcccacagaagctccctggcaaaatggggagcttagcactgagccctctttttccttgtgctatggaggtaacaaaccaggaggagcctgttc

SEQ ID NO: 66344 - DNA, 201 bp, Homo sapiens
ccgctaaggagcccctagcttctgactccaggaacagccatgaactggggccctgccctgaggatggtgagtgaagccaggtccctctcggttcctaccaytgggggagaagtctgccaactcgtgaggacacatcactaagcagtgagagatggtggttctgagagtggtttccccttgagtgaaacgagttcattctct

SEQ ID NO: 66345 - DNA, 201 bp, Homo sapiens
gccttcagtccatcaccccaaaaccattccccatgagtgagatgtgtgtcttcgcgggagccctagatcctgtcctggcccagggatcttcccccagcccrcccagccacccttaaatcacaccctcctccccaaggcccagcacagaccccttccccaggggccttaggaatagaaggactcgagcagacattcccccgc

SEQ ID NO: 66346 - DNA, 201 bp, Homo sapiens
gagcagccagggaggactgtacagggaggtgggcacctgccaggcagagggttcttagggcctggaagccctgttccagtgggctcagtacggggtggtgygtgctgctatcttgctctcactacagtcctctctgttcctgccgagcaacagatggatggagctcttagaagaggccgtgcggaatgccaccaggcaccc

SEQ ID NO: 66347 - DNA, 201 bp, Homo sapiens
agccatgcctgagatccaagagcagatccacgactacaggttggcccaggagctgacctcccacctctctcctcgttcacctccgcctcttggccctggcwccttccctctgggacgtgcacatatctcttgttatatgtgtttgtcttgttctttctggatgtccatctgttgagtatttgtgtatatttctttctttcc

SEQ ID NO: 66348 - DNA, 201 bp, Homo sapiens
gtgaagctcaagaggcagccatgcctgagatccaagagcagatccacgactacaggttggcccaggagctgacctcccacctctctcctcgttcacctcckcctcttggccctggctccttccctctgggacgtgcacatatctcttgttatatgtgtttgtcttgttctttctggatgtccatctgttgagtatttgtgt

SEQ ID NO: 66349 - DNA, 201 bp, Homo sapiens
atcatctctgagatgcagcggctcaccaagtacccgctgctgctggagagcatcatcaagcacacagagggtagcacctggggaggggctggcatcacagkcagtgggcctcgtgccagaccctcattctgacactgctttgtgaccttagcaagtcactgtgccttgtggtctttggtgtcttcgtcctttttctgttgt

SEQ ID NO: 66350 - DNA, 201 bp, Homo sapiens
tttttgtagcaatcttaggaaaagataacgagcttctgaatcagaacggttatggtggggacaaagaggagtggcaggattcccaagacgttttggtagcrgaattaaccagtattttaagactgaatcaaatttatttatttatttatttattttgagacagagtttcgctcttgttacgcaggctacagtgccatggca

SEQ ID NO: 66351 - DNA, 201 bp, Homo sapiens
tcaccaccttggggtcagtggggcagtacaacgatccttctggcgtggtgtgcagtcccatgctgggaagacatcaccctgtttcccctccagtggagaayctgcgacatctgatcctgtggagcctgctgccaggtcacaccatggaaactcaggctgcccaggagcccgaggacgacctgacacccacaccttctgtca

SEQ ID NO: 66352 - DNA, 201 bp, Homo sapiens
taagatgggtagggtagggagaatgaagggattcagactttatgtggtagtagaaagggagccggggaaggtttatgtattatatggtgataaacatagtrtttaaagagagaattctgatattaatatatagagcagaagagagcttggggttaggaagcctaggagtttttgtagcaatcttaggaaaagataacgagc

SEQ ID NO: 66353 - DNA, 201 bp, Homo sapiens
gtccctgtctgctcccccacagcctgccacctggctataatagagctgagcctgaagaagggtgagggggatgtagagcaagggaccagagaagctcagcyagcagcccccctcctctctgggttgccaagcagaccagccaggtgaagaggcccacaccgtccttctcggatcctactccattgcccattctaatgcatg

SEQ ID NO: 66354 - DNA, 201 bp, Homo sapiens
aaaccgcccacttcagcctcccaaagtgctgggattacaggcatgagccaccgtgcatggcctcaagcctaaatgcttgttgggaaatgttattaacaaarcaacacaaaataaaaagatggtacataattgctgaatcgttatgtacaccaaaaggtacatttagagaagagtgcaaggttggtgctaataagaatagtc

SEQ ID NO: 66355 - DNA, 201 bp, Homo sapiens
tattttaagattataagacatcaacattttgagaaaatatttgagaccatttacaaagttgcattcttggcattgctaggtaaatttgccctaagacactygctaggatcctaaagctactctaagcagaagcctttgggtttgatgattatcaactcattggcaatctcagaagaaatagtattagcaatatggtgggtc

SEQ ID NO: 66356 - DNA, 201 bp, Homo sapiens
ggttgtttcaacattcacgtgttaatttcaaatgtagtcaaataaggtcaattagagaaggtttcctaggtaatgtgtattttctagaaaataaatgacayaataaaggactatgtatttggaaagagattgtagctgagagtaagaaaattttggaatatttacttggcagtctttcatctcctgtagcaccctgttcaa

SEQ ID NO: 66357 - DNA, 201 bp, Homo sapiens
atctgcatggcttcaaggcccagatgcacgttcaggctgggacaggcagatctgctcttaatctccaaagtgagagtgatggtaatagccctactcctgtmatgtgcacccacagctacttacacagttttagaaaaatattccctagccacttgcctaaaggctgtcaagttgtaaactgtgaagacagcagctaaattt

SEQ ID NO: 66358 - DNA, 201 bp, Homo sapiens
ctcatgtgaggcaagggtggctcccctccacccacgcctgctggtttgaagcaagccagctgccatggatgaataggcagataacagctggcgccatgttrgacttctcaggcaggagccccaaccatctcttctgtccattttggtaggtggcacctctgagcatgagaagctgtgccgggcccgggaccagtgccggga

SEQ ID NO: 66359 - DNA, 201 bp, Homo sapiens
ttgctcacagagagagcatgcaactgggggactgggaaacacgtaagactcttgaagaccacataaagcaacaccagactgtaagcccctcacaagcaggracagtttggtttgcctgtatgaaatcctgtgtgcctagcttagtgtcttgcatgaggtgagtactcaagaaatgtttgacaaatgaatgttagagtgaat

SEQ ID NO: 66360 - DNA, 201 bp, Homo sapiens
ttacattgaggccaaaaaataaaagctaggctggagtaagggaaagtctaggcagagggaacagcaggtacagaagcctcaagcaagaaagagcatggtgktgtgagaattgcaagtggctgtgatctgtagtgagaccatagaaccattaattaaatgaaactggagaaaaggaaaatgagtaggagccaaggcctgagg

SEQ ID NO: 66361 - DNA, 201 bp, Homo sapiens
aattgtcacagaattgagcaagttcatttcctgttaataaggtccatatgcgtgcaactgattaacactttctaggttctacaataaatatatatatagakagagagagagacagcaatgggatgcaacctggaaactattctgttactgcaatttattttatgtaaaagtgacaattaaaaatattatcttccaaattag

SEQ ID NO: 66362 - DNA, 201 bp, Homo sapiens
gagtggcaggattcccaagacgttttggtagcagaattaaccagtattttaagactgaatcaaatttatttatttatttatttattttgagacagagtttygctcttgttacgcaggctacagtgccatggcacgatcttggctcactgcaacccctgcctcccaggttcaagcaattctcatgcctcagcctcctgagta

SEQ ID NO: 66363 - DNA, 201 bp, Homo sapiens
gatggttccattagttcaacaattagaaatccctttggatacgaaacttcctctgccacaatttaaaaccattttattgtctttctattgtgatttcagcrtaggccttaaagtcactagtatccctctattaccattgttgacttccttaagattttcctcctcattttaaagaatagcaaactaagacatgaatatgtg

SEQ ID NO: 66364 - DNA, 201 bp, Homo sapiens
gggccttccctctgcctggagccagaagaaattgttttgggctcgtaggcctgctgggcagcagcactggccctcagagtctgaacacatgacaccccttsccccaagagtctgcccagccacctctatcactggtaatgttactgtgtggttgcaattcttacctccaaatgattggtacaactttgtaaggtgtctgcc

SEQ ID NO: 66365 - DNA, 201 bp, Homo sapiens
cataaattttggttcccagggttgcactggacttggaaggagtgctgttgtgtacatactattgtatggttttatttattattttactgtacaaatcagcygaaagaatttttccaagtgccatttcggatttattaatccttttttttttcctttcctcaaagatatttgctgttgtcatattaagcattggagactaga

SEQ ID NO: 66366 - DNA, 201 bp, Homo sapiens
ccctttaagcacaagcctgtctgctcttgagaggaaatggaatcttaggaacagtattgttaagataagaatggaactcatccacatcacaactggaaggmtaagaatccagcagcagatagaactttctgacaggcagtgtggaaaatcctaaaatgagctgtgaatatagtgactccactttcctcttaagacctctta

SEQ ID NO: 66367 - DNA, 201 bp, Homo sapiens
ggtcctgcctatcagtaaaaaggcccctttaagcacaagcctgtctgctcttgagaggaaatggaatcttaggaacagtattgttaagataagaatggaamtcatccacatcacaactggaaggctaagaatccagcagcagatagaactttctgacaggcagtgtggaaaatcctaaaatgagctgtgaatatagtgact

SEQ ID NO: 66368 - DNA, 201 bp, Homo sapiens
cctgtggtcctagaagcagagcaggatgtagattactaataatatcagaaaaccagcccaacagggccacagcatggaggtggggtgaccatcctggggcrgctaggggtcagaggtgccagctgtcttgggctgatgcactgcaggactcgacaccgcaacacccagtcatcagcatctcatcaaaccccagagacactc

SEQ ID NO: 66369 - DNA, 201 bp, Homo sapiens
caggcctcctgtggtcctagaagcagagcaggatgtagattactaataatatcagaaaaccagcccaacagggccacagcatggaggtggggtgaccatcmtggggcagctaggggtcagaggtgccagctgtcttgggctgatgcactgcaggactcgacaccgcaacacccagtcatcagcatctcatcaaaccccaga

SEQ ID NO: 66370 - DNA, 201 bp, Homo sapiens
tgaattgtcacagaattgagcaagttcatttcctgttaataaggtccatatgcgtgcaactgattaacactttctaggttctacaataaatatatatatakagagagagagagacagcaatgggatgcaacctggaaactattctgttactgcaatttattttatgtaaaagtgacaattaaaaatattatcttccaaatt

SEQ ID NO: 66371 - DNA, 201 bp, Homo sapiens
ttagcatttcatattcccttgtcccctgtggaaggtaaaaggaccattttatttgggtttgtctttgcattagcattgagtttccatctcccaaatcttgkcttttctgtttctttctcatcatctcccatcctgttcctcctccctccctttctttcttctctccatttctcttatgcgttgctcattgttgctaaagct

SEQ ID NO: 66372 - DNA, 201 bp, Homo sapiens
acgggcacatgtgacggggaggaaagcccaggcatagggtaaacagagcttgctcaaaagcagagtgagaatgaaacacagctcccaaggacttagcctakcctgggtggagctagatgcagggactagaggagagacatctttcagtttctactggggagctcaggtttcatggagtgtgaagtgcttgccttttttagc

SEQ ID NO: 66373 - DNA, 201 bp, Homo sapiens
gattctgttcctagcgccactctcaaaaaatctcacagtacctctgttgttccacatatagaatacacattgcctgtctctggaatgtttggaggaagagmttgtaccaaattctccctattctcccctcattcagtgccctggttccccccaaccctccctgccttgcccatccctaggccgaagaaacagaggtctaga

SEQ ID NO: 66374 - DNA, 201 bp, Homo sapiens
tgttggctcttattttgttgactgacagtcccaccccagatcttttgcaaacaggaagagagcattttctcctacttcccatcttcatatgtcatgtgacmaggctgctctgaatctgccctgccccacccagaagcagttgacttcctgcaagtggaaatcatttcatctgtgctctgattttgggggcgggagtgagat

SEQ ID NO: 66375 - DNA, 201 bp, Homo sapiens
acaaaaaaaagtgagtagtcagttctgggagatcccttaggaagttgggtcatggtttgaggagattagcatgtatttgatggatcctgattaatcagccwtatatatatatatatatatattcatatatgtattcatatatgtattcatatatatattcatatatgtattcatatattcatatatatattttcatatata

SEQ ID NO: 66376 - DNA, 201 bp, Homo sapiens
gttttccttctgaaattttttcatcttctgaaaactaagttggtattttcaagtgttaagagcaaatagagtataatttccagtttcttagtagtaataartgttaataacagcataggaagaaaacctatactttccataaaactgtcagcagcagggaaatggatgcataaggaactctcactttctgttatgtcattc

SEQ ID NO: 66377 - DNA, 201 bp, Homo sapiens
atgtattcatatattcatatatatattttcatatatatattcatatatattcatatatgtattttcatatatatattcatatagattcatatatatattccatatagattcatatatatattcctatatatagattcatatatatattcctatatatagattcatatatatatattcctatatatagattcatatatatat

SEQ ID NO: 66378 - DNA, 201 bp, Homo sapiens
tctgggttccaaagcagaaatttcagatgcatccaacatgcaagattatcaaatctggctttcattttatcattgtcaactctgttatataaagagtaggrtggagagggcggccatggcattaactgtggcaagcctttgagagtgagggagcagagacgaaataatctaaaacagtgacttgaccaaaaacatatttcc

SEQ ID NO: 66379 - DNA, 201 bp, Homo sapiens
atagctgccatgtattcaggtatctgactttgcgctagacattctgctaagcacttcatatacataatctcactccactattacacccgtcccatgaggcrggtattgtcatctccattttatcaatgaggatgtattcaagcttgcccaagtctatacagctagtaagtggaggtgccagaagtcaaagccaggtgtccc

SEQ ID NO: 66380 - DNA, 201 bp, Homo sapiens
tatagcaatttaaaaaaattttaatgctcttaaagtccaaaacaaagcataattatttatgcaataatcagaaggcttcgtgaggtgatgcttgagttggrttcagtctgctgttaatagaacgttgaaaatgtcagtgggaccaggagtggtagctcatgcctgtaatcccagcactttgggaagccaaagtgggaagat

SEQ ID NO: 66381 - DNA, 201 bp, Homo sapiens
cctaactaatactgacagcagcgagtccagagtgaggaccaggcaggctagatggtgcccgtctcccttctccttctaatcatgagtagaagaattaaggrgaggcagtctaaggtgatgtcagcctgagaagctaatcactggcagctttttagaggacaggaattggaagctgcatttagaaagagatgatttacgggc

SEQ ID NO: 66382 - DNA, 201 bp, Homo sapiens
agccataaaaaagaaagaagtactaataaatgctacaacatggaagaaccctgaaaacactatgccaggtgagagaagccagacacaaaaatctacaggtygtattattccacttacatggagtgtccgaaatatgcagattcatgaacagaaagtagatcagtggttgccagagggttgaaggaaggggaaattgggagt

SEQ ID NO: 66383 - DNA, 201 bp, Homo sapiens
ggaaactggtgaaagaaaaggtggcagctccctcttcctgccctgcacacaggtgcccagaataaaggctctctttcccctaggccacagctccttctgtrttatagaaactattttcttctcaggccggctctctctggattcccaggagggggacagtggcttggactctgggacagaacgctttccttccctcagtga

SEQ ID NO: 66384 - DNA, 201 bp, Homo sapiens
gaggcgaacatgcttgttagggtaccagcaagagtcagctctccagttacttgctgagggccagccttgggggacagtggcagaattgattagcagccacrcctgggtatcaggacctcctgcaaacaccagtgtctcctgtctcagcagagcagcaattccaagaaagaaaaggatgccttggaggacaagaagcgaaac

SEQ ID NO: 66385 - DNA, 201 bp, Homo sapiens
actatcaacatcgcttccttcacatcccactagctcagtcagtctcaggccaatgcctgtccatcctcctcaaagatctccaaaggtaaaccttttatatyttccctcggtcacctgcttgagtctttttttatacttcttgatggttaagaagttctttcttgtatccaaataaggcaatagatgctttgaggtccaggg

SEQ ID NO: 66386 - DNA, 201 bp, Homo sapiens
gagggaatagagctggaggcatgggcaggaaaagcagtatgtgatcttcttgggactgtagctggcacgtggtaggggcaggtgggagacccaagtcagarccattggtatatccccctgctgccacatggcacatgacttcacagttacctttttgcttgtcttcatcccgcacaagagagtaagggcaaggactttttc

SEQ ID NO: 66387 - DNA, 201 bp, Homo sapiens
agagccattggtatatccccctgctgccacatggcacatgacttcacagttacctttttgcttgtcttcatcccgcacaagagagtaagggcaaggacttyttcttatttaccaattcccagcaccttaacacaatgtctggcacacagtaggctctcaaacacttgaatgaatgaatgaatgaatgaatgaatggtgtct

SEQ ID NO: 66388 - DNA, 201 bp, Homo sapiens
tcatgggcagggctgatgctagggtttaattccagctacttgacccctctccactagcttctaaggctccctttacagaacttcctccccacccccagtaycttcaggagacacattgtgtgccagtgaacaggccagtggaagagcaagcagatccccgacttccagcccaagaactacacacttttcaaattccctttg

SEQ ID NO: 66389 - DNA, 201 bp, Homo sapiens
gggaagttctcagtaaacaactgtagaataagtcagtgttcccagccccttggctccaaagctgcccataggctctcccatacgtgccctctccctttccytgccttacaatcttctctcatccgaaacaggcactgggtcccagcagagggtccaagggaagcaccaggtcctgctagaggaccctgagcaggagggcag

SEQ ID NO: 66390 - DNA, 201 bp, Homo sapiens
aaaagctcttctcaaagcagtgagtatttggggagcaacagccttgggcattccttgggcagggacctcagccctttcatgtaccagtatgttggcagagkgccttcctgtgtttctgggagccacaggcccaaactcagaccacagccactttctccccttgccaaatccagtgcaggatctctgaggttcaggtgaatg

SEQ ID NO: 66391 - DNA, 201 bp, Homo sapiens
ctgcagctgagagacctcatcatctctgagatgcagcggctcaccaagtacccgctgctgctggagagcatcatcaagcacacagagggtagcacctgggraggggctggcatcacaggcagtgggcctcgtgccagaccctcattctgacactgctttgtgaccttagcaagtcactgtgccttgtggtctttggtgtct

SEQ ID NO: 66392 - DNA, 201 bp, Homo sapiens
cctcaaatacattgggaagcccaaaagctcttctcaaagcagtgagtatttggggagcaacagccttgggcattccttgggcagggacctcagccctttcrtgtaccagtatgttggcagagggccttcctgtgtttctgggagccacaggcccaaactcagaccacagccactttctccccttgccaaatccagtgcagg

SEQ ID NO: 66393 - DNA, 201 bp, Homo sapiens
gaaaaatgcggtaaggcagtcatagattggattataattttatcatattctttgaactactcagaggcagggaaaattaagcaaaacatccaggccaaacrgagacaggttcttaaagagaaatctaggctgagagattaatattcctggattctgttcctagcgccactctcaaaaaatctcacagtacctctgttgttc

SEQ ID NO: 66394 - DNA, 201 bp, Homo sapiens
aactattttcttctcaggccggctctctctggattcccaggagggggacagtggcttggactctgggacagaacgctttccttccctcagtgaggtgagtyccagcagggcaaggcccattcagaacgtgcattcggggtcccttcccttgacccaagttctgctgcctaccagctgcactgaggcctctgtgtgcctctt

SEQ ID NO: 66395 - DNA, 201 bp, Homo sapiens
gtccttagtttccttgtctgtgaaatgagagtgttgagattctttctagcctttatcatttataattctgtgagatgtagatttgcattattttcgagttygagttatatgaaatgtttccctctacattttcttgggcaactgagaactgaatagggctaggtttaaatagagttaggcagttaggcttattcttttatt

SEQ ID NO: 66396 - DNA, 201 bp, Homo sapiens
tgcttatgcttttggtgtcatatctagaaaaccactgcctaactcaaggtcacaaagatttattcctatgttttcttctaagagttttacagttaggtcartgatccattttgagttaattcttgagttaattcttgtatatgatgtgaggcaggggtctagcttcattattttgcatgtggatatccagttgtcttagca

SEQ ID NO: 66397 - DNA, 201 bp, Homo sapiens
tattcatatatatattttcatatatatattcatatatattcatatatgtattttcatatatatattcatatagattcatatatatattccatatagattcatatatatattcctatatatagattcatatatatattcctatatatagattcatatatatatattcctatatatagattcatatatatatattcctatata

SEQ ID NO: 66398 - DNA, 201 bp, Homo sapiens
attcatatatatattttcatatatatattcatatatattcatatatgtattttcatatatatattcatatagattcatatatatattccatatagattcatatatatattcctatatatagattcatatatatattcctatatatagattcatatatatatattcctatatatagattcatatatatatattcctatatat

SEQ ID NO: 66399 - DNA, 201 bp, Homo sapiens
attttcatatatatattcatatatattcatatatgtattttcatatatatattcatatagattcatatatatattccatatagattcatatatatattcctatatatagattcatatatatattcctatatatagattcatatatatatattcctatatatagattcatatatatatattcctatatatagattcatatat

SEQ ID NO: 66400 - DNA, 201 bp, Homo sapiens
ttttcatatatatattcatatatattcatatatgtattttcatatatatattcatatagattcatatatatattccatatagattcatatatatattcctatatatagattcatatatatattcctatatatagattcatatatatatattcctatatatagattcatatatatatattcctatatatagattcatatata

SEQ ID NO: 66401 - DNA, 201 bp, Homo sapiens
agtttgacagtacttcagaacatgaaacacagcaatactatatgacccagcagttccactcccaggtatatatccaagagaattgagaacataggttcacmcaaaaacttgtacatgaacattcataccagcattattaataatagccagaaagtagaaacaacccaaatgttcttccgctgatgaatagataagcaaaat

SEQ ID NO: 66402 - DNA, 201 bp, Homo sapiens
gaagatatactatattatgataagtgctaacatttatatattggcaaatgtcagagtaatcaagacagtataatactggttcaaggatagacctgtagatsaatggaatagaattcacatgccagaaattaacccatacatctatggtcaattgattttcaacaaaggtaccaagacaattcaatggagaaagaatagtat

SEQ ID NO: 66403 - DNA, 201 bp, Homo sapiens
attcaaattacagtaggagggagagtgggaggaacaaagagcttacaataagagaacaaagaagagaaaaattaattaataatgggaaatatggggaagcrcttcacagagaggatagtatttcagctgggccttgaagagtggtactttagtaggcaaaagagatgagggagggaatgccagtgaaaagacagcataggt

SEQ ID NO: 66404 - DNA, 201 bp, Homo sapiens
ttcctatatatagattcatatatatatattcctatatatagattcatatatatatattcctatatgtattcctatatatattcctatatatattcctaaayatatacatatatatattcctatatatatattcctgtatatatattcctatatatatatattcctgtatatatatatattcccacatagccacccaaactc

SEQ ID NO: 66405 - DNA, 201 bp, Homo sapiens
tttactgcattccggcaaggtactgaataaaacatacttatgatccaggctctattctcatagctgtccttgcccaggaaccagcagatagaagagagctmagctgttgagttagtccctaactcttatattgccatattttccatgtctaggatcccgaagttcaaaaacatgccacccagatcctcaggaatatgctga

SEQ ID NO: 66406 - DNA, 201 bp, Homo sapiens
catacagtgggcaaggatgtggtggctgggctaacccagcgggagattgaccggcaagaggtcatcaatggtgagaacgtgctccactgcccccagctccrctcacacgtgtgggaataggtccagaatgcctaagacacaagggtgggaaagaggtaaatagggtggggggcccctgtgtgctggagcaggtccacattg

SEQ ID NO: 66407 - DNA, 201 bp, Homo sapiens
gccccagctgagtgactaactagctatgtgatcaggataatttgtaccagcctgaccaacatggagaaaccccgtctctactaaaaatacaaaattagccrcacgtggtggtgcatgcctgtaatcccagctactcgggaggctgaggcaggagaatggcttgaacccaggaggcagaggttgcggtgagccgagattgcg

SEQ ID NO: 66408 - DNA, 201 bp, Homo sapiens
tgatccgagagggaggaaaggagggaggaaaggtcaggcctggcattccaggaggtttcctttgtagatatgtgaggcagctaaagtcacatctttaatcktaacatggagtgatccacttaagtggccacaattccctattacttcaagtggagacagtactaggctctcatgagacatcttcatttttacccacactca

SEQ ID NO: 66409 - DNA, 201 bp, Homo sapiens
gagaatggcttgaacccaggaggcagaggttgcggtgagccgagattgcgccattgctctccagcctgggcaacaagagcgaaactccatctcaaaaaagaaaaaaaaaaaaaagcattttgtgaattccatggtgccaaacatacggtgagtgttgttagggcatttggtttggcagggaccccagattgtcctaaactc

SEQ ID NO: 66410 - DNA, 201 bp, Homo sapiens
aggagaattgcttgaactcaggagctggaggttgtagtgagctgagattgcgccattgtactctagcctgggcaacagagcaagactctgtctcaaaaacaacaacaacaacaacaacaacaacaaaaaccaccaaagtggttgcaccattttacatttccaccagcaatctgtgagggcccagttttttcatatctttct

SEQ ID NO: 66411 - DNA, 201 bp, Homo sapiens
cagaacaaattcatagtgtgacttgagtaaacaagtgaccagaggaggctaaagagcattggaaaatggcttcctaaaaacatggcattttgggccaggcrcagtggctcacgcctgtaatcccagccctttgggaggccaagacgggcggatcacaaggtcaggagatcgagaccatcctggctaacacagtgaaacccc

SEQ ID NO: 66412 - DNA, 201 bp, Homo sapiens
gctcctctcacctgcaaggggctggttgggtggctgtctcctcttctgggcccactggtttcccatgtgcatggggcaagcaggtcgggcaggagagggarggccaaaccctctgtgtgagttcttcctcctaaatgaagctgagctgcctgttttcccccaggagcattgagtcccccagtttggggttctgcacagata

SEQ ID NO: 66413 - DNA, 201 bp, Homo sapiens
tgaaatcctttttcttggggctgacctcggaagcactgaattgctttctggcaagaggtccaagaaatacactttttaaaaattcccacagtgattctcakgcttgctgaagtctgagaatttctgctcaagttccttaactctgaagagtttagtttaaaaaaaaaaaacactaagttattagaagtcacctcacgtgtt

SEQ ID NO: 66414 - DNA, 201 bp, Homo sapiens
gttgacatggatgctgctgcggaggctactcgcctgcaccagtcagcctcgtcctctacctccagcctctccaccaggtgggcagggctacaacggctgcrcccatggacatctcaggggtggcggcaaggatagagggttgctgagagttgacattccctccacaggtctcttgagaacccaacccctccattcactccc

SEQ ID NO: 66415 - DNA, 201 bp, Homo sapiens
ttccagatacatattaggtttctttaattcactgtcaaagtatagtctgtgttctgcctgtattagaatcacctaagcccaagatgattgaaatccttttycttggggctgacctcggaagcactgaattgctttctggcaagaggtccaagaaatacactttttaaaaattcccacagtgattctcaggcttgctgaagt

SEQ ID NO: 66416 - DNA, 201 bp, Homo sapiens
caatatggtgaaaccctgtctctacaaaaaatacaaaaattagcatgtgttggcacatgcctgtagtcccagctacttcggaggccgagatgggaggaccrcttgagcccaagatgttgaggctgcggtgagccaaaatcgcaccgctgcactccagcctgggtgacagagtgagacacagtctcaaaacaaacaaacaaa

SEQ ID NO: 66417 - DNA, 201 bp, Homo sapiens
cccagacttttagccagcttctgcctgctgtcccatttaattattctagacttttctttgaatactttcacctgtaactaccccttccccactccactgcrtggtggtgaagagattgtttggcacagggaagataacttgagctctctgattcaggacactgttcctcttttacagcgcccccatggacttcgccctcaa

SEQ ID NO: 66418 - DNA, 201 bp, Homo sapiens
ggggataactgagaagttgggtcagaaaatctgtctcagtggtgccatttagagtacaaatttggggggaaattctccactcctcagggccgcctccatayccgcaggtttaggctgagcagaatctgagctctgctgccaaattttgatgagaatgtcctcaggaaaagggaggggccaccattaaaatcttttctatct

SEQ ID NO: 66419 - DNA, 201 bp, Homo sapiens
ttgtccctccaacaggtcaacggcaccatggtgaccaatagctcacacctggaagtggtaaagctgatcaaatgtgagttggagagaggtgacaactaaartagggaagcagatgatccgagagggaggaaaggagggaggaaaggtcaggcctggcattccaggaggtttcctttgtagatatgtgaggcagctaaagtc

SEQ ID NO: 66420 - DNA, 201 bp, Homo sapiens
atgaaggcagggattagagaatgggtggggcattaaaagtgaggagaacttaatctacagaataatgagtttaatgacaggacaagggagaacagcccccycctgtatagctggactgtctctccagaacagcactcctggaacaagtctctctctgtttccctctagctggcgcctatgtcgcactcaccctcctgggct

SEQ ID NO: 66421 - DNA, 201 bp, Homo sapiens
gaaggcagggattagagaatgggtggggcattaaaagtgaggagaacttaatctacagaataatgagtttaatgacaggacaagggagaacagccccctcytgtatagctggactgtctctccagaacagcactcctggaacaagtctctctctgtttccctctagctggcgcctatgtcgcactcaccctcctgggctct

SEQ ID NO: 66422 - DNA, 201 bp, Homo sapiens
accacctcctccacctctaccacctccacaacgcatcacaggacccaaacctctgcaggtaataatcctcctggctttctttcctcaccctaatgtcctgwtgaaaagctccgcattggggaggaaagcaagttaaatccagtggggctgtggtaaacagagacaagccaaaagacatatgaaagaccattgaaagagttg

SEQ ID NO: 66423 - DNA, 201 bp, Homo sapiens
ctctcatgtttcttctaagagtttcatagtttaactcatatagtctatggtccattttgagttaatttttatgtatggtatgaggtaggggtccaacttcrtacttttgcttatggatttctgattgtcccagccccatttgttgaaaaaactattctttctccatttaattgtcttggcacctttgttaaaaatcagtgg

SEQ ID NO: 66424 - DNA, 201 bp, Homo sapiens
ttgctctccagcctgggcaacaagagcgaaactccatctcaaaaaagaaaaaaaaaaaaaagcattttgtgaattccatggtgccaaacatacggtgagtkttgttagggcatttggtttggcagggaccccagattgtcctaaactctcctcagctgccactagaatacccatgcttgaattaccctcagtcctgtgctg

SEQ ID NO: 66425 - DNA, 201 bp, Homo sapiens
ggagaattgcttgaactcaggagctggaggttgtagtgagctgagattgcgccattgtactctagcctgggcaacagagcaagactctgtctcaaaaacaacaacaacaacaacaacaacaacaaaaaccaccaaagtggttgcaccattttacatttccaccagcaatctgtgagggcccagttttttcatatctttctt

SEQ ID NO: 66426 - DNA, 201 bp, Homo sapiens
gagaattgcttgaactcaggagctggaggttgtagtgagctgagattgcgccattgtactctagcctgggcaacagagcaagactctgtctcaaaaacaacaacaacaacaacaacaacaacaaaaaccaccaaagtggttgcaccattttacatttccaccagcaatctgtgagggcccagttttttcatatctttcttt

SEQ ID NO: 66427 - DNA, 201 bp, Homo sapiens
ctaccaaacttttccaaagtggttgtaccattttacattcccaccagcaatctgtgagggttctagtttctccacatcctctccagcagttgttattatcttttttttttttttttgagatggagtctcgctctgttgcccaggctggagtgcaatggcacaatcttggctcactgcaacctccccctccctgtttcaaat

SEQ ID NO: 66428 - DNA, 201 bp, Homo sapiens
attgcctacctcaaaagtcacgaagatttactctcatgtttcttctaagagtttcatagtttaactcatatagtctatggtccattttgagttaatttttrtgtatggtatgaggtaggggtccaacttcgtacttttgcttatggatttctgattgtcccagccccatttgttgaaaaaactattctttctccatttaat

SEQ ID NO: 66429 - DNA, 201 bp, Homo sapiens
cctctgggctgtcttttcactttcttgatggcatcctttgaagcacaaaggttttttattttgatgaagtccagtttttatatattttttctttttttgcktatgcttttggtgtcatatctagaaaaccactgcctaactcaaggtcacaaagatttattcctatgttttcttctaagagttttacagttaggtcaatga

SEQ ID NO: 66430 - DNA, 201 bp, Homo sapiens
aatagtctagggaatttgtttagtgtgaaaaggcttcttgaagaagaaaggcactggggcttccctgggttggtcttggcatgtgtacactaacctcccartgacactgcgtactcaacctttctctccgccttccaggtctcgttcaacgctgtgtcattatccaaaaggaccagcatggcttcggcttcacagtcagtg

SEQ ID NO: 66431 - DNA, 201 bp, Homo sapiens
ttgaagcacaaaggttttttattttgatgaagtccagtttttatatattttttctttttttgcttatgcttttggtgtcatatctagaaaaccactgcctaactcaaggtcacaaagatttattcctatgttttcttctaagagttttacagttaggtcaatgatccattttgagttaattcttgagttaattcttgtata

SEQ ID NO: 66432 - DNA, 201 bp, Homo sapiens
gagacaagcattttagcacctcagagaagggtagtttcttatttggaatacaaagttaagttataggttttgccaaccaccaagggaggcgtgtcattgcratagtgtttagacaggaatagtctagggaatttgtttagtgtgaaaaggcttcttgaagaagaaaggcactggggcttccctgggttggtcttggcatgt

SEQ ID NO: 66433 - DNA, 201 bp, Homo sapiens
tttaataagcatttttggagcatctacggtgttccaggaactgaactgttgtaaacattggagctgtaacagagaacaaaagagacaaaaaaaaaaaaacaaaaaaaaaaaacctttgccttcttggagcttacattacattctaaacaaattaaataagaaagttatttgttagatattactgtgtattagataatatgg

SEQ ID NO: 66434 - DNA, 201 bp, Homo sapiens
ccaggattccagataggtggtgttaccagtggtgtacacatggctaatgtcctaccagattgggttacagggcgggtaggttggtctctcattatccaagrctcagggccccttttgacagagcctccatctactacaaggctgatcccccctgctgagctcattgacatgctttccttactccttctccaggttaagtag

SEQ ID NO: 66435 - DNA, 201 bp, Homo sapiens
cccatgggatgattgctccagaacactgcacagtagcttacggacaggtgcaaatgggacagaccctgcctaggcgctcactctgccggggggagcttgtyatgggaagacattggacttggagttaggagacctgggttcatgtctgccagccttctacatgacctctctgggcctccgttggcttatctgaacaaagag

SEQ ID NO: 66436 - DNA, 201 bp, Homo sapiens
gttctctctcctcctagcttttttacctgtgtgcagaagtttatcagcaggcaagccccaaggattcccgaagcttggggaaagacatctggaatattttyctggagaaaaatgcggtaaggcagtcatagattggattataattttatcatattctttgaactactcagaggcagggaaaattaagcaaaacatccaggc

SEQ ID NO: 66437 - DNA, 201 bp, Homo sapiens
tgaggcggaaggatcagataagaccaggaactggaggtttcagtgaactattatcataccactgcactccagcctgagtgacagagcaagactttgtctcaaaaaaaaaaaaaaaaaaaatagagagagaggttcctaagctcagccagctagtaagtggcagaatcaggatggagacccttgtctttttttttttttttt

SEQ ID NO: 66438 - DNA, 201 bp, Homo sapiens
ttcattctttcttatgactgagttctgtgtcattgtattactgtaatttatttaaccagtcactcattgtgaacatttagattatttccagtgctttgccrtcacacacagtgcttccatgagtagccttctacttagtcttttgctataggtaggataggaattgcccctttctgaggggcagcaactattgattcagga

SEQ ID NO: 66439 - DNA, 201 bp, Homo sapiens
agagcaagactttgtctcaaaaaaaaaaaaaaaaaaaatagagagagaggttcctaagctcagccagctagtaagtggcagaatcaggatggagacccttgtcttttttttttttttttttttttgagacagagtctcgctctgtcgcccaggatggagtgcagtggcgtgatctcggctcactgcaagctccgccccccg

SEQ ID NO: 66440 - DNA, 201 bp, Homo sapiens
aggggcttaaagtctaaaagagatgacagactaacagatgatatcaatatgtgttcattttgcagataagaaagatgatagactgatgatagactcataarttaagggacttgtttcaagagtttctccaagttacggtcctctgaataaggaatggcttgggctgcttgttgaaatagattccacaccacagacctgctg

SEQ ID NO: 66441 - DNA, 201 bp, Homo sapiens
gataactgagaagttgggtcagaaaatctgtctcagtggtgccatttagagtacaaatttggggggaaattctccactcctcagggccgcctccatacccscaggtttaggctgagcagaatctgagctctgctgccaaattttgatgagaatgtcctcaggaaaagggaggggccaccattaaaatcttttctatctatg

SEQ ID NO: 66442 - DNA, 201 bp, Homo sapiens
gactccaggaacagccatgaactggggccctgccctgaggatggtgagtgaagccaggtccctctcggttcctaccattgggggagaagtctgccaactcrtgaggacacatcactaagcagtgagagatggtggttctgagagtggtttccccttgagtgaaacgagttcattctctcagcttcagagagggatcttttt

SEQ ID NO: 66443 - DNA, 201 bp, Homo sapiens
agcaagactttgtctcaaaaaaaaaaaaaaaaaaaatagagagagaggttcctaagctcagccagctagtaagtggcagaatcaggatggagacccttgtcttttttttttttttttttttttgagacagagtctcgctctgtcgcccaggatggagtgcagtggcgtgatctcggctcactgcaagctccgccccccggg

SEQ ID NO: 66444 - DNA, 201 bp, Homo sapiens
ccttcagctaacatttttggagcgaccctcactatgcaccaggcactgtgctggaactcagctggtgatacaaggatgaataagacatggtccctgttctyaggggcttaaagtctaaaagagatgacagactaacagatgatatcaatatgtgttcattttgcagataagaaagatgatagactgatgatagactcataa

SEQ ID NO: 66445 - DNA, 201 bp, Homo sapiens
aagcttactggctaatatatgttgaaggaatgatagaattagcaaattgccattttgcaggcaccagtgcaataagcgctttaggcaagaatcatctatgratagtaaaactattggatgagagattgttggaaaacagagtatctatgcagtctcaaaatatcatcccacagatttctcattaattcaaatgagaaaata

SEQ ID NO: 66446 - DNA, 201 bp, Homo sapiens
ttcctcttgatgtcttgagatgctattcttttcattgaacataagtttgatggaggactccgtgacaaaagcaaataaatataggctaaacataatattcrgcagtagatcatctaggagatcttaggagatctgtaaaatggttgcatctatattagataactcaagacttgattttgtgtttcaaggcaggatgtgctt

SEQ ID NO: 66447 - DNA, 201 bp, Homo sapiens
actttcaaagcacttaataaatattatcttttttgccctcacatcagccctggaagaaagaaaggacgtatatgggtccttcagctaacatttttggagcraccctcactatgcaccaggcactgtgctggaactcagctggtgatacaaggatgaataagacatggtccctgttctcaggggcttaaagtctaaaagaga

SEQ ID NO: 66448 - DNA, 201 bp, Homo sapiens
gatgcttcactgtcttatttgcagaattcagttgtagcaatctggggcattgaagaatttaggagcttaaatagttcttacagggtcaccagtggtactcyccgcctaagtccatagagaggctaacacccttctagtttattagtctttgttaaacctatgaaattatgaatttaatcctaatttatatgcattgtggag

SEQ ID NO: 66449 - DNA, 201 bp, Homo sapiens
gactctctcccccagggtgtagatcaaagcccaaagcctttaattattggcccagaggaagactatgacccgggttatttcaacaacgaggtaacggtttsctagttttctcctttcatcatttttttttgtcatacaagctgctcttgactagaagcagtttgactagcatcagctgtgaagggaacttgaggcggggag

SEQ ID NO: 66450 - DNA, 201 bp, Homo sapiens
ctccctcttcctgccctgcacacaggtgcccagaataaaggctctctttcccctaggccacagctccttctgtgttatagaaactattttcttctcaggcyggctctctctggattcccaggagggggacagtggcttggactctgggacagaacgctttccttccctcagtgaggtgagtcccagcagggcaaggcccat

SEQ ID NO: 66451 - DNA, 201 bp, Homo sapiens
ccccctccctcctgctggggcagcctccatgatttcccttcctgtggctttgctctccacccctgacttctactcctaataatcagatcttggatcttccwgaaagttgctttatgttgtctggagttgcacagctagtaaatggcagaattagcaccaatatctaggtctcctggcttcctcttgatgtcttgagatgct

SEQ ID NO: 66452 - DNA, 201 bp, Homo sapiens
actggtgaaagaaaaggtggcagctccctcttcctgccctgcacacaggtgcccagaataaaggctctctttcccctaggccacagctccttctgtgttayagaaactattttcttctcaggccggctctctctggattcccaggagggggacagtggcttggactctgggacagaacgctttccttccctcagtgaggtg

SEQ ID NO: 66453 - DNA, 201 bp, Homo sapiens
cagggagaggaagctgggactttggtatcagacacacttgaacttgtgtcctggctctactatttaatagctgtatggcctggggcgacttatgtaacttwgctgaacctcattttccttatccgtaaaggaaaataacactgttatctcaccaggttgtcaggattaaatgaatgcctgtaacacatgtttattatatgt

SEQ ID NO: 66454 - DNA, 201 bp, Homo sapiens
tttccctgtctttttcttgcattcattttctctgctgctccgttctgttccatcagccccattgcagcctggtaagacccaacaagcatgtacacgtgtgyacatccccttcttgctattgtctctttgtcgcctaactccaggaagggttatttcccttcacaccttgctgggtattaaagagatcatgcttgccctgcc

SEQ ID NO: 66455 - DNA, 201 bp, Homo sapiens
ctcttctgtccattttggtaggtggcacctctgagcatgagaagctgtgccgggcccgggaccagtgccgggagattctcaagtatgtgaatgaagcggtraaacaaacagagaaccgccaccgtttagagggctaccagaaacgcctggatgccaccgccctggagagggccagcaaccccctggcagcagagttcaagg

SEQ ID NO: 66456 - DNA, 201 bp, Homo sapiens
gcctgtaatcccagcacgttgggaggctgaggctgaggatcccttgtgcccaggagtttgagaccagcctgggcaagatagtcagagctcatctctatttaaaaaaaaaaaaaaaaaacaagctgggcagctactcagggagcttaggtgggaggattgcttgagctcgaacccaggaagtcgaggctgcagtgagccgtg

SEQ ID NO: 66457 - DNA, 201 bp, Homo sapiens
tctatgtgagaccgtaagctcgaggatgccagaacttctgactgacctttcaagagaagtcagaaatctgtattttattgcttagcaactaacttttaaaatatatatatatatacacacacacacatatatatacacattcacacacagacacaccgcagaccaacaaaaaggatatgtgggctctctggaaggtcacca

SEQ ID NO: 66458 - DNA, 201 bp, Homo sapiens
ctatgtgagaccgtaagctcgaggatgccagaacttctgactgacctttcaagagaagtcagaaatctgtattttattgcttagcaactaacttttaaaatatatatatatatacacacacacacatatatatacacattcacacacagacacaccgcagaccaacaaaaaggatatgtgggctctctggaaggtcaccaa

SEQ ID NO: 66459 - DNA, 201 bp, Homo sapiens
gcctgagtgacagagcaagactttgtctcaaaaaaaaaaaaaaaaaaaatagagagagaggttcctaagctcagccagctagtaagtggcagaatcaggayggagacccttgtcttttttttttttttttttttttgagacagagtctcgctctgtcgcccaggatggagtgcagtggcgtgatctcggctcactgcaagc

SEQ ID NO: 66460 - DNA, 201 bp, Homo sapiens
taagctcgaggatgccagaacttctgactgacctttcaagagaagtcagaaatctgtattttattgcttagcaactaacttttaaaatatatatatatatacacacacacacatatatatacacattcacacacagacacaccgcagaccaacaaaaaggatatgtgggctctctggaaggtcaccaagcatctccttgct

SEQ ID NO: 66461 - DNA, 201 bp, Homo sapiens
aaagggtgcacagcctagggcagtgctggattgttctactaaggggtgaagatggtgccctcagagccgggctctgcttcgtttctgggagacagttgtgyctctttactctaggactcacagtccagcgaacaaggagagaggtcgacaatgtggaaggtgcttttgcagaaatatataccaggtgctgtgggagacaga

SEQ ID NO: 66462 - DNA, 201 bp, Homo sapiens
aagctcgaggatgccagaacttctgactgacctttcaagagaagtcagaaatctgtattttattgcttagcaactaacttttaaaatatatatatatatacacacacacacatatatatacacattcacacacagacacaccgcagaccaacaaaaaggatatgtgggctctctggaaggtcaccaagcatctccttgctt

SEQ ID NO: 66463 - DNA, 201 bp, Homo sapiens
agcctggcccacatggcaaaaccccatctttactaaaactacaaaaattagcctggcatgttgacacacgctataattccagctgctcaggagactgaggyacaagaatcacttgaacctgggaggcgaaggttgcagtgagctgagatcgcaccactgcactccagcctgtgtgatagagtgtgactgtctcaaaaaaat

SEQ ID NO: 66464 - DNA, 201 bp, Homo sapiens
tgtcgcccaccctgtgggctggggtgaggagcatgtggatgcatagttagaaggcacctgctctgtgccttgtgctgcactcaggcataccgggaagtccmcactgcaacctctgccctccagcaaataggcaggactgacgcaccaggccacagggagccttggaggaggggagaatgtgtgcgccaatgcgggctgcat

SEQ ID NO: 66465 - DNA, 201 bp, Homo sapiens
cagttagggaaactaggatccagccaaggcccggggggagacccgcatgttgcttggtctgctcaagtcggagtcaggtttcagtgtcttttccctccctyagcccaaccctccaaggcctcatgtctcctaagcatgctgactgcatccgaaaggcccccactcaccatggtctgccctcaccccacatatgtgtgtaca

SEQ ID NO: 66466 - DNA, 201 bp, Homo sapiens
gctcacttgaggtcaggagtttgagaccagcctggcccacatggcaaaaccccatctttactaaaactacaaaaattagcctggcatgttgacacacgctmtaattccagctgctcaggagactgaggcacaagaatcacttgaacctgggaggcgaaggttgcagtgagctgagatcgcaccactgcactccagcctgtg

SEQ ID NO: 66467 - DNA, 201 bp, Homo sapiens
gggctggggtgaggagcatgtggatgcatagttagaaggcacctgctctgtgccttgtgctgcactcaggcataccgggaagtccacactgcaacctctgmcctccagcaaataggcaggactgacgcaccaggccacagggagccttggaggaggggagaatgtgtgcgccaatgcgggctgcattgtaaagaagaggaa

SEQ ID NO: 66468 - DNA, 201 bp, Homo sapiens
acagtggatcatacctataatccaagcactttgggaggccgaggcaggtggctcacttgaggtcaggagtttgagaccagcctggcccacatggcaaaacsccatctttactaaaactacaaaaattagcctggcatgttgacacacgctataattccagctgctcaggagactgaggcacaagaatcacttgaacctggg

SEQ ID NO: 66469 - DNA, 201 bp, Homo sapiens
gcaaaaagtacaaggcttggtcttcccatcttactgttaagaaagctgagactgagaagtggtgtggcttgcccagtgccacacagtggctacgatgtggygaggaggaaacctcattccacagatggaggcctttcccttcggccctggcaagtccctgtgacagatgcttgttctttatcttgtaggttctaggttctg

SEQ ID NO: 66470 - DNA, 201 bp, Homo sapiens
gaggagcatgtggatgcatagttagaaggcacctgctctgtgccttgtgctgcactcaggcataccgggaagtccacactgcaacctctgccctccagcarataggcaggactgacgcaccaggccacagggagccttggaggaggggagaatgtgtgcgccaatgcgggctgcattgtaaagaagaggaagagttctgcg

SEQ ID NO: 66471 - DNA, 201 bp, Homo sapiens
acgcctctgcactccagcttgggctacagggcaaggctgtctataaaaaaaaaggaggggagaaactgtaaatggcttaaaacagtttttttaaaagaaakaaaacagttgtctttaatgatgtgaataccgagaatatctttatgaacctctcaggacttaggaaactcttgttttaatccttttctctgaatttctctt

SEQ ID NO: 66472 - DNA, 201 bp, Homo sapiens
aaggtattatcactttcgtgatgatttacttcagaacatatttacttatcttttcaggaaaacattaggtaaaacaagatatgcctgtagggccgggcacrgtggatcatacctataatccaagcactttgggaggccgaggcaggtggctcacttgaggtcaggagtttgagaccagcctggcccacatggcaaaacccc

SEQ ID NO: 66473 - DNA, 201 bp, Homo sapiens
ctgaggcaggagaatggcatgaacccaggaggtggagcttgcagtgagccgagatgggccactgcactccagcctgggtgacagagcaagactccatctcaaaaaaaaaaaaaaaaaaaaaagtggcattttgaacttacagaaggatcccctagctgttcattaccattactcaatactgtttgtccctccaacaggtca

SEQ ID NO: 66474 - DNA, 201 bp, Homo sapiens
cgactcaagtaacaactccgtttatacaaggtataaagtatgccttctttgaagaaaatccagtcttttgagaatttatatttaaggtattatcactttcrtgatgatttacttcagaacatatttacttatcttttcaggaaaacattaggtaaaacaagatatgcctgtagggccgggcacagtggatcatacctataa

SEQ ID NO: 66475 - DNA, 201 bp, Homo sapiens
attattatcatcatgagttcccatttatcaatcagtcacaagaatttactaagagtatatgcttagcactgtgttagttattgcaggctctatcaacaaartatatgtgacaggatttctgcttgtgaggagtttatcatctagttggagtgagatatgaacaatatggatgaaatgatttgataacaagtgccaaatagc

SEQ ID NO: 66476 - DNA, 201 bp, Homo sapiens
tagctcttattattattatcatcatgagttcccatttatcaatcagtcacaagaatttactaagagtatatgcttagcactgtgttagttattgcaggctytatcaacaaagtatatgtgacaggatttctgcttgtgaggagtttatcatctagttggagtgagatatgaacaatatggatgaaatgatttgataacaag

SEQ ID NO: 66477 - DNA, 201 bp, Homo sapiens
tttttcagctcttactgccattcaacattacttgtatccatgagatggcttctttcctccctcaccccacccgtcttcagtttcctggaaatggaatgggsgctggaagagagaaaggatggaaattcccattgcatctctctcggctatgcagtggttcagatggggttttggtgaggggggttgggagaagtagaaaga

SEQ ID NO: 66478 - DNA, 201 bp, Homo sapiens
aatttgctagctcttattattattatcatcatgagttcccatttatcaatcagtcacaagaatttactaagagtatatgcttagcactgtgttagttattrcaggctctatcaacaaagtatatgtgacaggatttctgcttgtgaggagtttatcatctagttggagtgagatatgaacaatatggatgaaatgatttga

SEQ ID NO: 66479 - DNA, 201 bp, Homo sapiens
ccatcaattgtcaactgatttgccacacaagtggattgaagaatgctgtgtgtagaaacctatattttacagtgaatgttttatgtgtatgtacatatacrcacatgcccatgcaaaaacatgtttttcatccaactggccagcagaggagaatgcaaaatttcaaaaatgggagatatactcttttctttcaaggagttt

SEQ ID NO: 66480 - DNA, 201 bp, Homo sapiens
taattaaactggccctccgattcttagcccatatgattgtgtgattccatcttggatagctccactttctctttggctatctagtcttttaaatttgtgaygtgtgggccaggtgcagtagctcatgtctataatcctagtgctttgggagtctaaggcaggaggatcccttgaagggccaggaagttcaagaccaggctg

SEQ ID NO: 66481 - DNA, 201 bp, Homo sapiens
ctgagtgaaataatactttatcagagcagcctgccaatgtacacaacttaatttacaggcaatatcctatcacagtaaaacctcaaaaaataaaacttcckgaccactaaagaattgtcattggccagtagaatttgttaaagcagaatttcaccaataaagtgaataggattctccatgtgtaatagattaggatagtga

SEQ ID NO: 66482 - DNA, 201 bp, Homo sapiens
atatggtgacaccagccagagaccatcagaaggtaagtcccccatcaccccttttttctctggcatatctctagtccaggtttcttacctgtttaccctcsccatggggcagattccaggaaagaaaatatatagtgcctgccctctgagaaatgaaataatgggagaaagcagtacaaatacacagggaagctggataca

SEQ ID NO: 66483 - DNA, 201 bp, Homo sapiens
ccacaacgcatcacaggacccaaacctctgcaggtaataatcctcctggctttctttcctcaccctaatgtcctgttgaaaagctccgcattggggaggaragcaagttaaatccagtggggctgtggtaaacagagacaagccaaaagacatatgaaagaccattgaaagagttgaacaaaaatgaaggctgcacaataa

SEQ ID NO: 66484 - DNA, 201 bp, Homo sapiens
aggaatctggctgaagatgcttcaagcacagaggcagcaggaggttacaaagttgtgagaaaaggtaaaataaatgggagtgtccagtggggagacaagcwcccttgctaggtgagataagtcttccgaacagctgcttccttccctatactccccctgggtaccgtgtgagcagagacctacgctgggtcctggaagaag

SEQ ID NO: 66485 - DNA, 201 bp, Homo sapiens
aggcactggggcttccctgggttggtcttggcatgtgtacactaacctcccagtgacactgcgtactcaacctttctctccgccttccaggtctcgttcarcgctgtgtcattatccaaaaggaccagcatggcttcggcttcacagtcagtggggatcgcattgttctggtgcagtctgtgcggcctggtgagtgctgca

SEQ ID NO: 66486 - DNA, 201 bp, Homo sapiens
ctcaggaggctccagaggacagaagggacatagtccctgtccttgggcaaccgtcctgtaatagaggaaaagacccatgggatgattgctccagaacactrcacagtagcttacggacaggtgcaaatgggacagaccctgcctaggcgctcactctgccggggggagcttgtcatgggaagacattggacttggagttag

SEQ ID NO: 66487 - DNA, 201 bp, Homo sapiens
tctcactacagtcctctctgttcctgccgagcaacagatggatggagctcttagaagaggccgtgcggaatgccaccaggcaccccggagctgccccaatrcccgtccatcctccacccccaggtccccgggagccagcccagcagggccccacacccagcaggtgcagtgcttagccctccagaccctgcactctctcca

SEQ ID NO: 66488 - DNA, 201 bp, Homo sapiens
tctaccaaaaatacaaaaaattagccagacatggtggcatgcacctgtggtcccaggtactcaggaggctgaggcaggagggttgtttgagcccaggaggyggaggttgcagtgagccatgatcgtgccaatgcactccagcctgggtgacagagtgagaccccatctcaaagaaaaaacaaaacaaaaaaacaagtagaa

SEQ ID NO: 66489 - DNA, 201 bp, Homo sapiens
cccccctcagcctgacagcctccctgcagggcagacagagcctcagcctcagctgcagggaggcaacgatgatccaagacgccccagccgctctcctccargcctggccctcagggacgtgggcatgatcttccgtaccattgagcagctcactctcaagctcaacaggctcaaggtgagggaagcagggcttgggtccct

SEQ ID NO: 66490 - DNA, 201 bp, Homo sapiens
acagagcctcagcctcagctgcagggaggcaacgatgatccaagacgccccagccgctctcctccaagcctggccctcagggacgtgggcatgatcttccrtaccattgagcagctcactctcaagctcaacaggctcaaggtgagggaagcagggcttgggtccctgcaggccttcagtccatcaccccaaaaccattcc

SEQ ID NO: 66491 - DNA, 201 bp, Homo sapiens
cagccgctctcctccaagcctggccctcagggacgtgggcatgatcttccgtaccattgagcagctcactctcaagctcaacaggctcaaggtgagggaarcagggcttgggtccctgcaggccttcagtccatcaccccaaaaccattccccatgagtgagatgtgtgtcttcgcgggagccctagatcctgtcctggcc

SEQ ID NO: 66492 - DNA, 201 bp, Homo sapiens
tgtcatcatttccacatcctgtctccagccaaggctctccctttctggagagattgaagttgttgtttcctatttcacaggattccttttatttttacgtytggggggtctcacccagggaattccttcctgatgtcatctttgtgggatgtaaaggagggaatgaggggaggggccccaagaatgtttctctttctgtga

SEQ ID NO: 66493 - DNA, 201 bp, Homo sapiens
ccctctgaaggcggtcaacattatgggggttggggggatgcagccagccctgagaccactgggagctataagggacagcattctctttttaatggtgggtwtaaggcagtcatcaaaccaagctgagcaaatccactgcccaagcaacgggcagtaacacaggaaggaagaagggaagtactatacaaagtgtgagtgtgc

SEQ ID NO: 66494 - DNA, 201 bp, Homo sapiens
tataaaatatagatatggaaatgactgttctgctgttaagataatgtatactcttttattttcttcctttcatggttaagattttttttttaagaaaagtyaaatatccttcagtggtggtgtgtgtgtttcttggaatcgctgtgataaaaggtacggtgtttgttccctgtaagactggttaggattggatagtgggaa

SEQ ID NO: 66495 - DNA, 201 bp, Homo sapiens
ttccctagctgagtgcagctaacaaagtagaagtaaagcccgaaaatgggagcttttctccagagctagtttgttggacaaatttgatgggaggactgggratacaaaggaatcaggactgctgccgtaggtgatcagctatggaattcaggcgaaaaggaagagaagctgagaggacgttgatacctgggaggaaaatac

SEQ ID NO: 66496 - DNA, 201 bp, Homo sapiens
acactaataaaaccgtgattggaggcaccaaaggcctcagcaaggctggagaccttgaatctgcatgttagatcacacagcagtgtgatttttccctagckgagtgcagctaacaaagtagaagtaaagcccgaaaatgggagcttttctccagagctagtttgttggacaaatttgatgggaggactggggatacaaagg

SEQ ID NO: 66497 - DNA, 201 bp, Homo sapiens
ctttgtatttaatgaataaatctttgccaatttcatagccactaagattttcctcctctgttttcttctagacattttatggttttagctcttacatttaratctgtgatttattcttcgttactttttgtgtagtgtgtgagagaagagttgaggttaatttattactattttttgcatatgaggtccagttgttctggc

SEQ ID NO: 66498 - DNA, 201 bp, Homo sapiens
gtgttggattttgtcagacgctctttttacatctattgagatgatcatggttttgttcttcaatctcttaatatagtatgttacacaaattgagattcatrtgttaaaccaaccttgcattcctgggataaatcccacttggtcatggtaaagaatcctttatccatattgctggattcaatttgctgatattttgatgag

SEQ ID NO: 66499 - DNA, 201 bp, Homo sapiens
cccaggaaagagagaaactagattctacccatttctaccctatgattacggtgcttttggtggaatacatcctaggtctctcactccctctcacagtcccrctctgtcttcaaatcagagtcaacttcaggattggaaggaatcttggcagtcatctaattaaactggccctccgattcttagcccatatgattgtgtgat

SEQ ID NO: 66500 - DNA, 201 bp, Homo sapiens
ctgacctgagccctatccaattgtctggaaagccagatctgcctgacttcccatgctgttaccaagaaccaaagtattgagccccaggccagagctgtctkctgcaccagagggcacacaggatcagagagcaattctcttcttgtcctcagaaccctttttttctaagcccaggaaagagagaaactagattctacccat

SEQ ID NO: 66501 - DNA, 201 bp, Homo sapiens
taaggactgtaataagaagttccattgaacacccctgctgccagtactgcctgagtctgggaagtctggctggcttagaatctgtaccaacccctgagacratctgatgtttaaatactgtgatgccctttctccccttttcaatgcttcttactctcttttgctggtttctctttcctttttccacatctttccatataa

SEQ ID NO: 66502 - DNA, 201 bp, Homo sapiens
ctggaatccaaggtcctttttccctctctaccagatttatgccctgtctcatttcagctaccattgtctcagtcagcatctacacctactttgtattgtgygcttatttatcttcgacatgcatcggggaagataatggagacaagtagtacttgcctttagggaacctcaggcctgttggaaaggcacctgcaaaagacc

SEQ ID NO: 66503 - DNA, 201 bp, Homo sapiens
tgggctggtctgagagggtggcaagaaaagtagaacaaagcctggggcacacatgggatggggttccacgctagtgggcctgccctcccctgggattccaytctgcctcccttccagcagcatttttcattccatctgcccaagggccacctgtctcctgggtttctgggaactgaccttccttctctgtctctcggtgaa

SEQ ID NO: 66504 - DNA, 201 bp, Homo sapiens
cagcctaaggactgtaataagaagttccattgaacacccctgctgccagtactgcctgagtctgggaagtctggctggcttagaatctgtaccaacccctragacaatctgatgtttaaatactgtgatgccctttctccccttttcaatgcttcttactctcttttgctggtttctctttcctttttccacatctttcca

SEQ ID NO: 66505 - DNA, 201 bp, Homo sapiens
tgtctatccttatgccagtcgcatactgacttgcttactgtagctttctggtagatcttgaaatcaggaattatgagtccaccaacttgattctttctcargattgttttagctattcattttcatatgaattttagggtcaacttctcaatttcaaaaaaaattgagattttaatagggatttcatttaatctgtggatc

SEQ ID NO: 66506 - DNA, 201 bp, Homo sapiens
ttgcttggtctgctcaagtcggagtcaggtttcagtgtcttttccctcccttagcccaaccctccaaggcctcatgtctcctaagcatgctgactgcatcygaaaggcccccactcaccatggtctgccctcaccccacatatgtgtgtacacgcgcacgcctgtatgtgcgctgccctcagacatgcaagtgaaaggagg

SEQ ID NO: 66507 - DNA, 201 bp, Homo sapiens
ctagtgctgttcctcttttcctatacccctgtcaaggcttggtggtaaaaatgtgtaattcttaagggagccagacatcagatttgcctgacagtagtgamagacagtgaaatttgcctgactaggaaagagataggtaaatcaggagtcaagtcccccaagtttttctgtctcttcccaatacaatttccttgtccatgg

SEQ ID NO: 66508 - DNA, 201 bp, Homo sapiens
tcctcctctcctgcttttctttttgccctgtgcattagtgggccgtttctcatcatctccaggttctccagaccaatggctctgagtctgagatgcagatrtgggtccgaggatagtggtaggtacatgacatggcctggcaattcttgtgccatagggtttcctaaataacacttcaggccttaggatcatttaattaag

SEQ ID NO: 66509 - DNA, 201 bp, Homo sapiens
agtagcaagggaaggagccagtttctagtgggtccaagtgagaataggaggtgaagaaatggtgatggacatagtctagtcaattctttcatgaagtttcrtcagaaaggaaaaaaaaaatgtcgctcctggtcctgtcaggtaggactttaattttttcaaggtagggatgtattgccctaggtcagaggttctcaatct

SEQ ID NO: 66510 - DNA, 201 bp, Homo sapiens
tagaaccacagaccctcttcccttcagagccccagggagaggggaaaaataccactaggatttcagtgtcttcacaggaacagggtttcaggtttgggaarcattcatgccatccctcaaataagaagcttggtctgtttaacaaatcttcacttatcgtagtgctaggcatcaaggattcaaccagaatatgctgcatac

SEQ ID NO: 66511 - DNA, 201 bp, Homo sapiens
ctcatcccaaagcagatcctttgctagaaacccacaatgtctttccttcctagcccaagctccccagcttgggattcatgacttctttcttcagtttagcscacatctcaataatcgtaggtctcattactgtaccctgtcgccctgcttcgggtagaccagcctcattcctgggcccacatccctctttgcacaccttta

SEQ ID NO: 66512 - DNA, 201 bp, Homo sapiens
acgttttcttcatatctgtaaaaccagaaaagcatggaagtgaagggctggttctttgttcattttgtttgtgttatcgtttttttgaaatatattgcacrtatcataaaattcatccatttaaattatatggttaagtgatttttagtatagtcacagttgtgccattatcacatcctagttttagaatttttcagtatc

SEQ ID NO: 66513 - DNA, 201 bp, Homo sapiens
gttttatagcacataaggacatttctttctgcctggcacaaaccaactaccagtaccagtctctgttagtgctcctcactgatctcctgttcccagggaaragagccactcttctcaggagcctcaggccgggaaagacagggcaggtgcatgcagcccctcacgccaggcaacagctccaagggcagtagaggtggcagc

SEQ ID NO: 66514 - DNA, 201 bp, Homo sapiens
gggctgctgcctgctcctttcagaagagcctgaaaccagctcacaatctgtttactcaaggagggggagccactccaatttccccaaatgaaacactgcakctctgccacttctcccttgagttcatcgctcagcatctcccccagcttggggccagactgagcaagtgtcatctagaaggtctcgggagcagggctttta

SEQ ID NO: 66515 - DNA, 201 bp, Homo sapiens
caggctcaaggtgagggaagcagggcttgggtccctgcaggccttcagtccatcaccccaaaaccattccccatgagtgagatgtgtgtcttcgcgggagscctagatcctgtcctggcccagggatcttcccccagcccgcccagccacccttaaatcacaccctcctccccaaggcccagcacagaccccttccccagg

SEQ ID NO: 66516 - DNA, 201 bp, Homo sapiens
tcttgaagatttaggaggggcatgagtgagatttgagcttgaactagagggaaaaggctaagatgagtgtgaggagcttgtaggtagaggtaggaaattgmagaagaacagtgcttaaaggctccagttatttttatgtggtaagaggcaatacaatctaatgatagggagagggtgggctttaaatatggaggctgagga

SEQ ID NO: 66517 - DNA, 201 bp, Homo sapiens
gtctcaaaaagaggagaaaaaaaaagagagagagagaattgaataaatttctgggctgaggagaaagagccaatacaattagatcttgaagatttaggagrggcatgagtgagatttgagcttgaactagagggaaaaggctaagatgagtgtgaggagcttgtaggtagaggtaggaaattgcagaagaacagtgcttaa

SEQ ID NO: 66518 - DNA, 201 bp, Homo sapiens
aatcaagcaagtggctcagcctttctgtagcccattttcttatctgtaaaatggcaacattaatagtgccaactcatgaggttgttgtgaggattaaatgyaatacataagaatggctaatatgaataatcaacaatcaatcaataaggaattcttactgagtgccaggccctggcctgagcattttttgcatgttttaaa

SEQ ID NO: 66519 - DNA, 201 bp, Homo sapiens
ctctatcaacaaagtatatgtgacaggatttctgcttgtgaggagtttatcatctagttggagtgagatatgaacaatatggatgaaatgatttgataacragtgccaaatagcatagtatggactcaaaatgcagtagaaatggacttagttactgaaaggatcattgggtaagttggactagttaggaaagtttactag

SEQ ID NO: 66520 - DNA, 201 bp, Homo sapiens
tctcctggccaatccaggttcatttcctggagattgtgttttgtggactagcagtttcccagttgaaatgctagtattgccctgttcgaggtggtccattrttgatgtaataaagcctcattatcatgtgatttgtgcctggatagaatcattatatgtgtctaggtcctggaaaggaactgcagggaccacatggttcat

SEQ ID NO: 66521 - DNA, 201 bp, Homo sapiens
agggctggggagattgattgcagtttgactgttgtagctttgaggtgtcagtgaaggtgatttggtcctcgcaattaccctttgagaaaggtagtattacytacatttgttattgggaaactaaggtttgaagaggttggatgacttgcctaagactacatagccaagaaagggctgagcctgagcttgtgccagtatttt

SEQ ID NO: 66522 - DNA, 201 bp, Homo sapiens
cccatgagtgagatgtgtgtcttcgcgggagccctagatcctgtcctggcccagggatcttcccccagcccgcccagccacccttaaatcacaccctcctycccaaggcccagcacagaccccttccccaggggccttaggaatagaaggactcgagcagacattcccccgccgactcttccaggatatggagctggccca

SEQ ID NO: 66523 - DNA, 201 bp, Homo sapiens
tcaaattgtccaggatgtattgtttaactggctatgtggtcagagaaaaggaagagtcaagattgattgccagaattcctacctggggcttgagagaataygagaggaggacagaggtgtggtgcatggagatgagtttgtcagtgtgttgagtttgagcatctgttggctgtgttgtcccctagagagttccatatggag

SEQ ID NO: 66524 - DNA, 201 bp, Homo sapiens
tggccctaggttctgtcctcttaaccactatatcaagcagtctctgaaattcctgaagtagaggggaaaatgagaagcatagacaatttgtatcaaattgwccaggatgtattgtttaactggctatgtggtcagagaaaaggaagagtcaagattgattgccagaattcctacctggggcttgagagaatacgagaggag

SEQ ID NO: 66525 - DNA, 201 bp, Homo sapiens
gtggggacaggggtctgaatgccgagtccctgaattcacccaggaccatccaaggggccaccgcagcattggccccatcaccacgtcctcacccaactctycctgatgaatagaatatacacactgtgctaggtgtatatatacatatatatatatataaatatatatataatatataaaatatagatatggaaatgactg

SEQ ID NO: 66526 - DNA, 201 bp, Homo sapiens
tggaggtcattgataagaaagtatttaaactgagctatctggggaagttccacctcttcgccatcctgattgtccatatttgctttattattatggggagyctgaaaggaatacatctttatcaatagttcttctccttcctattttcttttttaaatcttaatggtatggcagcagccttagcttctagccttaaatctc

SEQ ID NO: 66527 - DNA, 201 bp, Homo sapiens
acaggctcaaggtgagggaagcagggcttgggtccctgcaggccttcagtccatcaccccaaaaccattccccatgagtgagatgtgtgtcttcgcgggasccctagatcctgtcctggcccagggatcttcccccagcccgcccagccacccttaaatcacaccctcctccccaaggcccagcacagaccccttccccag

SEQ ID NO: 66528 - DNA, 201 bp, Homo sapiens
agacattttatggttttagctcttacatttaaatctgtgatttattcttcgttactttttgtgtagtgtgtgagagaagagttgaggttaatttattactrttttttgcatatgaggtccagttgttctggcaccattacttgaaaatcatattctttcctcattgaattgtgttggcatctttgctgaaaatccattgat

SEQ ID NO: 66529 - DNA, 201 bp, Homo sapiens
tggaagaggaaggagagcagactgaacagacttaagaaagggtgaactcgctcacctgaccagaaattcccacccagcctctctgggtgacggcatcagcygtggaagaagacgagcagtctggcgggatccacgggccctgcatcctccagccaggggttactgttggggagggagatacatgctgcaacaatgagaatg

SEQ ID NO: 66530 - DNA, 201 bp, Homo sapiens
acagtgccatggcacgatcttggctcactgcaacccctgcctcccaggttcaagcaattctcatgcctcagcctcctgagtagctgggattacaggtgccygatcccatgcctggctaagtttttatattttttagtagagacggggtttcaccatgttggcctggctagtctcaaactcctgatctcaggtgatccgccc

SEQ ID NO: 66531 - DNA, 201 bp, Homo sapiens
ggctagagtgcagtggctcgatcacagctcactgcaacctccacctcccagattcaagcgattctcctgcctcagcctcccaagtagctgggaccacaggygcatgccaccatgtccggctaatttttgtatttttagtagagacggggtttcaccatgttggctaggatggtcttgatctcttgaccttgtgatccgccc

SEQ ID NO: 66532 - DNA, 201 bp, Homo sapiens
caggcatggtgactcacatctgtagtcccagctactctggaggctgaggtgggaggatcacctgaaccctggaagtccaggatgcagttagctgtgatcgyaccactggactccagcctggacaatgggagtgagaccttgtctcaaaaaaaaaaaaaaaaaaaaagtattttgtaacctgctagctaggactggccttag

SEQ ID NO: 66533 - DNA, 201 bp, Homo sapiens
catcttattttcatggcttaagatttctaggtccagataaaaaccaagggtgccctgggccttgccagctaatgagtgcatagaatccagggatagcaagrgaggcttggagagccttttctttctccagccctgttctttctccaggccctgccaggctggccttcctgccctgggcctgtgtacaggtttgtttctgtg

SEQ ID NO: 66534 - DNA, 201 bp, Homo sapiens
tgggctggtagagagcttcaaccagagcctggatgactggaggcagggagcaagggtgagtgccaaagacagagcactcacccacctgctggtctgctccrgcagaagatacactgtgtatctggcatgagcaggtgtcttcaaggcttccgaatggagcttagacaaaggagggtctgaggctagtatccagccaagccc

SEQ ID NO: 66535 - DNA, 201 bp, Homo sapiens
ggagcgcaaaccgggggcttcagatgctaagtccaggctcttgacagctcactggagacgctggaatcaccttcactgcgcctgtatcagcacccgccacwcaggcgcacaaataaaccttcccagagtgaatgaatgaattaatgactcatccagccccagctgcttccggtgggtcgggggcgtggcgagaccctgttt

SEQ ID NO: 66536 - DNA, 201 bp, Homo sapiens
aggctgctctcgaactcctgacctcaagtgatgcatctgccttggcctcccaaagtgctgagattacaggtgtcagccaccgcgcctgggcttacattcayttttaaaagcgtgatgttctctgggggaggtatctccctaaggtggaaggtggcagtgatttgagttccatgacacttgcacaactcctgccatgcttgg

SEQ ID NO: 66537 - DNA, 201 bp, Homo sapiens
cgaaggactttctttagatccacgtttcgcaagtgtccctgaggccgaggaagaggcgaggggcgcccccggcctcgggcgtctggggcctgcccataagkccgggtcggcgcggcggggcggggagagctgtggccgcgcgcctgctccgccgcacaatcggctgggacaaggcagggaagctgtggcgacctgcagggg

SEQ ID NO: 66538 - DNA, 201 bp, Homo sapiens
taggtcggggggcggatgccggggcttcccaggatgtggagtgtggggcagtgagaggccccccgccccgcctcttcggaaaagcctgagcagcagctccsggggcgcggaagctctgacacctgagagccggtgcaggcgaaagggcgcgaagcgcgggcgcgtcccgcttccctcttccgcccgcagggactcggcgaa

SEQ ID NO: 66539 - DNA, 201 bp, Homo sapiens
gtcgtgggtcacttataccttagtgcaaatcgttttataaatttaaactgattgctcttcccaccaccacgaccacagggagtgctagtttgatagggcarttggaacatggggagggtattgggctggtagagagcttcaaccagagcctggatgactggaggcagggagcaagggtgagtgccaaagacagagcactca

SEQ ID NO: 66540 - DNA, 201 bp, Homo sapiens
gcaaaggtggccatccagtagagaagggcccccaggcaggtctcagtgttccccagaagtcaaaactcagactgccttattgctgcacatcacttcaccaygcacaaagcactttctcaggccacatcccatttaacccccaaagggaggcaggatggtagcatcctgctggggatactttggaacctgctggggcagttg

SEQ ID NO: 66541 - DNA, 201 bp, Homo sapiens
catgtgtaactgtgctaaaaggcaagtgcctctgtggggaggcggcagacacagttgacatgagccaacctgtgtacttcagagaggacacagggctgccragttgcgggtggtaagaggagaggtccagaggatgggatgctctcaagattagctggaggctagaagagataaggggcacaccaaaaaaacaaaaacaaa

SEQ ID NO: 66542 - DNA, 201 bp, Homo sapiens
catcagctccagcaccaccctcggcttccgcatcgagggcatcaaggtgaggcaggcgcgcttcgctggcaccgccgcagccccactgcgcgctgtctttyccgatcccccgctcccgccccgcctgcccctccgccctctcccaccgcctcgccgtcccctgcaactgggaggtaccgctgctctacgctgtcctcttcc

SEQ ID NO: 66543 - DNA, 201 bp, Homo sapiens
tcctcaggtctcctgctggttgttcctgagagttttatcacctatagattgtaaacaacctaagttggctataaatattgttgctaggctgatgacatcasggagggctgaagacagagggaatggcagtaaggtatgaatgaggaggaatgagttcatgttaacccaaggataaagaagatcttcgctgttgcccaataa

SEQ ID NO: 66544 - DNA, 201 bp, Homo sapiens
ggcgtgagccaccgcatccggccaatgcaattgttttcttaattccattttctgcatgttctttgctagtgcatagacatacaatttttttttttttttttgagacggagttttactcttgttgcccaggctggagtgcaatggtgcaatctcggctcacagcaacctccatctcccaggttcaagcgattctcctgtctc

SEQ ID NO: 66545 - DNA, 201 bp, Homo sapiens
aaaaattagctgagtgtggtggtgcatctgtagtcctagctttttgggagactgaggtgggaggacggcttaagcccaggaggtagaggttgcagtgagcyaagatcacgctactgcactccagcctgggtgacagagccagactctgtcacaataaattaataaagtttacaattcatggcttttagtatattcacaagg

SEQ ID NO: 66546 - DNA, 201 bp, Homo sapiens
gcatttcaccgtgttagccaggatggtctcgatcttctgacctcgtgatctgcctgccttggcctcccaaagtgctgggattacaggcgtgagccagcacrcccggccttcattcagcactattgttagttccagctatctagcttgtctacctctccatctcatcctccttcaacttttaggaggtggtcaacttcatca

SEQ ID NO: 66547 - DNA, 201 bp, Homo sapiens
ccatattctctcaccccaactttgggtacatcattgaccaaaggaagacctttacaatcttggagacatcatttaaactgtaaacctttggaatttctagrcttgtgtgggcaaagagagataatgaagtgggaaattattaaaagacccagcatttcggcatggtctctgtctccccagtaagccccttgaacccaggga

SEQ ID NO: 66548 - DNA, 201 bp, Homo sapiens
cttcccttttaattcctacccttcctcctctttctacctccatatccccgtggagcttcccaggagccatgttggtggggaccagagagcccacgcagcasctcagccttcctgtagcctgtgtgctccctctttatgccccctacacatcggggccttctctcccttcagaaggctcagcctgcagaagcctccaaatgt

SEQ ID NO: 66549 - DNA, 201 bp, Homo sapiens
gtttatagccaggacccacaggacaggtggagggctcctccacagggctggggtggctggagtgtaaaggggcgtgaggcagccagatcctcactgtggcmccctttggcacttttgtagtgattctgctgaggccagcctctcggccaccccttccttagtcacttggacacaggtgtctgggctccagcctcttgttga

SEQ ID NO: 66550 - DNA, 201 bp, Homo sapiens
gactttgtggcaccagaggggcctgggtcagggttgagttaagccactctctgtccagctgagagtagctggacttgagactcacagctgaccctgatccycagactgtgcccatttccagttgagcagctttgatctccggagccgcctgtgccgcatcatagctgaggctccccaagaactggccttgcccccagagga

SEQ ID NO: 66551 - DNA, 201 bp, Homo sapiens
cagttcgacaccagcctggccaacataatgaaaccccgtctctactaaaaatacaaaaattagtcgggcatggtggcgcatgcctgtagtcccagctactygggaggctgaggcaggagagtctcttgaacctgggagacagaagttgtggtgagccaagatcactccactgcactccagccagggcaacagagcaagact

SEQ ID NO: 66552 - DNA, 201 bp, Homo sapiens
caactcagaccggcctccgctccaggaccatcgggatgtggtgatgttggacagtgagttcccatggatgtgaggctgagaagtagagagggtacagcctygggcccctccctcttcctgttgtggttggattcagacacatcattattatttcagacactgcatagcctgtgtttctgcagccccattttacagaggaag

SEQ ID NO: 66553 - DNA, 201 bp, Homo sapiens
gtggtgcatgccggtagtcccagttacttgggaggctgaggcgggaggattgcttgagcccaggagtttgaggctgtggtgagctacgattgtgccactgyactccagcatgggtaacagagcaagaccctatctctttaaaaatatatatttacagcctgagcaacatggtaaaaccccgtctctagtaaaaatacaaaa

SEQ ID NO: 66554 - DNA, 201 bp, Homo sapiens
ctgggtggccagctcttgccatcttcttcctctctgatccagttgcttagaaatgcaacagaaatcaccaggcatgaacctgtttactggagcctgtttaytggagcctggtgcatcatataggtatactgtggtctcatgatgtaataggaggtctccctgttccctagacccagatcagaagggcttcatgcacatagg

SEQ ID NO: 66555 - DNA, 201 bp, Homo sapiens
gtacacagggtctaggagaatgaatggctgggccatcagctcagtgaattccttggtccaccagccaagctcatgcccggaggattggctccaggacatgsagcgcctgtcagaggagctgctgctgccactgctgagtcagcccacactgggcagcctgtgggattcccttaggtatgtactgtgtttggtagctggggg

SEQ ID NO: 66556 - DNA, 201 bp, Homo sapiens
tgacatcctggctgtgctcatccgcctggcccggcattccctggaatcagccacaagggtgagaaaaaagggagcagggaatgggcaaaaagcctagctgrgccttgtcttgacccacagcctcccttcctcccttttacctcctgtctcccataggtcctggagtgccctcggctgatagagactatagttcgagagttc

SEQ ID NO: 66557 - DNA, 201 bp, Homo sapiens
gcgctacgtgctggaggtgacatacccaggacctgcggtggtccttgacatcctggctgtgctcatccgcctggcccggcattccctggaatcagccacargggtgagaaaaaagggagcagggaatgggcaaaaagcctagctgggccttgtcttgacccacagcctcccttcctcccttttacctcctgtctcccatag

SEQ ID NO: 66558 - DNA, 201 bp, Homo sapiens
ctggagatgaggtaccacagggataggaatggggcttgggctgggaggtgccagggtccatattcctgtttctgggcatggccccattgctaaggctttgygggcaagatgtagaatgggatggcaggcgtctccctcatctcctaaagtccctaaagcccaggaggcttgcctttatggtttttattggggagcatcctc

SEQ ID NO: 66559 - DNA, 201 bp, Homo sapiens
ggctctgcaccgaggggagctacagcgagtcccaaccctgctactgcccatgcctacggagccgctgctgcccaccgactggcccttcctgccactgattsgcctctaccaccgggcttcagacaccccctcgggactctctcccacagacaccatgggcacagccatgcgggtcctgcagtgggtgctagttttggagag

SEQ ID NO: 66560 - DNA, 201 bp, Homo sapiens
tccgtgctcttcgggctctgctggtggctcctggagatgaggtaccacagggataggaatggggcttgggctgggaggtgccagggtccatattcctgttyctgggcatggccccattgctaaggctttgcgggcaagatgtagaatgggatggcaggcgtctccctcatctcctaaagtccctaaagcccaggaggcttg

SEQ ID NO: 66561 - DNA, 201 bp, Homo sapiens
ggcaaacgaaggattagggcaaagcctctagataacttcagcatcttcagcaaggttttaccctcctgccctcaggcccaggctggtgagtttggggaccrgctagcaggcagtgtcttaagcctccttttggatgctggtttcctcttcctactgcgcttctccttggatgacagagtggatggggtcattgcaaccgcc

SEQ ID NO: 66562 - DNA, 201 bp, Homo sapiens
gaagatcttcgctgttgcccaataaagagaatcagggttcagttgcagagggcccatattctttcttgctcttagggatgaataagagggaacccccacayggagacactgctggagagagtcgtactggggaggcagctggagcagcaagatgctgtcgagaccgaagccaggggagtccgaggtggacctgctgcactt

SEQ ID NO: 66563 - DNA, 201 bp, Homo sapiens
attaaaagacccagcatttcggcatggtctctgtctccccagtaagccccttgaacccagggactggattttactcccatttctttatatttacagccccytgtacaccgctcagcccagagtaaactctcaaaaaattttttgataatgttcttaaggtcacaccgtcatgtgattgtttcaccatttctacccctttag

SEQ ID NO: 66564 - DNA, 201 bp, Homo sapiens
ctgccattccatgtctctcggggctgctgtgctgatttcttctggcccagctcaggccatgccttgcctccagaagtttcccagcttccctctgctcacaraataaggttctggtctcagctgggcaagatattccttctaccttttgtccctgctgaccctgctgctctgcctccttcacttcctgctacaccactctgc

SEQ ID NO: 66565 - DNA, 201 bp, Homo sapiens
cattcagtttcttaggctcaaaatcttgatcctctctccgtattctggtcagttgctagaatttgccgatcttctgtcacctcctcatgatgcctcctgcrctgtggccttgcttccttggtctgctcactctccatgccctccattctccgcccccctgccattccatgtctctcggggctgctgtgctgatttcttctg

SEQ ID NO: 66566 - DNA, 201 bp, Homo sapiens
gttgtgatccctggaaattgagcaaatccccttttatctctttgttccagaggccttgatataaagaggttgagaggaaagtgggatgatgagcatcagtracctgggttttctttttgccccacaggggaaatcagcaacatctggtaagagaagcatctttgcccaggaaattgcggcaaggaggatagctgaagccaa

SEQ ID NO: 66567 - DNA, 201 bp, Homo sapiens
tgaaaggcctgggattaaaggtggggagtgggtgtgggaaggttgctggagcccccagaccacagtcctctttctcttcccattagaggatgcaggctcgrttcagtcttcagggagaactactggcccctgacgtggacctgcccacccacctgggtctgcaccaccatggagaggaggcagaggtgaggcatgggactg

SEQ ID NO: 66568 - DNA, 201 bp, Homo sapiens
aagatgttctagggcaacagggatattggatgctcggggtgggtgaggcttatcagtggagggtgcttcagaaaggtagacttttacccctgaggtcaggwtgggggctgggttagaatcactgccctgaagggaggagggtccgtaaccccccagagtgaggttctcatcgttcagaactgggctaataggatcgggtcc

SEQ ID NO: 66569 - DNA, 201 bp, Homo sapiens
aacctgggttttctttttgccccacaggggaaatcagcaacatctggtaagagaagcatctttgcccaggaaattgcggcaaggaggatagctgaagccawgggcccatcagttggggaagttgtgcccaacgtgggcccaccagagggtgagccggggttgaagaggattgggcttggcctttttaaaagacacaatcat

SEQ ID NO: 66570 - DNA, 201 bp, Homo sapiens
ttctttcttgctcttagggatgaataagagggaacccccacacggagacactgctggagagagtcgtactggggaggcagctggagcagcaagatgctgtygagaccgaagccaggggagtccgaggtggacctgctgcacttccagagtcagtttctcgcagctggtgcagccccagcagtgcagctggtgaagaaagga

SEQ ID NO: 66571 - DNA, 201 bp, Homo sapiens
ggcccatcagttggggaagttgtgcccaacgtgggcccaccagagggtgagccggggttgaagaggattgggcttggcctttttaaaagacacaatcatarggtcatttttgaagatatgtcttcctgcctcaaatgagaggtgcatttgagccatctcaagtagtctgagaatactaggtatgggaggcttgggtccata

SEQ ID NO: 66572 - DNA, 201 bp, Homo sapiens
agccctcatttttggcttttgggtcccattacagggaaagaacatcagggggtccagaggcagccgacttctctgaccagctgtcgttaggaagcagcagrgtccctcggtgtgggcaagggactctgctggctcaggcctgccaggacctccccagcatccgcaactgctacctgactcattgctcgccagcccgagcca

SEQ ID NO: 66573 - DNA, 201 bp, Homo sapiens
gcagaatctgacaaagatcttatgaacatgccagaccagaagcagagaggccagtggaagcactcatttcccagaaactagattatttcattagtgattawcaaaataagaaattgaattatgagagccaggaacctcatgcccccggaggagctccaggccagctgagcaggttgggtgggggtaggcgtgaaggaggaa

SEQ ID NO: 66574 - DNA, 201 bp, Homo sapiens
tccaccttcacggctcaagcagtcctcccacttcagcctcctgtgtagctgggattataggcacacaccaccacactcagctaatttttttttttttttgsggggacagagtttcactcttgttgcctaggctggaatgcaatagcacaatctcggctcaccacaacctccgcctcccgggttcaagagattctcctacct

SEQ ID NO: 66575 - DNA, 201 bp, Homo sapiens
ttttttttttttttttgagatggtcttgctctgtcacccaggctggaatgcagtggcacgatctcggctcactgcaacctccaccttcacggctcaagcartcctcccacttcagcctcctgtgtagctgggattataggcacacaccaccacactcagctaatttttttttttttttggggggacagagtttcactcttg

SEQ ID NO: 66576 - DNA, 201 bp, Homo sapiens
cctggaatcagccacaagggtgagaaaaaagggagcagggaatgggcaaaaagcctagctgggccttgtcttgacccacagcctcccttcctcccttttayctcctgtctcccataggtcctggagtgccctcggctgatagagactatagttcgagagttcttgcccaccagttggtctcctgtgggggcagggcctacc

SEQ ID NO: 66577 - DNA, 201 bp, Homo sapiens
cagcaagatgctgtcgagaccgaagccaggggagtccgaggtggacctgctgcacttccagagtcagtttctcgcagctggtgcagccccagcagtgcagytggtgaagaaaggaaataggggcggtggtgatgccaactcagaccggcctccgctccaggaccatcgggatgtggtgatgttggacagtgagttcccatg

SEQ ID NO: 66578 - DNA, 201 bp, Homo sapiens
tacaggcactgctcccttctctgcaacccgctgtcctgtgtgccagcccttgaagctccccccagcctcgtgtcactgggctgctcgggaggctgcccccrtctcagtctggctggctcagcctcacccttcccattcctcactgccctcctctctcttcttaataccctggcccagatccacaaggggctgtgtggccag

SEQ ID NO: 66579 - DNA, 201 bp, Homo sapiens
agaccggcctccgctccaggaccatcgggatgtggtgatgttggacagtgagttcccatggatgtgaggctgagaagtagagagggtacagcctcgggccsctccctcttcctgttgtggttggattcagacacatcattattatttcagacactgcatagcctgtgtttctgcagccccattttacagaggaagaaaatg

SEQ ID NO: 66580 - DNA, 201 bp, Homo sapiens
cccaacaaatccttggggtcagcaaggggctggagcccaggatggagtgtgtctgtcatatttgagactttcaccccagccccaggagttccagtccctgrgccatgccatttagccataaccgagggtagaagctggcagatcctggaacagaagtggatgtggcagctgctgggtgatggtggggacccctgtggatag

SEQ ID NO: 66581 - DNA, 201 bp, Homo sapiens
gtggctcctggggctgccccacacctcacacctttctctgcatgggccctgcgccatgagtaccacctgcagtacctggcactcgctctggcccagaaagyggtaggtccccctgtctgacaggttctcctgtcatcccattatctccttcctgtttctgtggaacccagcctgcttctgccaggccatgcagctcccact

SEQ ID NO: 66582 - DNA, 201 bp, Homo sapiens
gcaaggggctggagcccaggatggagtgtgtctgtcatatttgagactttcaccccagccccaggagttccagtccctgggccatgccatttagccataaycgagggtagaagctggcagatcctggaacagaagtggatgtggcagctgctgggtgatggtggggacccctgtggatagtgagctgagccgtttgggtaa

SEQ ID NO: 66583 - DNA, 201 bp, Homo sapiens
gtggctcaggcctgtaatcccagcactttgggaggccaaggcaggaggatcacttggggccaagagttcaggggccagcctggacaacatagcaagactcygtctctacaaaaaacaaaaacaaaaaattagctagatgtggtagcacatgactgtagtctcagctactcggtaggctgaggtagaaggatcacttgagct

SEQ ID NO: 66584 - DNA, 201 bp, Homo sapiens
agggagggctgggtgtagtggctcaggcctgtaatcccagcactttgggaggccaaggcaggaggatcacttggggccaagagttcaggggccagcctggmcaacatagcaagactctgtctctacaaaaaacaaaaacaaaaaattagctagatgtggtagcacatgactgtagtctcagctactcggtaggctgaggta

SEQ ID NO: 66585 - DNA, 201 bp, Homo sapiens
atttgaataatagtagtaactggcccgttgcagtggctcacgcctgtaatcccagcactttgggaggcagaggcgggcagatcacctgaggtcgggagttygagaccagcctgaccaacatggagaaacccagtctctactaaaaatacaaaattagctgggcgtggtggcacatgcctataatcccagctactagggaga

SEQ ID NO: 66586 - DNA, 201 bp, Homo sapiens
aaaaaattacagccaggtgtggaggctcacgcctgtaatcccagcactttgggaggctgaggtgggcggatcacaagatcaagacattgagaccatcctgrccaacacggtgaaatcctgtctctactaaaaatacaaaaattagctgggcgtggtggcacacgcctgtagtcccagctactcgggaggctgaggcaagaa

SEQ ID NO: 66587 - DNA, 201 bp, Homo sapiens
gatactgttctatgctatgcctcacccctagtgtctgttcaccaaaatgccaggcactcagtcaatcttgttacccactgtatactagcacctctatagastataatacgtgttagggctcagtatggtgccttgccctgtaattccagcactttgggaggttgaggtgagaggattgcttgaggccaagagtttacgacc

SEQ ID NO: 66588 - DNA, 201 bp, Homo sapiens
ccactggccttggcctcccaaagtgctggagccactgcgcctaggttttttttttttttttaagacggatttttcctcttgttgcccaggctggagtgcartggcgcaatctctgctcactgcaacctctgcctcccaggttcaagcaattctcctgtctcagcctccaaagtagctgggattacaggcgcctgccaccat

SEQ ID NO: 66589 - DNA, 201 bp, Homo sapiens
atagatctcgggcacggcccttcaacgggcggcgaaagctgcgactcggtgattcctcattgtagagttgggtggtccaggaggcttaactggagcccttracctgagcggtaagggcagtcacgcgtcccgactcgggattggatcctggctctggaggataggctgcaatgtaagagccccagagactcctcagaggcc

SEQ ID NO: 66590 - DNA, 201 bp, Homo sapiens
aaagaggggccatcaatgcccagggtccagctgcatttgtcagtgggtttctctctccaactcccaggggctcctggctaccagcctgctgcctcggctgygctacgtgctggaggtgacatacccaggacctgcggtggtccttgacatcctggctgtgctcatccgcctggcccggcattccctggaatcagccacaag

SEQ ID NO: 66591 - DNA, 201 bp, Homo sapiens
cctgcctgcgggcctttggtctgtaagggagcaactgtggcctcctctgtgcatagatctcgggcacggcccttcaacgggcggcgaaagctgcgactcgrtgattcctcattgtagagttgggtggtccaggaggcttaactggagcccttgacctgagcggtaagggcagtcacgcgtcccgactcgggattggatcct

SEQ ID NO: 66592 - DNA, 201 bp, Homo sapiens
ctcctgcctcagcctcccgagtagctgggaatacaggtgcccgccaccacgcccggctagttttttatatttttagtagagacggggtttcaccgtgttarccaggatggtcttgatctcctgacctcataatccacacgccttggcctcccaaagtgctgggattacaggcgtgagccaccgcatccggccaatgcaatt

SEQ ID NO: 66593 - DNA, 201 bp, Homo sapiens
atcactgcaagctccgcctcccgggttcacgccattctcctgcctcagcctcccgagtagctgggaatacaggtgcccgccaccacgcccggctagttttytatatttttagtagagacggggtttcaccgtgttaaccaggatggtcttgatctcctgacctcataatccacacgccttggcctcccaaagtgctgggat

SEQ ID NO: 66594 - DNA, 201 bp, Homo sapiens
tgtctgacaggttctcctgtcatcccattatctccttcctgtttctgtggaacccagcctgcttctgccaggccatgcagctcccactttcctccagacaygccctggacctgtgcccttcagcctcacttttatcctcttcctcacttctctctgccacgtccccttctcctgtactaggtagttccctgcttttctgtc

SEQ ID NO: 66595 - DNA, 201 bp, Homo sapiens
gcatctgtagtcctagctttttgggagactgaggtgggaggacggcttaagcccaggaggtagaggttgcagtgagccaagatcacgctactgcactccakcctgggtgacagagccagactctgtcacaataaattaataaagtttacaattcatggcttttagtatattcacaaggttgaacattttcattactccaaa

SEQ ID NO: 66596 - DNA, 201 bp, Homo sapiens
gtgaaaccccatttctactaaaaatacaaaacttagctgggcgtggttgcgggtgcctgtagtcccagctactcaggaggctgaggcaggagaatcgcttsaacccgggaagcggaggctacagtgagccgagatcgcgccactgcaccccagcccagtgacagagcaagaccctgtctcaaaaaagaaaaaaggaaaggg

SEQ ID NO: 66597 - DNA, 201 bp, Homo sapiens
tagtctttaaccctgatccttgtgctagaaggacagatgtttgtctaggacctgatctctgccctcatgatttggtttcatgtgatcgttatccacacacsttatgtatgtatatacattcctaccctccccctcagcacgtcatttcccctgtcacagttgcctgtgtccctggagtgttacacagtgcctcctgaagac

SEQ ID NO: 66598 - DNA, 201 bp, Homo sapiens
tctcctgtcatcccattatctccttcctgtttctgtggaacccagcctgcttctgccaggccatgcagctcccactttcctccagacatgccctggacctstgcccttcagcctcacttttatcctcttcctcacttctctctgccacgtccccttctcctgtactaggtagttccctgcttttctgtctgcaggcagcgc

SEQ ID NO: 66599 - DNA, 201 bp, Homo sapiens
gcctgtgggattcccttaggtatgtactgtgtttggtagctgggggaagcaggggaggaggcaatttctttccttgtgggattcctgggtccagctcccakgtccatcccagggtgcaggccctcggcccgagggaaacccgagtccctagcaggcagcagtggggtgggctctgaggagtgtgagcagcactgacctcca

SEQ ID NO: 66600 - DNA, 201 bp, Homo sapiens
gccttcctgtagcctgtgtgctccctctttatgccccctacacatcggggccttctctcccttcagaaggctcagcctgcagaagcctccaaatgtgctcytttgggctgttgggatggtggcattggcctgggtacacagggtctaggagaatgaatggctgggccatcagctcagtgaattccttggtccaccagccaa

SEQ ID NO: 66601 - DNA, 201 bp, Homo sapiens
tgaggaaaaccttttcatataagtactagggaagcagtgagtggagaagccacctggagtccctgtgccagacccagtggggtctccactctgaggaaagyttgggtctatacctgtctccagggctaatagccttatagaagaaggccaaaaagcccagttagagccctggaggacagagcaatgaatgtgatcatacct

SEQ ID NO: 66602 - DNA, 201 bp, Homo sapiens
tgtggcagctgctgggtgatggtggggacccctgtggatagtgagctgagccgtttgggtaatactatcatgctttgtctccccagctctggcattgcccrtgacccctcagaaagaatggctgcacatggacactgtcgagctggagaagctccactggacccaggacttgccccctgtccggcggcagcagacacagga

SEQ ID NO: 66603 - DNA, 201 bp, Homo sapiens
ccaacattttgggaggccaaggtgggaggattgcttgaggccaagagtttctgaccagcttgggcaagaaagctagacaccatctctacaaaaaattattsgaaaattagccagacctggtgatttgcccgtagacccagttactcaggagcctgaggcaggaggatcacttgagctcaggaggttgaggctgccagtgag

SEQ ID NO: 66604 - DNA, 201 bp, Homo sapiens
gttcctctggcaggagctcctcgacagcaccttctcttggtaccatggagctttgacgttccctctgatgcccagccaggaggacaaggaggatgaggacraggatgaagaatgcccagcaggaaaagcaaaaaggaaaagccctgaagaagaaagccggcctccacctgacctggcccgacatgatgtcatcaaggtaaa

SEQ ID NO: 66605 - DNA, 201 bp, Homo sapiens
tgggcatggccccattgctaaggctttgcgggcaagatgtagaatgggatggcaggcgtctccctcatctcctaaagtccctaaagcccaggaggcttgcmtttatggtttttattggggagcatcctctctactcctggatccatttcctggccccttcagcattgccccccaactcccgttcctctggcaggagctcct

SEQ ID NO: 66606 - DNA, 201 bp, Homo sapiens
ggtgcctggctttcctgctgagaccaggctaggagaggaataccacttattgagctaggcttactgtgagttccgggcactgtgctgagtactttaatgcyttttttttttttttttttttttttgagatggtcttgctctgtcacccaggctggaatgcagtggcacgatctcggctcactgcaacctccaccttcacgg

SEQ ID NO: 66607 - DNA, 201 bp, Homo sapiens
cgagctggagaagctccactggacccaggacttgccccctgtccggcggcagcagacacaggaggtgaggagggccacctggcctacaaggggtgggtgakatagggcaggagaggagctgctgctcttgccctcagaactcaggcctttctattgcccagagcctgagaagcatctctcctttgctctcacccaccttta

SEQ ID NO: 66608 - DNA, 201 bp, Homo sapiens
gttagaatcactgccctgaagggaggagggtccgtaaccccccagagtgaggttctcatcgttcagaactgggctaataggatcgggtccagcctggggaagtttctccattgtgcttcacaactttgtgctttgttgctacaggaacgagatacaagttcagtggccgtgaatctgcctgtgcccagtggtgttgctttc

SEQ ID NO: 66609 - DNA, 201 bp, Homo sapiens
tgtaggtaccatccctctggtacatatcaagattctagactccaagaaggggagcaagtgttcagaataacttgaaccatgcctaccagttatggaatggkggcaaccctctcaaactccgtgtttcctaacaccagctaaaggccagtcttataagcagtcctttctaagatttgcagtctcaggcctgttatattaact

SEQ ID NO: 66610 - DNA, 201 bp, Homo sapiens
aaactgttggctcagtcttctttttgttttgtgtgttttggtttttaactgtcaccgataccagaatagctcatctccaaggtaactgtaacagaacactyagcagattaaacagaaaatacttgcttattataattattaaaagtttggtagggtctatgtctgctctctggtgtgtcctggatcatcaacttggttaca

SEQ ID NO: 66611 - DNA, 201 bp, Homo sapiens
accataattcagtttaaataattttcatcccccattaagcctccttgtgctcacttatagttaatcctctttgtcacctcaaatatgcagagaccacctayctactttctcgttatatacacttgcctactctggaatttcatagatataggatcatgcaatatgtgggccttcctatgtgactggcttctttcacttagc

SEQ ID NO: 66612 - DNA, 201 bp, Homo sapiens
tactgtttttttgatttttgattatggtcattcttgcaggagtaaggtggtatcgcattgtggttttgatttgcatttccctgatcattagtgattttgarctttttaaaatatgtttgttggccatctatatcttcttttgaaaattgtctattcatgttcttagcccactttttgatggggttgtttggtttttttctt

SEQ ID NO: 66613 - DNA, 201 bp, Homo sapiens
ggacgtggctgtggtcttcactgaggaagagctgaggctgctggaccttgcccagaggaaactgtaccgagaagtgatgctggagaacttcaggaacctgytctcagtgggtgaggacaggcaccctttgtaagggaacatcaggaccaggagtggctttgtatcctagagtgttcaagtttgagtatgcattgggaacct

SEQ ID NO: 66614 - DNA, 201 bp, Homo sapiens
ttagagctccttttagcagttcttgtagtggtggcttggtagtggcaaattctgtcagcgtttgtctgaaaaagactgtatcttccattcatatatgatgyttagttttggtggatacaaaattcttggctgataattgttttgtttaaggaggctgaagatagggccccaatctcttctagcttgtagggtttctgttga

SEQ ID NO: 66615 - DNA, 201 bp, Homo sapiens; identical to SEQ ID NO: 15334

SEQ ID NO: 66616 - DNA, 201 bp, Homo sapiens
ctttccacttcctaaaggaagaaaagttttggatgatggagacagcaacccaaagagaagggaatttaggtaagaagcaagcaactctgtgtccttgtgcrtgactctcccatcggtttcacttctgtccattgcccagctctgttgtcctggtctaaatggccagacctctttcctgaattattacagctgactttcggc

SEQ ID NO: 66617 - DNA, 201 bp, Homo sapiens
atgttttccaagcttttagaattctcttcttcctcaggaacactgattattcttaggtttggtcctttaacataatcccatacttctttgaggctttgttyatattttcttattcttttttctttgtctttgttggattgggttaattcgaagaacttgtcttcaagctctgaatttctttcttctacttgttcaattcta

SEQ ID NO: 66618 - DNA, 201 bp, Homo sapiens
acatctgcaaattcatcagagaatccacactggagagaaaccattcaaatgtgagcagtgtgggaaaggctttagtcgtagatcaggactttatgttcatygtaaattacacacaggagtgaaacctcatatttgtgagaaatgtgggaaggccttcattcatgattcccagcttcaggaacatcaaagaatccatactgg

SEQ ID NO: 66619 - DNA, 201 bp, Homo sapiens; identical to SEQ ID NO: 15337

SEQ ID NO: 66620 - DNA, 201 bp, Homo sapiens
cacattcgtgttggtggatggcatccctggccacactttcatgtctctttttctgccttccctggtactttccaggcaggattctgctttcccttggactrtatcactcaggactctgaatattccctgaaataggaggaaaaatgaccacgttgaaggtgagtagagcttgcctctcttgctgttaaaatttcttttatg

SEQ ID NO: 66621 - DNA, 201 bp, Homo sapiens
aagttcatgcgtgttgtagcatgaatcagtacttcattccttttaatttccaaataagattccattgtatggataggccacaatttgtctatccatgtackcataggagggagtttgttggtgtgcagttttgggttactatgaatgatgctgttgggaacattcatgtgttaatttacaatacacattcgtgttggtgga

SEQ ID NO: 66622 - DNA, 201 bp, Homo sapiens
gcagtgtgggaaaggctttagtcgtagatcaggactttatgttcatcgtaaattacacacaggagtgaaacctcatatttgtgagaaatgtgggaaggccytcattcatgattcccagcttcaggaacatcaaagaatccatactggggagaagccattcaaatgtgatatatgttgtaagagcttccgtagtagagcaaa

SEQ ID NO: 66623 - DNA, 201 bp, Homo sapiens
gatacatgtggtaagagctttggtctgaaatcagcacttaatagtcatcgcatggtccacacaggagagaaacggtacaaatgtgaggaatgtggaaaacrcttcatttataggcaagatctttataagcatcagatagaccacacaggggagaagccatataattgtaaagaatgtggaaagagcttcagatgggcctca

SEQ ID NO: 66624 - DNA, 201 bp, Homo sapiens
ccaggaggtggagcttgcagtgagcggagatcacgccactgcactccagcctgggggacagagcgagactccatctcaaaaaaaaaaaaaaaaaaaaaaarggaaaatacaatctgaacattccctatatttattaaaatttcaggctatgtcctaagtatgaaatcttgataacactgaataaaagctttacttgcccac

SEQ ID NO: 66625 - DNA, 201 bp, Homo sapiens
tctggaaccagttaggacaaagagcaggattgagcgccattccattcatagacaccgtggtgatattttgagtacattaggttaaaaggctttcttcagcaaaatctatctctagagatagatttgatttttataatcaaatctactagagatagatttgatttttataatcaaatctactagagatagatttgattttta

SEQ ID NO: 66626 - DNA, 201 bp, Homo sapiens
gaaccagttaggacaaagagcaggattgagcgccattccattcatagacaccgtggtgatattttgagtacattaggttaaaaggctttcttcagcaaaayctatctctagagatagatttgatttttataatcaaatctactagagatagatttgatttttataatcaaatctactagagatagatttgatttttataat

SEQ ID NO: 66627 - DNA, 201 bp, Homo sapiens
ccagttaggacaaagagcaggattgagcgccattccattcatagacaccgtggtgatattttgagtacattaggttaaaaggctttcttcagcaaaatctmtctctagagatagatttgatttttataatcaaatctactagagatagatttgatttttataatcaaatctactagagatagatttgatttttataatcaa

SEQ ID NO: 66628 - DNA, 201 bp, Homo sapiens
ccattcatagacaccgtggtgatattttgagtacattaggttaaaaggctttcttcagcaaaatctatctctagagatagatttgatttttataatcaaayctactagagatagatttgatttttataatcaaatctactagagatagatttgatttttataatcaaatctactagagatagatttgatttttatacttaa

SEQ ID NO: 66629 - DNA, 201 bp, Homo sapiens
ttcatagacaccgtggtgatattttgagtacattaggttaaaaggctttcttcagcaaaatctatctctagagatagatttgatttttataatcaaatctmctagagatagatttgatttttataatcaaatctactagagatagatttgatttttataatcaaatctactagagatagatttgatttttatacttaatgt

SEQ ID NO: 66630 - DNA, 201 bp, Homo sapiens
atagacaccgtggtgatattttgagtacattaggttaaaaggctttcttcagcaaaatctatctctagagatagatttgatttttataatcaaatctactmgagatagatttgatttttataatcaaatctactagagatagatttgatttttataatcaaatctactagagatagatttgatttttatacttaatgttct

SEQ ID NO: 66631 - DNA, 201 bp, Homo sapiens
catagacaccgtggtgatattttgagtacattaggttaaaaggctttcttcagcaaaatctatctctagagatagatttgatttttataatcaaatctacyagagatagatttgatttttataatcaaatctactagagatagatttgatttttataatcaaatctactagagatagatttgatttttatacttaatgttc

SEQ ID NO: 66632 - DNA, 201 bp, Homo sapiens
aattgtgactgtacttgtgaaatgtctacaatggaaattaattatcaacccgtaccaaaggttcttattggaactaatcatgtaggtaccatccctctggkacatatcaagattctagactccaagaaggggagcaagtgttcagaataacttgaaccatgcctaccagttatggaatggtggcaaccctctcaaactccg

SEQ ID NO: 66633 - DNA, 201 bp, Homo sapiens
ttggaactaatcatgtaggtaccatccctctggtacatatcaagattctagactccaagaaggggagcaagtgttcagaataacttgaaccatgcctaccrgttatggaatggtggcaaccctctcaaactccgtgtttcctaacaccagctaaaggccagtcttataagcagtcctttctaagatttgcagtctcaggcc

SEQ ID NO: 66634 - DNA, 201 bp, Homo sapiens
gttgtagcatgaatcagtacttcattccttttaatttccaaataagattccattgtatggataggccacaatttgtctatccatgtacgcataggagggartttgttggtgtgcagttttgggttactatgaatgatgctgttgggaacattcatgtgttaatttacaatacacattcgtgttggtggatggcatccctgg

SEQ ID NO: 66635 - DNA, 201 bp, Homo sapiens
tgtgggaaggccttcattcatgattcccagcttcaggaacatcaaagaatccatactggggagaagccattcaaatgtgatatatgttgtaagagcttccrtagtagagcaaatcttaataggcattccatggttcacatgcgagagaaaccattcagatgtgatacatgtggtaagagctttggtctgaaatcagcactt

SEQ ID NO: 66636 - DNA, 201 bp, Homo sapiens
attgtgaagagcttaaccaattgcaaagtttaaagtgacagctcacagaagactgctgtcactgcataccaatgacaaattcagtggtttccccaaattaytttcatgttccatattcttaaaattatgggtttttataggggaaagatgcatattacaattaggagaaaaatcaagtaagacagagtccagggaagtatc

SEQ ID NO: 66637 - DNA, 201 bp, Homo sapiens
tggtttccccaaattattttcatgttccatattcttaaaattatgggtttttataggggaaagatgcatattacaattaggagaaaaatcaagtaagacasagtccagggaagtatcaaatgagaactttttattgtactctccccatgaaatcaggatgcattacatccccaagattaaggtgtgacattagacgggagg

SEQ ID NO: 66638 - DNA, 201 bp, Homo sapiens
ccagtcttattaagttaaatgacatgtggatgaacaattaccaatgctttgtccaactttattgaggtgtattctacatatcatagaaactacccatttcrtgtgtacactttaatgatttttaggaactttgtggagtggaataaacatcaccataattcagtttaaataattttcatcccccattaagcctccttgtgc

SEQ ID NO: 66639 - DNA, 201 bp, Homo sapiens
ctccggagttcaagtgattctcctgcttcagcctcccaagtagctgggactacaggcacacaccaccacacccagaaaatttttgtatttttagtagagayggggtttcatcatcttggccaggctgttctcaaactcctgacctcaggtgatctgcctgccttagcctcccaaagtgctggaattgcagatgtgagccac

SEQ ID NO: 66640 - DNA, 201 bp, Homo sapiens; identical to SEQ ID NO: 15347

SEQ ID NO: 66641 - DNA, 201 bp, Homo sapiens
agacagcaacccaaagagaagggaatttaggtaagaagcaagcaactctgtgtccttgtgcgtgactctcccatcggtttcacttctgtccattgcccagstctgttgtcctggtctaaatggccagacctctttcctgaattattacagctgactttcggctggtttccctgctcccacttttcccaccctgacatctgt

SEQ ID NO: 66642 - DNA, 201 bp, Homo sapiens
aataattttcatcccccattaagcctccttgtgctcacttatagttaatcctctttgtcacctcaaatatgcagagaccacctatctactttctcgttatrtacacttgcctactctggaatttcatagatataggatcatgcaatatgtgggccttcctatgtgactggcttctttcacttagcataatgtttccaaagt

SEQ ID NO: 66643 - DNA, 201 bp, Homo sapiens
tactatgcagacatgaaatgagataaaatagatggcaacaatgacaataataataaaaaaaattttaaaaagctagtgtttattaggtatttagtctgcamtgatcaactttcccaatgctgcatgtatttccttgtttaatcattgaaaaaactataatatgaaaattattagagagggagtaaataggtgaacttgtcc

SEQ ID NO: 66644 - DNA, 201 bp, Homo sapiens
attattagagagggagtaaataggtgaacttgtccaaggtcatgtgaccaggaaggcacagagccttgggatgtgcttttaggcacactgtctgcagatcrtagatcaatgctgcaatcaatgtatgtagtttatgccttgagagtacacaggatgtactgtatagctgtcccacacaggttaccacaagctttgttagtt

SEQ ID NO: 66645 - DNA, 201 bp, Homo sapiens
ccagacctctttcctgaattattacagctgactttcggctggtttccctgctcccacttttcccaccctgacatctgttttcctcatggcagccaatgtawtccttaggaaagtcagactgccattcctcggctcaaaagcctttctggcttcttttttttttttttgagatggagtctcgctgtgtcgcccaggctggag

SEQ ID NO: 66646 - DNA, 201 bp, Homo sapiens
ccacagtagagaaaaactacttcaatgtgaggactgtgggaagagcattgtgcacagttcatgccttaaagaccaacaaagagaccaaagtggagagaaawcatctaaatgtgaggactgtgggaagcgctacaagaggcgcttgaatcttgatacgcttttgtcattatttttaaatgacacataactgttgtactcatt

SEQ ID NO: 66647 - DNA, 201 bp, Homo sapiens
atcgcagagtccacactggagtaaagccatacaaatgtgaagagtgtgggaagggcttcaacagtaagtttaatcttgacatgcaccagagggtccacacyggagagagaccttataattgtaaagaatgtgggaagagctttagccgggcctcaagtattttgaatcataagagactccatggtgatgaaaagccattca

SEQ ID NO: 66648 - DNA, 201 bp, Homo sapiens
tccagtctcatccaggttgctgcaaatgctattaattcattcctttttatggctgagtagtattccattgtatataataccacagttttctttattcactygttgattgatgggcatttgtgttggttccacgattttgcaattttgaattgtgctgctgtaaacatgcatgtgcaagtatctttttcgtgtaatgacttc

SEQ ID NO: 66649 - DNA, 201 bp, Homo sapiens
tcatttatcttttgtattttttgttttgttttgttttgttttgttttgtttcaatttcatttatttctgctctgatcttggttctttcctttcttctgctrggtttgggtttggtttgttcttgtttctctagttccttgaggtgtgatcttagaatgtaagtttgtgctctttcagtctttttgatgtaggcatttaggg

SEQ ID NO: 66650 - DNA, 201 bp, Homo sapiens
agaatgtaagtttgtgctctttcagtctttttgatgtaggcatttagggctatgaactttcctcttagcaccatcttagctgtatcccagaggttttcatrggttgtgtcattattgtctttcagtttgaataattttttaatttctatcttgatttcatttttgacccaatggtcattcaggagcagattatttaatttc

SEQ ID NO: 66651 - DNA, 201 bp, Homo sapiens
gtaaaaaatcaacaaagattcttttaagaaaaggtgtgtatgggtagggaacaatagcatgacagcagtgcggcctctaacagtctggaaccagttaggamaaagagcaggattgagcgccattccattcatagacaccgtggtgatattttgagtacattaggttaaaaggctttcttcagcaaaatctatctctagaga

SEQ ID NO: 66652 - DNA, 201 bp, Homo sapiens
acttctttgaggctttgtttatattttcttattcttttttctttgtctttgttggattgggttaattcgaagaacttgtcttcaagctctgaatttctttmttctacttgttcaattctattgctgagactttccagagcattttgcatttctataagtgtgtccagtgtttcctgaattttttatttttttttatttaag

SEQ ID NO: 66653 - DNA, 201 bp, Homo sapiens
agcattttttttctaattctatgaagaatgatggtgatgttttgatagggattgcatttaatttgtagattgcttttagcagtatggtcattttcacaatattgattgcacccatccatgagcatgagatgtgtttccatttgtttgtgtcatgtatgatttctttcagcagcattctgtagttttccttgtagaggtctt

SEQ ID NO: 66654 - DNA, 201 bp, Homo sapiens
tctcagctgcaaaagaaaagggcttgggtcttcccctgcctgtgagtctgcacactggattcacaccctcccccaagttctggccaggaggcttcttgccyggttcaaactgttataaagttcagctggatacttctttctccttgtggagttccccaccccctgctcctctggctgccttcctgatggatccctgtgatg

SEQ ID NO: 66655 - DNA, 201 bp, Homo sapiens
ttccctggcaggggccctcgtggcttctcattttccattcccttcactgtggctaaggggtggggtgaggggatggagagggagggctgcctaccatggtytggggcttgaggaagatgagtttgttgatttaaataaagaatttgtcatttttgaatggactctggctgtgtctggggccactgtgccactgtggggaag

SEQ ID NO: 66656 - DNA, 201 bp, Homo sapiens
caagggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaaggg

SEQ ID NO: 66657 - DNA, 201 bp, Homo sapiens
aagggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaagggc

SEQ ID NO: 66658 - DNA, 201 bp, Homo sapiens
agggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaagggcg

SEQ ID NO: 66659 - DNA, 201 bp, Homo sapiens; identical to SEQ ID NO: 51625

SEQ ID NO: 66660 - DNA, 201 bp, Homo sapiens; identical to SEQ ID NO: 51624

SEQ ID NO: 66661 - DNA, 201 bp, Homo sapiens
gggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaagggcgt

SEQ ID NO: 66662 - DNA, 201 bp, Homo sapiens
ccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaagggcgtcgga

SEQ ID NO: 66663 - DNA, 201 bp, Homo sapiens
gggtagatccaaccagtttcctaagctgttccacattcctcctcctctccccaaatcattctctttcccagggctataaagagcagggttgcatttggtarcagttctggtcctcatccttggggctcaccgtgggggaaatggtgtatatccctgcaggcagaattcctgaattccccactccccaggctgcaaggtgtt

SEQ ID NO: 66664 - DNA, 201 bp, Homo sapiens
acgggggtcggggacatgtgcgtgctgtgtagaaagcaagaagccagcgctttgaacttgctccagcgagctcggggatcaagggctggtaccaggcaagrgtccggtgactactttaccccgccccgtgctgtcaggtcctgtccccaagccctgacccgacattgttggacgatgaggtcaggcgaggttagcccatgc

SEQ ID NO: 66665 - DNA, 201 bp, Homo sapiens
attccatcccttctccctccagaattttcagctgtgggttctctagctcagaacactttcccttcccaggggatttcttctcctgaacaactacttcctgmgtcctcttcttcaccccaacacgggtcatttcctatcttcccccacacgctgtccatccccactatagctgtctcctggaataatctcttgcacctggct

SEQ ID NO: 66666 - DNA, 201 bp, Homo sapiens; identical to SEQ ID NO: 51631

SEQ ID NO: 66667 - DNA, 201 bp, Homo sapiens
gacatgtgcgtgctgtgtagaaagcaagaagccagcgctttgaacttgctccagcgagctcggggatcaagggctggtaccaggcaagggtccggtgactrctttaccccgccccgtgctgtcaggtcctgtccccaagccctgacccgacattgttggacgatgaggtcaggcgaggttagcccatgcatagacagggcg

SEQ ID NO: 66668 - DNA, 201 bp, Homo sapiens; identical to SEQ ID NO: 51605

SEQ ID NO: 66669 - DNA, 201 bp, Homo sapiens
gccccgggtccgccccgtctgaggcgggaccctcctgaaaatccccggctgggcagggcgcaccacttgcagctgcagcccttgccttgagtcagtgcgcygctctccagcccgcttgaacggtgagcaggtcgggggtacgggggtcggggacatgtgcgtgctgtgtagaaagcaagaagccagcgctttgaacttgct

SEQ ID NO: 66670 - DNA, 201 bp, Homo sapiens; identical to SEQ ID NO: 51608

SEQ ID NO: 66671 - DNA, 201 bp, Homo sapiens; identical to SEQ ID NO: 51612

SEQ ID NO: 66672 - DNA, 201 bp, Homo sapiens
caagaaggactgtgaggcttactctagtgaaagagtccaagctgtcttcaggcaagacaggagcctctctggttcattgtctctggttctgagggtggtgyacgctgagctgcgataggtaggcatattctcacctttccacccctgctgtcctcatccaggtgctatgtgagctcattaatgcactgtaccccgaggggc

SEQ ID NO: 66673 - DNA, 201 bp, Homo sapiens; identical to SEQ ID NO: 51644

SEQ ID NO: 66674 - DNA, 201 bp, Homo sapiens
gtgagagtggggatggagtgtgggattcgatgtagaagacctgcggctgggacggggctcccccagtgttctcattgacttcaaagcaccagacagcaatrgctctctatctctagccccctcccagtttctcctccccactacaaggggcagacctacaactgcagaggaggccaaggcagggcgggcccagtagggccc

SEQ ID NO: 66675 - DNA, 201 bp, Homo sapiens
tctggttctgagggtggtgcacgctgagctgcgataggtaggcatattctcacctttccacccctgctgtcctcatccaggtgctatgtgagctcattaaygcactgtaccccgaggggcaggccccagtaaagaagatccaggcctccaccatggccttcaagcagatggagcagatctctcagttcctgcaagcagctg

SEQ ID NO: 66676 - DNA, 201 bp, Homo sapiens; identical to SEQ ID NO: 51645

SEQ ID NO: 66677 - DNA, 201 bp, Homo sapiens; identical to SEQ ID NO: 51646

SEQ ID NO: 66678 - DNA, 201 bp, Homo sapiens
tcgtctcaaaaaaaaaaaaaaaaaaaaaaaacaacttaagatggtccttccagcttttatagttagtaattacctgtcacctatctcagaagtcttccagkgacttcctatctcacttgaggggaaagccagtattacaatggcctggaagcctccttggtctccccttcccccacatccactacctctctggtcacctct

SEQ ID NO: 66679 - DNA, 201 bp, Homo sapiens
tcatgaaggaaattccagcgctgcttcatcttccagtgctgataattatggcattagccatcctggttagtattaatatattagcactgtcgggccaggcrcggtggctcacgcctgtaatcccagcactttgggaggcctaggcgggcggatcacgaggtcaggagatcgagaccatcctggctaacacagtgaaaccct

SEQ ID NO: 66680 - DNA, 201 bp, Homo sapiens
ggtctcgctttgttgcccaggctggtcttgaagtcctggcttcaagctatcctcccaccttggcctgtcaaagcactaggattataggtgtgagctacctygcccaggctattattcttatacatatgaaatactgcaaactaatatttagttccaaattggcttttgtcttaaaatggttcaccaagtagtaataaaatt

SEQ ID NO: 66681 - DNA, 201 bp, Homo sapiens
tattaagaggtcctgccaactaaccataatatataactgatataatagctaataatgtagccctatgctaactacttctcactgttaccactctagtccayatcaccaatattttttgcctgcatcaccatacaatctttctagctggttttcatactaacacccttgccactctacgttcttccatcagtagccaggatc

SEQ ID NO: 66682 - DNA, 201 bp, Homo sapiens
gggggcggaggttgcagtgagccgagatcgtgccattgcactccagcctgggtgacagagtgagacgtcgtctcaaaaaaaaaaaaaaaaaaaaaaaacamcttaagatggtccttccagcttttatagttagtaattacctgtcacctatctcagaagtcttccagtgacttcctatctcacttgaggggaaagccagta

SEQ ID NO: 66683 - DNA, 201 bp, Homo sapiens
tactaggtcacttataccgtattgatgaacaagccacaaaattgtagaaatgattttgtgcttttgagtccagttctttttagctgtcttaagtgtttttkgtggctgatttctgcttctctctgttttaaggtacttctttgtctgctctgcatcgtggttttagtggctactgagctgtggacatatgtacgttggtac

SEQ ID NO: 66684 - DNA, 201 bp, Homo sapiens
acagttgagcactgcttaagatacactctttacttgatttccaccacaccacaccccacccctccccagcccacccttggggtatccttccaactctctgsctgttgcttctttgccagctcatcttcctccatctaaccagtagattttgaaatgctcagggcttagtcttcctgtcctattctttaggtactttcttcc

SEQ ID NO: 66685 - DNA, 201 bp, Homo sapiens
cagggggcggaggttgcagtgagccgagatcgtgccattgcactccagcctgggtgacagagtgagacgtcgtctcaaaaaaaaaaaaaaaaaaaaaaaamaacttaagatggtccttccagcttttatagttagtaattacctgtcacctatctcagaagtcttccagtgacttcctatctcacttgaggggaaagccag

SEQ ID NO: 66686 - DNA, 201 bp, Homo sapiens
ctatctatatatatttatatttatatatctgtctatatttatatatttattatatataatatatatttatatattatatatttatatttatatatatatatgcactgtcagtatttagcaagatttatattaaatcttagtattaatattagtaatactggttagtattaaatattagcactgtcaatatttagcaagatt

SEQ ID NO: 66687 - DNA, 201 bp, Homo sapiens
agagaaaagaaattccttttctcttttttgttgtattagggtccccagctgactgaatggtgctggcccctacagagggtggatcttccacactcagtcarctgactcacaaaccagtcttccctggaaaccccttcagacacatcagaaggaatgctttgcagttctctaggttttccttagtccagtcaagttgacact

SEQ ID NO: 66688 - DNA, 201 bp, Homo sapiens
tctatctatatatatttatatttatatatctgtctatatttatatatttattatatataatatatatttatatattatatatttatatttatatatatatatgcactgtcagtatttagcaagatttatattaaatcttagtattaatattagtaatactggttagtattaaatattagcactgtcaatatttagcaagat

SEQ ID NO: 66689 - DNA, 201 bp, Homo sapiens
gaggcggagcttgcagtgagccgagatcgcaccactgtactccagcctgggcgacagagcaagattccgtctcaaaaaaaaaaaaaaattatacatatatrtatatttatatatctatctatatatatttatatttatatatctgtctatatttatatatttattatatataatatatatttatatattatatatttatat

SEQ ID NO: 66690 - DNA, 201 bp, Homo sapiens
ccgggcgtggtggcgggcgcctgtagtcccagctactcgggaggctgaggcaggagaacggggtgaacctgggaggcggagcttgcagtgagccgagatcrcaccactgtactccagcctgggcgacagagcaagattccgtctcaaaaaaaaaaaaaaattatacatatatgtatatttatatatctatctatatatatt

SEQ ID NO: 66691 - DNA, 201 bp, Homo sapiens
tttagctactatactcccaaaccttcagccttaaccacctgttaatctactttctgtcttaatagatttgcctattctggacatttcatatatatgtactyatataatgtgtggtctttcatatctggtttctttcacataatgtagcattttcaaggttcatatgtgttgtagcatggtgtcagtatttcatcccttttt

SEQ ID NO: 66692 - DNA, 201 bp, Homo sapiens
tggctaacacagtgaaaccctgtctctactaaaaaaaatacaaaaaattagccgggcgtggtggcgggcgcctgtagtcccagctactcgggaggctgagrcaggagaacggggtgaacctgggaggcggagcttgcagtgagccgagatcgcaccactgtactccagcctgggcgacagagcaagattccgtctcaaaaa

SEQ ID NO: 66693 - DNA, 201 bp, Homo sapiens
taatctactttctgtcttaatagatttgcctattctggacatttcatatatatgtacttatataatgtgtggtctttcatatctggtttctttcacataaygtagcattttcaaggttcatatgtgttgtagcatggtgtcagtatttcatccctttttatggctgaataatattccattgcatggctataccagttttat

SEQ ID NO: 66694 - DNA, 201 bp, Homo sapiens
ttctttttagctgtcttaagtgtttttggtggctgatttctgcttctctctgttttaaggtacttctttgtctgctctgcatcgtggttttagtggctacygagctgtggacatatgtacgttggtacactcagttgagacgtgttttaatcatcagctttctgttcagtttgggatggaattggatgtatttatataagg

SEQ ID NO: 66695 - DNA, 201 bp, Homo sapiens
atgaaggaaattccagcgctgcttcatcttccagtgctgataattatggcattagccatcctggttagtattaatatattagcactgtcgggccaggcgcrgtggctcacgcctgtaatcccagcactttgggaggcctaggcgggcggatcacgaggtcaggagatcgagaccatcctggctaacacagtgaaaccctgt

SEQ ID NO: 66696 - DNA, 201 bp, Homo sapiens
gggggtcccactctgtcacccaggttggggtgcagtggtgtgatcttggctcactgcaacctctgcctcccaggctcaagcgatccacctgcctcagcctyccaaggggctgggatcactggcttgcgctaccacgcctggctaattttttggttatttttttcattacctagcctggtcttgaactcctgagctcaagtg

SEQ ID NO: 66697 - DNA, 201 bp, Homo sapiens
ttaccttatatgatgggcatgaatctagaaacatgaataattatcagactagaaccttctaatttaaatatctaggcttcagcctgccattgttatagttyaatcgaaatgtgtctagctgattaaaatgtctactgaaagatttattaagttttattggccactctggccttgtattaatctaaagaggtctctaatgaa

SEQ ID NO: 66698 - DNA, 201 bp, Homo sapiens
atatggatggagggttttacaattttaacacatttattcacaatgaaagaagactctaatccattgagagcaatcttgccttggatgtgggttggaggcaktgattagaggtggcccacgctggagaggaattaaatggacacttcttagctgacagttttttgattccttgaccagttagtgggtaaaaaagttcagtcc

SEQ ID NO: 66699 - DNA, 201 bp, Homo sapiens
atgggcggcaaagcctaaaatattttctatctggccttttacagaaaaagtttgcctgcctctgtcttaggctgttaaatctgttaagaaatagcccagamtgaatttttttttttttttttttgagacggattctcgctctgtcatccaggcaggactgcagtggtgtgatcctggctcactgcaacctccatctttcag

SEQ ID NO: 66700 - DNA, 201 bp, Homo sapiens
aaattctaatctatgattcacttaacttcctactttataaacactaggtaaagtaatctcacaagctgccaaagaacacatcccaagcagtaatcacagaygatgaagcaccttacaggacccctccaccctcaaacgcgcatgtccagagaagtattaatgccttaatagactactgaaggttaactatttacatcattc

SEQ ID NO: 66701 - DNA, 201 bp, Homo sapiens
gtcaattaagatgttaaaaaattatttccataagagtattaaattctaatctatgattcacttaacttcctactttataaacactaggtaaagtaatctcrcaagctgccaaagaacacatcccaagcagtaatcacagacgatgaagcaccttacaggacccctccaccctcaaacgcgcatgtccagagaagtattaat

SEQ ID NO: 66702 - DNA, 201 bp, Homo sapiens
ttatgatgctgagattatccttaaaagagaaactttgttagaaatacagaagtttctcaatggagaagactggaaaccaggtgccttggatgatgcactargtgatattttaattaattttaagtttcatgattttgaaacatggaagtggcgattcgaagattcctttggagtggatccatataatgtgttaatggtaag

SEQ ID NO: 66703 - DNA, 201 bp, Homo sapiens
cagagtgagacgtcgtctcaaaaaaaaaaaaaaaaaaaaaaaacaacttaagatggtccttccagcttttatagttagtaattacctgtcacctatctcaraagtcttccagtgacttcctatctcacttgaggggaaagccagtattacaatggcctggaagcctccttggtctccccttcccccacatccactacctct

SEQ ID NO: 66704 - DNA, 201 bp, Homo sapiens
tggaactgctggttattactgtagaaagtaacatagttgccaatagtacgactttgtggatgtcacagtcaaaactcaactgcctggctggcacagtggcwcacctgtaatcccagcactttgggaagacaaggcggcgggcagggggatcctttgagctcaggagttcgggactagcctgggcaacatagcaagaccctg

SEQ ID NO: 66705 - DNA, 201 bp, Homo sapiens
atgatggacaataataactctctaatacaaaataagcccttcctgaatgagaattataacactaccaatgttttcagtggtatctgagctgtatgcagaaygaaaaaaatatacagacatacttgacattttacaaggatgtcaaagaaatcttcatcagcctctttgttgtcattagtcatcaggtggctaagtaccgac

SEQ ID NO: 66706 - DNA, 201 bp, Homo sapiens
ttcattctttttgtatgtggctctctagtttacccagaaccatttgttgataaaactgtcttttcccccactgaatggtcttggcacccctgttgcatatyatttgaccacacatgcaagggtttatttctgggatctgtattctattccattggtctatatgtctgtcttttatgccagtactgcactgctttgattaat

SEQ ID NO: 66707 - DNA, 201 bp, Homo sapiens
gatgcttaggtctttggcccactttgagttttgcatatggtattaggtaagggtccaacttcattctttttgtatgtggctctctagtttacccagaaccrtttgttgataaaactgtcttttcccccactgaatggtcttggcacccctgttgcatattatttgaccacacatgcaagggtttatttctgggatctgtat

SEQ ID NO: 66708 - DNA, 201 bp, Homo sapiens
aaattttatatttttatattatgttaaatcgctctatattcttgtctctgctgataaatttgtatttctagtgtttccgtgtaccgtatgatttttatatrtcaaatttttctttggatactctaaccttggtttcttattagttattctagccttggtttttctagtagtaccttgtattttcctgtaataacattgaca

SEQ ID NO: 66709 - DNA, 201 bp, Homo sapiens
atatgtcaaatttttctttggatactctaaccttggtttcttattagttattctagccttggtttttctagtagtaccttgtattttcctgtaataacatwgacatctctgtgttgtaagtatttctttaccagactgcagacttcttggtgcaaggaatacgttttattgatcttaattctctgtcacctgtcacagggc

SEQ ID NO: 66710 - DNA, 201 bp, Homo sapiens
tacagggtggaacagaacctagataaggaaacagatggaaccaaaaatacttaagatggaaatgctggaaaatatttagtttctgatttttttttttttttgagacagagtcttgctctgtcacccaggctggagtgcagtggcgcaatctccgctcactgcaagctccgcctcccaggtttacaccattctcctgcctca

SEQ ID NO: 66711 - DNA, 201 bp, Homo sapiens
taataacattgacatctctgtgttgtaagtatttctttaccagactgcagacttcttggtgcaaggaatacgttttattgatcttaattctctgtcacctrtcacagggctgaggcatagtaaactctcaacaaatgtagcaaatgaagaaatgtgtctattaccagcttatacgaataagagttactcttaagaaggatt

SEQ ID NO: 66712 - DNA, 201 bp, Homo sapiens
ggagttggaggatgcactgagctgtgattgtatcactgtactccagcctgggcaatagagcaagaccctgtctctaaaaataataataataataataatawcccaaaacccaatttatttaaaaaaataattctatttcattatatatattaaaaattgttttagccttatacaggatgctgtgttctttgctcctttgtg

SEQ ID NO: 66713 - DNA, 201 bp, Homo sapiens
aggaatacgttttattgatcttaattctctgtcacctgtcacagggctgaggcatagtaaactctcaacaaatgtagcaaatgaagaaatgtgtctattaycagcttatacgaataagagttactcttaagaaggattattataatttagtgtgtaatagctattcattccttcatttatccaatcctcttaaaaaaatgt

SEQ ID NO: 66714 - DNA, 201 bp, Homo sapiens
tgtcatgtttatccactgatgtgcatttcagcgctcaactcatggtccacactccgttaaaaaatgcaagttgatgatcacaaagttattctaatgtttgraaaatacccactaccctcagcgacttgcctgctgggttggtggtggcagagctaagttcgtaggaagtctgctcccgtgtagaattgtgtgctgaagggt

SEQ ID NO: 66715 - DNA, 201 bp, Homo sapiens
accacgtggacaggatccggtcagcagcccctgtggctagaggaacaccagcacaaacgacagcctcaagtctccttcgagctttgtaaagtatactcttyactctctttctcttctctgcaagaattctgattactacaaaggtgccaacttcaacattcacatttcaacttcaacattcacatttttactgacaattag

SEQ ID NO: 66716 - DNA, 201 bp, Homo sapiens
attctcctgcctcagcctcccaagtagctgggatttacaggtgtgtgccaccacgcctggctaatttttgttgttgttgttgttttattagagactgggtytcaccatgttagccaggatggtcttgatctcctgacctcattatctgcctgcctcggcctcccaaagtcctgggagttagtcgtaagcttttttcctcag

SEQ ID NO: 66717 - DNA, 201 bp, Homo sapiens
atccactgatgtgcatttcagcgctcaactcatggtccacactccgttaaaaaatgcaagttgatgatcacaaagttattctaatgtttgaaaaatacccrctaccctcagcgacttgcctgctgggttggtggtggcagagctaagttcgtaggaagtctgctcccgtgtagaattgtgtgctgaagggttgccatgtgg

SEQ ID NO: 66718 - DNA, 201 bp, Homo sapiens
ccccacccaggttcaagcgattctcctgcctcagcctcccaagtagctgggatttacaggtgtgtgccaccacgcctggctaatttttgttgttgttgttkttttattagagactgggtttcaccatgttagccaggatggtcttgatctcctgacctcattatctgcctgcctcggcctcccaaagtcctgggagttagt

SEQ ID NO: 66719 - DNA, 201 bp, Homo sapiens
atacaaaagtttggctgcacagcaaaaatgcagaaatacctttttacagaatttttttattccattgtttgtgactggtttaaacattctaagaaacatgrttggcaaaatggagtcttgaattctttttttttttttcctaagttgtttctttaaggtttagaaaataaactggttttacaaaccttgcctgagagcaaa

SEQ ID NO: 66720 - DNA, 201 bp, Homo sapiens
acgatctcggctcactgcagcctccgtcccccacccaggttcaagcgattctcctgcctcagcctcccaagtagctgggatttacaggtgtgtgccaccaygcctggctaatttttgttgttgttgttgttttattagagactgggtttcaccatgttagccaggatggtcttgatctcctgacctcattatctgcctgcc

SEQ ID NO: 66721 - DNA, 201 bp, Homo sapiens
tattgttaaaatttccttttttttttgagacagagtctcgctctgttgtccaggccggagtaccgtcgtgcaatcttggctcactacaacctctgcctccygggttccagcaattctccctgactcagcctcccgagtagctggattacaggcacctgccaccatgcctggctaatttttgtatttttagtagagatgggg

SEQ ID NO: 66722 - DNA, 201 bp, Homo sapiens
agacatgcttaactatgatgctgcttcaggaacaatgagaaaatctcaggtattaaaaaaaattcgtgcatgtgtgtgagaccttatcagtcccatgatgsaaacagtctagctctgttgttttgcacagagctatgagggtcatggatccatgattagcaattatgcagaatattttcttgacactgttaatctaaaatt

SEQ ID NO: 66723 - DNA, 201 bp, Homo sapiens
ctgggtatggtggcacatgcctataatcccagctacttgggagggtgaggcaggagaatttttgaacccaggaggcagaggttgcagtgagccaagatcgygccattgcactccagcctgggcgacaagagcgaaactccgtcacacacacacacacacacacacacacacacacacgcaaagacagtgcccagtatacag

SEQ ID NO: 66724 - DNA, 201 bp, Homo sapiens
gtgatccgcttgccttggcctcccaaagtgctgggattacaggtgtgagccaccgcacctggccaaaatttctatttttaagaagtcactgttttcacttkgggaagtgaaaacttcccagacttaatgcattaatttagttttaattcacttaccaaagtgaaaacatcaagaaaacataaatttaataacttataacat

SEQ ID NO: 66725 - DNA, 201 bp, Homo sapiens
tatttttagtagagacggggtttcactgtgttagccgggatggtctcgatctcctgaccttgtgatccgcctgcctcagcctcccaaagtgctgggattasaggtgtgagccaccatgcctggccaagtgtaatggctgtaaataacacttttattactgctggtgatgttgtggttttatggggtgtgatggggctcagc

SEQ ID NO: 66726 - DNA, 201 bp, Homo sapiens
gctctgtcacccaggctggagtgcagtggcgcaatctccgctcactgcaagctccgcctcccaggtttacaccattctcctgcctcagcctcctgagtagytgggactacaggcacccgccaccatgcccggctaattttttgtattttcagtagagacagggtttcaccgtgttagccaggatggtcttgatctcctgac

SEQ ID NO: 66727 - DNA, 201 bp, Homo sapiens
ttaaaagcctcaagtggcttcttgttacacatagagtaaaaaccacactctttactgtggtctaccactccctccccgcctccccgcctccccgcctcccwgcctcccagctcattcccaagacccagctgttctggcctcctttctgttccttgactgcttcagcttcttctccactcagggcttctatacttgctgtgt

SEQ ID NO: 66728 - DNA, 201 bp, Homo sapiens
aaaaggaaaaggtgtgtattagataggcttcagtcaagcgtaaggtataggacagttgtccatgtgttcagtgttagtgaatgaacaatatgtattttaartaaggtgtccttaaacaggaatgtacagaaacacacataaaacaaggttatatattgatcaattgataaaaatgttatgacaggtttgcacgaaccaaac

SEQ ID NO: 66729 - DNA, 201 bp, Homo sapiens
actcaagagtgtggtctgcggcatcaccaggagcttgttagaagtggagatctcagacctacctcagatttactgaatcagaatcgtttttttttttttttaacaaactcttcagcaggtttagatgtagctttgtttggaggaagtgtgagattcgttttaggatttctcaaggagttccagccttcaatcagtgaccat

SEQ ID NO: 66730 - DNA, 201 bp, Homo sapiens
gctgggattacaggcatgcgccaccacgccctgctacttttgtatttttagtagagacagggtttctccatggtggtcaggctgggctggagctcccaacytcaggtgatgcgcccgccttggcctcccaaggtgctgggattacaagcgtgagccaccgtgcccggcctttagctactattatacatattataatttaaa

SEQ ID NO: 66731 - DNA, 201 bp, Homo sapiens
tgcccaggactcagtcttttgtcctcataataaatcttctggtgatcttacccagatcatctcttttaaaccccgtctacattctgatcgttctcaaatgyagtcccactgctctccttagcttcatcctgcatatttataatctctacttggacatcagtggacacttcagatttactatatccaaacaaaactcttgat

SEQ ID NO: 66732 - DNA, 201 bp, Homo sapiens
gttcgggactagcctgggcaacatagcaagaccctgtctctataaaaaagaaaaaaaaatctcaactgcttgacaggctttttattcacttccctttgtakaatgcctcctgtagtaccttttttcccctccaaatctccgtttcccccatcctaacctcctcacagtgttagaaatgcaaattactcttaatttctctgt

SEQ ID NO: 66733 - DNA, 201 bp, Homo sapiens
ttaccctcctgtcttccatcatttctgcattgctaatctctatccctggagaaatctatggaactgctggttattactgtagaaagtaacatagttgccartagtacgactttgtggatgtcacagtcaaaactcaactgcctggctggcacagtggctcacctgtaatcccagcactttgggaagacaaggcggcgggca

SEQ ID NO: 66734 - DNA, 201 bp, Homo sapiens
atgagccaccatgcccagcccaagaagtagagtttcttttatactgactttggcctaaaaaaacagattttcatggaggaaaaaaaaacctagatttttartaagactattttatatacttttttacattgatcaagtacattatttttaccaaacaacattgtttcccactacatccatggttatgtataaaaaaacgcc

SEQ ID NO: 66735 - DNA, 201 bp, Homo sapiens
gtaaattttatttgtagagaaggggtctccctgtgttgtccaggcttgtctctgactcctgggctcaaaggatcttcccatcttggcctcccaaagtgctrggattacaagcgtgagccattgcgcctggctccaaatctgatttgagtgtaaaaagttagacacaccataagctgtaggtttattactgggtggtgaaaa

SEQ ID NO: 66736 - DNA, 201 bp, Homo sapiens
ctcaagtgacccgcccttgtcggcctcccaaagtgctgggattacaggcatgagccattgtgcccagcctatatagtgtgaagcttttaggaaaatcagarcagggtagacagctgttaaaaacaatgtttaaatggaataatgttgaatgtttacaggctgtaagaactattgtatacacaaaataatacacaaagtttg

SEQ ID NO: 66737 - DNA, 201 bp, Homo sapiens
cggcggctgcctgtccgccgcggttgcgcgcgttccggggaggtgcttggcccagagagcggcctacggagaaggcacagcgagggcaaagcgagacctgrgcgcacgttgaattctgttggctttggttatctctgaaaactttaagcataatttgaataaatgctgtcagcagaatagctcggatttagttgtagttaa

SEQ ID NO: 66738 - DNA, 201 bp, Homo sapiens
attgattatagacctgatggtggagcaggtgatgccgatttccattataggggccaaatgggccccactgagcaaggcccttatgccaaaacgtatgaggrtagaagagagattttgagagagagagatgttgacttgagatttcagactggcaacaagagccctgaagtgctccgggcatttgatgtaccagacgcagag

SEQ ID NO: 66739 - DNA, 201 bp, Homo sapiens
cctgggaggcagaggttgcagtgagccgagattgcgccattgcactctagcctgggcaaaaagagtgaaactctgtctcaaaaaaacaaaaaacccaaaaataggggggagattcgttaaaatacctgtttttaaattgactttattgagctataaatcacatactatataatccacccatttaaagtgtccagttccacc

SEQ ID NO: 66740 - DNA, 201 bp, Homo sapiens
cctcccaccttggcctcccaaagtgctgggattacaggtataagccaccacatgctcctcttgagttttatagttttagttctgatgcttaggtctttggyccactttgagttttgcatatggtattaggtaagggtccaacttcattctttttgtatgtggctctctagtttacccagaaccatttgttgataaaactgt

SEQ ID NO: 66741 - DNA, 201 bp, Homo sapiens
tttaggtttaaaaccagtgactttttatgctcatctaaagtcacagggaaggaatagaagttgtatatatgttggctctgatattatctgtcttccttcakaagactgtgtgaaggatcctatgctcgcttttgttcatctcgttctttgcacagggtctggcatattctcaatagaagtttattaaacaagtgaatgaat

SEQ ID NO: 66742 - DNA, 201 bp, Homo sapiens
tcctcccaccttggcctcccaaagtgctgggattacaggtataagccaccacatgctcctcttgagttttatagttttagttctgatgcttaggtctttgrcccactttgagttttgcatatggtattaggtaagggtccaacttcattctttttgtatgtggctctctagtttacccagaaccatttgttgataaaactg

SEQ ID NO: 66743 - DNA, 201 bp, Homo sapiens
ttttatgctcatctaaagtcacagggaaggaatagaagttgtatatatgttggctctgatattatctgtcttccttcataagactgtgtgaaggatcctakgctcgcttttgttcatctcgttctttgcacagggtctggcatattctcaatagaagtttattaaacaagtgaatgaatgtatatatgaattaatatccat

SEQ ID NO: 66744 - DNA, 201 bp, Homo sapiens
gctttcagtctgtcaccattgagtatgatgtcagcggtacatgtttcatatatggcttttattatgttctggtagtttcctactgttgctaatttttaagkttttatcatgaaagagttttgaattgtcatttttttcctgtatgtgttttttccctttattctgtttatattatgtgttacactgattgattttcacatg

SEQ ID NO: 66745 - DNA, 201 bp, Homo sapiens
tttttaattaaaaatttataacagtctggtttggatgaatggtaaagacactctttgaatgaaggtcttttggatgtgtaggcctaaccttcataggtaayggcctctcctggttcccttttggtgttgggcagctagcttttgcacagcatcaggctgaagtcgccaagatggagccattaaacaatgtgtgtgccaaaa

SEQ ID NO: 66746 - DNA, 201 bp, Homo sapiens
tctttgcagtcttaaaaattgaagcccacaaacagctcttacttaaggtgattatatttattgatacttacatattaggagttaaaacaaatttaaaacayacgagtactgtacacgcaagcatgcatcccctgagtctgagtgaggctgtcactctagcatctggaatgctccgttgtatattcaggaggggacagtgaa

SEQ ID NO: 66747 - DNA, 201 bp, Homo sapiens
atatggagccaaggttgagagctattgtgctaatggaagagacagaccgataaatggctaatttcattgcttccaatgccagaagaatatacagggcacayggggaacaggagtatttaatttagcctagagtgatttttattgtacaactagaccgtaagctgtttatgggcagggcccagggctttgtcatcttggggt

SEQ ID NO: 66748 - DNA, 201 bp, Homo sapiens
tacatattaggagttaaaacaaatttaaaacatacgagtactgtacacgcaagcatgcatcccctgagtctgagtgaggctgtcactctagcatctggaaygctccgttgtatattcaggaggggacagtgaaaaagacaaataataatgtctttgtattatgaaaagttttgatctcatagatctcctgaaagtctcagg

SEQ ID NO: 66749 - DNA, 201 bp, Homo sapiens
agaatcacttggggagcttaaaaagatcgaagtgcctgggtcctaatcccagagattctgatttaatggttttgggatatggccaaaacattgggagtttyagaagctcctcgggtgattctaatatggagccaaggttgagagctattgtgctaatggaagagacagaccgataaatggctaatttcattgcttccaatg

SEQ ID NO: 66750 - DNA, 201 bp, Homo sapiens
ggcgggcggatcacttgaggtcaggagttcaagaccagcctggccaacatgatgaaaccccgtctctactaaaaatacaaaaattagctgggcgtggtagsgggcacctttaatcccagctactcgggaagctgaggcaggagaatcgcttgaacccgggaggtggtggttgcagtgagccgagattgtgccaccgcacac

SEQ ID NO: 66751 - DNA, 201 bp, Homo sapiens
attgagtcctcaggaaaatgtatttcttttccttacagagtttctgctatggtgctggaaaatcagttcatgtgctgagacatataggcggtcctgagagmgaacctccccaggcacttcggccacgggatagaagacggcaggaggaaattgattatagacctgatggtggagcaggtgatgccgatttccattataggg

SEQ ID NO: 66752 - DNA, 201 bp, Homo sapiens
ttaaacaatgtgtgtgccaaaaagatggactggactggaagtatctggggtaaggtgtttgtgcacttgtccttattttgaatagaaattctgagaatgaragaacatagaacaaagagaatgataaaataacaggaggctttccatgactgaatctttaatatcagaagaacatgcaagaagcattttaggtttaaaacc

SEQ ID NO: 66753 - DNA, 201 bp, Homo sapiens
gttaattttctaaaacttcaaatctgtgaattaacacagttaacaacaacaacaaaaacggacacaaaacaacctccaaattggattttttttttttttttgagacggagtcttgctgtgtcacccaggctggagtgcggtggtgctatctccgctcacggcaacctccgccttccgggttccagcgattctcctgcctca

SEQ ID NO: 66754 - DNA, 201 bp, Homo sapiens
aatttaaaaatcagcattacagggagtctacttaaaacttaagataatttaaaactcattggtgggtggtcagggagggtcaaaaccaaagtaatgtcttrtttgggaatgaaatgcaacattaaaagaaatgatcagtgttttgtctgtttctctaaacagaatggtttagaagttcatggacctataaggatgacccat

SEQ ID NO: 66755 - DNA, 201 bp, Homo sapiens
ttccagcttttatagttagtaattacctgtcacctatctcagaagtcttccagtgacttcctatctcacttgaggggaaagccagtattacaatggcctgraagcctccttggtctccccttcccccacatccactacctctctggtcacctcttctccctccgtgcttactctactttagccataagggctcctgactgt

SEQ ID NO: 66756 - DNA, 201 bp, Homo sapiens
atagctcggatttagttgtagttaattttctaaaacttcaaatctgtgaattaacacagttaacaacaacaacaaaaacggacacaaaacaacctccaaawtggattttttttttttttttgagacggagtcttgctgtgtcacccaggctggagtgcggtggtgctatctccgctcacggcaacctccgccttccgggtt

SEQ ID NO: 66757 - DNA, 201 bp, Homo sapiens
gatctgtgctccttatttgttgcctacttgccctttgcaaagagaacatggggaagcaggccagctctgcactgtaatgtattatagctgataaatgcaarcttgatcaaaacaactagctccttaccttgattccgatgacagcactaggctagaaacttaacccttatattatactttgactctaactaatgttgaatt

SEQ ID NO: 66758 - DNA, 201 bp, Homo sapiens
gtgacttcctatctcacttgaggggaaagccagtattacaatggcctggaagcctccttggtctccccttcccccacatccactacctctctggtcacctyttctccctccgtgcttactctactttagccataagggctcctgactgttccttgaacttgagagcctttgtacctgctgttcattctacagtcttcattt

SEQ ID NO: 66759 - DNA, 201 bp, Homo sapiens
ctacttgggagggtgaggcaggagaatttttgaacccaggaggcagaggttgcagtgagccaagatcgtgccattgcactccagcctgggcgacaagagcraaactccgtcacacacacacacacacacacacacacacacacacgcaaagacagtgcccagtatacagtaggtatttggtaaatgttgaacaaatgaatg

SEQ ID NO: 66760 - DNA, 201 bp, Homo sapiens
agaagaaataaaattagatttaacttttatgtaaaatacaatttaacagtagtttgttagagcagatggtaattcatatgaaccttcatgggaagccagcrtatgagcatgacagaaatttctatctttgaagagatcagagagaaggcatcactgaaggcccggagctctagggaaggtacagtagagccctaaaggatt

SEQ ID NO: 66761 - DNA, 201 bp, Homo sapiens
tccagcttttatagttagtaattacctgtcacctatctcagaagtcttccagtgacttcctatctcacttgaggggaaagccagtattacaatggcctggragcctccttggtctccccttcccccacatccactacctctctggtcacctcttctccctccgtgcttactctactttagccataagggctcctgactgtt

SEQ ID NO: 66762 - DNA, 201 bp, Homo sapiens
atgcctccagcatcttcatgcagccatggagtatcgttaccaggatcagtctgactgacacctcagcttatctctacgcaggctgcccacaggtcactgtrgctgtagtttcatcttttccacagctattactacgcctgcatccttattgttccttttactttgtttacttagagaaaactgaagactgccagggcaatt

SEQ ID NO: 66763 - DNA, 201 bp, Homo sapiens
tttttagagatctatacatagagaataccatgatgaggaagaagagagttgggtgtcttccttaactgcagacaggacatcagtcagcactttacattagyctttctgattatcaaaagcattcctcattttaaactttttaaaaagcaatgcataaattttgtacctgtccttagcagacttcacagacatcaggtgtcc

SEQ ID NO: 66764 - DNA, 201 bp, Homo sapiens
catcataccttatagtatacatgaaacataatgtaatccaggttgtaatttagaactttttttttttttttagctgagcacttaatgtaattaattccagrttatgactcttaaaaaacattggccattagagaaatagttctatttgcccatccaaatcacctgaatgactttttgaaagaataggggtccacatcccca

SEQ ID NO: 66765 - DNA, 201 bp, Homo sapiens
ataaagaaataaaatgtttctatactctgttttaggcaaaatatggtatttcaggggaaaaggatgtcagtcctgacttgtcatgtgctgatgaaatatcrgaatgttatcacaaacttgattctttaacttataaggttagtttttttattgataaattttatatttttatattatgttaaatcgctctatattcttgtc

SEQ ID NO: 66766 - DNA, 201 bp, Homo sapiens
atgggatgagggcaagggcaacgtcattaagtttcctttttaaaatactttccaaactccaccataattacgttaagaacctgtactaggtcacttatacygtattgatgaacaagccacaaaattgtagaaatgattttgtgcttttgagtccagttctttttagctgtcttaagtgtttttggtggctgatttctgctt

SEQ ID NO: 66767 - DNA, 201 bp, Homo sapiens
tattttttattttttgtggatatggggtcttgctgttacccaggctggtctcaaactcctggcctcaagcagtcttctcaccttggcctcccaaagttatrggattacaggtgtgagccaccatgcctaaccatatcactttttcagaccaccctaatttaaactgtaatttgaccctgccagcccacccacattcagcac

SEQ ID NO: 66768 - DNA, 201 bp, Homo sapiens
ctcacttgaggggaaagccagtattacaatggcctggaagcctccttggtctccccttcccccacatccactacctctctggtcacctcttctccctccgkgcttactctactttagccataagggctcctgactgttccttgaacttgagagcctttgtacctgctgttcattctacagtcttcatttatatatcaatca

SEQ ID NO: 66769 - DNA, 201 bp, Homo sapiens
atgtttatccactgatgtgcatttcagcgctcaactcatggtccacactccgttaaaaaatgcaagttgatgatcacaaagttattctaatgtttgaaaartacccactaccctcagcgacttgcctgctgggttggtggtggcagagctaagttcgtaggaagtctgctcccgtgtagaattgtgtgctgaagggttgcc

SEQ ID NO: 66770 - DNA, 201 bp, Homo sapiens
tccctgggaccgtaaaataaggctgaaaaagtcttcatctggtactgtcggaccctttgtggtagcaggtggtggagcacatctttgatcatctaatctgratccctagaagtttatgagagagattaaaagacatactgtgggaaagaaagcaccaagctatgttaaatctctcagtcacaacaagaaaacgcagttgta

SEQ ID NO: 66771 - DNA, 201 bp, Homo sapiens
aaagcattattttgcaaaaagtcctttagcccaaagtcagtgtctctgttttgatctctttgtaaaagaactctctgttcatccattctctttccctgggrccgtaaaataaggctgaaaaagtcttcatctggtactgtcggaccctttgtggtagcaggtggtggagcacatctttgatcatctaatctggatccctag

SEQ ID NO: 66772 - DNA, 201 bp, Homo sapiens
ctgtgggagtactgtggagtttggtgaggtataataacatttatataattataacccagcactggaccctggatttgaaagagtttggagcttgctacaayggatttgggtgggaactttttagatatgtttgattactaagacttcacattacattaaacagttaaaatgtaattttgtactttatagcataaatcacct

SEQ ID NO: 66773 - DNA, 201 bp, Homo sapiens
aagaccctatcctctcagagaagcccctgagagccattagtacttttgccctggagaggcagtttaggtagagccagtctgggttctaccacttactagcytggtggtcttaggcaagttactttgtgtgatctgtaaaatgaagatgagtgaagataagagtactacttccagtagttttgtgaggattaaattaatgta

SEQ ID NO: 66774 - DNA, 201 bp, Homo sapiens
ttttatgttgggttgcctttttactgttgataatgtcctttgatgcacaagtttttaattatgaagtccaatttgtctacgttgttgttgttgttccctgytcactcttttggttttataaccaagaaatcactgccaaacccaatgccatgaggctttccttttttttccctttagagacagggtctcactctgtggcct

SEQ ID NO: 66775 - DNA, 201 bp, Homo sapiens
ctctatatatatacacacacacacacgtctctcctaaaatgtaagatcctttaaaaatcaagtgtgtcctcgatgcctagaatagcagctgaaacataatyggtgttcaataattttttactgaatgatggacaataataactctctaatacaaaataagcccttcctgaatgagaattataacactaccaatgttttcag

SEQ ID NO: 66776 - DNA, 201 bp, Homo sapiens
cagaaagggatgtggaagaacatgggtatgctgagaaagagtttggggatccaggagcagacattaagaagaaatattactcgtcatccctccatggtctrttcagtgttttttgttatcgattttttagctattacccaagtaaagcagttgtcgcataaaacaaaaagaactcagatgtgccaagggaaattctcttcc

SEQ ID NO: 66777 - DNA, 201 bp, Homo sapiens
gttttttggcttgtgattacaggattatgtggttgacgggtatttttttgttaggtgacattagttctatagtcatagtttagtctctgaaactgaaattwtcagcagagtcttcaccatctgtttttgtttcatgtgctccctcaggaaagttatgctctttgacttttgctgcttttgtcttcaaatagtagtgtttga

SEQ ID NO: 66778 - DNA, 201 bp, Homo sapiens
tttttgttaggtgacattagttctatagtcatagtttagtctctgaaactgaaattatcagcagagtcttcaccatctgtttttgtttcatgtgctccctmaggaaagttatgctctttgacttttgctgcttttgtcttcaaatagtagtgtttgaaaaactagtacagaaattttcaaagtttctgttctcaggacctc

SEQ ID NO: 66779 - DNA, 201 bp, Homo sapiens
acctttgcttacccactacccctttatcctcctttaaagttcttcatagcaagcataattacctaatacaacacacatatactctctctctatatatatayacacacacacacgtctctcctaaaatgtaagatcctttaaaaatcaagtgtgtcctcgatgcctagaatagcagctgaaacataatcggtgttcaataat

SEQ ID NO: 66780 - DNA, 201 bp, Homo sapiens
atggctcactgcagccttgaactcctaggctcaagtgatcctcccacctcagcctcctgtgtagctgggactacaggtgtgtgccattaatttaaaaaaawttttttatagagatggggtctcactatgctgcccagtctagtcttgaactcctgggctcaagcaatcctcccaccttggcctcccaaagtgctgggatta

SEQ ID NO: 66781 - DNA, 201 bp, Homo sapiens
gtgtgatcctggctcactgcaacctccatctttcaggttcaagtgattcttcagcctcagcctcccagtagctgagactataggcatgcgtcaccacaccyggctaatttttgtatttttagtagagatgggggtttcaccatgttggccaggctggtctcgaactcttgacctcaagtgatccacccgccttggcctccc

SEQ ID NO: 66782 - DNA, 201 bp, Homo sapiens
atccaggcaggactgcagtggtgtgatcctggctcactgcaacctccatctttcaggttcaagtgattcttcagcctcagcctcccagtagctgagactayaggcatgcgtcaccacacctggctaatttttgtatttttagtagagatgggggtttcaccatgttggccaggctggtctcgaactcttgacctcaagtga

SEQ ID NO: 66783 - DNA, 201 bp, Homo sapiens
cttcggcctcccaaagtgctgggattacaggtgtgagccactgcgcctggctgctgatttatttttcatagacacgggggtctatgttgcccaggttggtyttgaactcctagcctcaagcgatcctcctgcctcagcctcccaatgtgctgggattacaggaatgagccaccatgcccagcccaagaagtagagtttctt

SEQ ID NO: 66784 - DNA, 201 bp, Homo sapiens
aggaagacaaagcttaatgacaactaaggttctagctgacatctttctttcatatttaatttttgtgagttttcatctgttttctgtttgtttatgtgtcytaggttcttgacctaaccacatgggttttgttttttgtttttatattagaacttagaaaagtttgttttacagcagtattatggaacagaagagaccatt

SEQ ID NO: 66785 - DNA, 201 bp, Homo sapiens
cagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcct

SEQ ID NO: 66786 - DNA, 201 bp, Homo sapiens
gcagcctccacctcctgggctcaagtggtcctcctgcctcagcctcttaagcagttgggactacaggtgtgtgccagcatgcttgctgttttttttttttttgagacagagtcttgctctgtcactcaggctggagtccagtggcttggtctcagctcactgcaatctctgcctcccaggggttcaagtgattctcctgcc

SEQ ID NO: 66787 - DNA, 201 bp, Homo sapiens
atcatagctcagtgcagcctccacctcctgggctcaagtggtcctcctgcctcagcctcttaagcagttgggactacaggtgtgtgccagcatgcttgctrttttttttttttttgagacagagtcttgctctgtcactcaggctggagtccagtggcttggtctcagctcactgcaatctctgcctcccaggggttcaag

SEQ ID NO: 66788 - DNA, 201 bp, Homo sapiens
tttagtaagactattttatatacttttttacattgatcaagtacattatttttaccaaacaacattgtttcccactacatccatggttatgtataaaaaamcgccattgtcaattaagatgttaaaaaattatttccataagagtattaaattctaatctatgattcacttaacttcctactttataaacactaggtaaag

SEQ ID NO: 66789 - DNA, 201 bp, Homo sapiens
ttacttacgtgcctgtaacaatgtaattttaggccaggtgcagtggctcatgcctacagtcctagcactttggaaggttgagggaggatgatcgcttaagytcagttgttcaaggctatgtactaaaaataaaactagccaggcatggtggtacacgcctgtagtcccagctacttggagggctgaggcaagaggatcgtg

SEQ ID NO: 66790 - DNA, 201 bp, Homo sapiens
tgtgcataattgaaaacttaggaactgtttacttctggaattttccatttaatattttcagactgcagttgactgtgggtaactgaaacctcagaaagcawaaccgtagatggggttaccactgtagagttactgtgttaccttgatccaaaacctttacctgaatgattcctttaaccattcccggtaggctttctctgt

SEQ ID NO: 66791 - DNA, 201 bp, Homo sapiens
gacaggatccggtcagcagcccctgtggctagaggaacaccagcacaaacgacagcctcaagtctccttcgagctttgtaaagtatactcttcactctctytctcttctctgcaagaattctgattactacaaaggtgccaacttcaacattcacatttcaacttcaacattcacatttttactgacaattagaattaaca

SEQ ID NO: 66792 - DNA, 201 bp, Homo sapiens
tgttgcctacttgccctttgcaaagagaacatggggaagcaggccagctctgcactgtaatgtattatagctgataaatgcaaacttgatcaaaacaactrgctccttaccttgattccgatgacagcactaggctagaaacttaacccttatattatactttgactctaactaatgttgaattgattttatggttacaga

SEQ ID NO: 66793 - DNA, 201 bp, Homo sapiens
gcacttgcagttacattcaccacatttgtaacggagccattgaagcatattggaaaaggaactggggaatttattaaagcactcatgaaggaaattccagygctgcttcatcttccagtgctgataattatggcattagccatcctggttagtattaatatattagcactgtcgggccaggcgcggtggctcacgcctgta

SEQ ID NO: 66794 - DNA, 201 bp, Homo sapiens
tgctaaagtttaatttatcagttaggcacagtaagagattaacagcaataactaataaaatagaaaaattataacaatacacaataataacagttatgtastgtggctggaattttttcacttgaggtgcgacagcaaaactagcatgaatttctttctcctcctgtacaatttcatggatacaagttttgttcttaacat

SEQ ID NO: 66795 - DNA, 201 bp, Homo sapiens
aagcatacgaaataagttgcagcctcccgacttataccctggtacttctagtctaaaacaggatttgactctactaatccaggttagtcttgcctttcccrttactcatgtgctttcgttgaaaccaaagactttttcttttgtgcccatttctactcactgcctggccgtctgcacgacgatctgtgtttcctggtagtt

SEQ ID NO: 66796 - DNA, 201 bp, Homo sapiens
ttgaaattatcgttttttcttcattcagttgatacgatgtatcacatttattgatttgcatatattgaaccatccttgcatacctgtgataaatctaactygatcatggtgaataatctttttaacgtgttgctggatttggtttgctggtgtttttgttgagggtttttgcatctgtatttattagggatactggccata

SEQ ID NO: 66797 - DNA, 201 bp, Homo sapiens
agttaatttgctagagcagcttacagaactcagggaaacttatgttaaccagcttactagaaaggatattacaaaatatatagatgagcagtcagatgaargagatacataggaaaagttatgaggaagggggtgtggagtttccatgccctctctgggcatgcctccctgcagacacctgcacatgttcagcaacccaga

SEQ ID NO: 66798 - DNA, 201 bp, Homo sapiens
cccatcattggtccctacaggtatgtggggtgcatttctgcttcaccagttatgggaatgggattgctggcagtggctggcagctagttcttaaaccctagggactgcatgcaccagtgcccttggtcttggaggtggcctccctgctgtgctagattgcttgttcctttaggtctactatatcagctcaggttctggagt

SEQ ID NO: 66799 - DNA, 201 bp, Homo sapiens
ggatagatttttctatttctgtgcaaaatattgggattttgatagcaattgcattgattctgtagattatttttggtagtattgacatctcaacaatattraatctttcaatttatgaacatgggatgtgtttccatttatttatatcttctttaatttctgttagcagcgtcttttagttttctaagtatttcacctcct

SEQ ID NO: 66800 - DNA, 201 bp, Homo sapiens
agtgcagttcgttccacttttgacgcattggttgtgtggcatacagttggacattgtcgtagagaagaattggaccctttctgttgatcagtgccggctgygggcattgcagttttcaatgcatctcatcgatttgctgagcatacttatcaaatgtaatggtttccctgggattcagaaagctgtagtagatcagaccgg

SEQ ID NO: 66801 - DNA, 201 bp, Homo sapiens
acctcagaaatgtaaatcgaagagggaaatgtaatttaagcctgtagaatcaatgcattaatttgttttgcaaaaatttagagccctgtatgagtggaagytgtgaatgctgaacccaagatatttgagagattcttcaggtattgcaaatttaattattctgtttcatgagagtgacatctaaatgtgattatttgtacc

SEQ ID NO: 66802 - DNA, 201 bp, Homo sapiens
aaacaagatcagacccaagataagtgaccaagttcaataaaaacttttttttttaaatcaaagcaaagtatatctgcagtaaaataatgaaacccattttsttggtttacaaactggcttagaaatctttgaactaaagatttatggtgagctgggtattttaggagacatgctttccttgttatcgaatttcctgttagt

SEQ ID NO: 66803 - DNA, 201 bp, Homo sapiens
ccagccttgcatcccagggatgaagcccgcttgatcatggtggataagctttttgatgtgctgctggatttggtttgccagtattttattgaggattttcrcatcaatgttcatcagggatattggtctaaaattctcttttttgttgtgtctcttccaggctttggtatcaggatgatgctggcctcataaaatgagtta

SEQ ID NO: 66804 - DNA, 201 bp, Homo sapiens
ttacaggcgtgagccacaacgcccagcctacttttcattcgttaaggaatctccacactgttttctatagtggttgtactagtttaccttcccaccagcastgtaaaagtgttcccttttcactacatccttgtcaccatctattattttttgatttttaaattatggccattcttgcaggagtaaggtggtagtgcattg

SEQ ID NO: 66805 - DNA, 201 bp, Homo sapiens
aacaggatggtatgtaggttacagtgcattgtacaatgctttatatatagtaagctctccattcagtaaaatgtaatattttgaatacaatatttggactmttcataaaaaaggaaactgaacattatcatttttatagaaattaatatacatgcaaactttagattttttttttttttttttacaactagtatttgttcc

SEQ ID NO: 66806 - DNA, 201 bp, Homo sapiens
ttctataagctttctatataagggttctatataagctttagttttcccattcctttgacgtgtcatgccttctatcctaaatgtgttttctcttttttacytgtctggtaagcctgtattgcctacttttatagttatttgtgtgtatgagttatttttaacaccagagtttgaagtttttatggggagatatgtgcttca

SEQ ID NO: 66807 - DNA, 201 bp, Homo sapiens
tgctttctttaaaattattattagattgcaagactggaggaagataaagaagaactacgtaaccagctgcttaatgttgatctcacaaaagacagcaaacragtggaacaacttgctcgagaaaaagtctatttgtgtcaaaaattaaaaggtttagaggctgaagtagcggaattaaaggctgaaaaggagaattctgag

SEQ ID NO: 66808 - DNA, 201 bp, Homo sapiens
atatttgtgcaaaatggacgggcttggccaaggaatggagacatgggcatcatggccttgacctatgaccccaccacagctcttcagaatgggttttaccyagccccttataacatcacccccaacaggatgcttgctcggtctgcactctccccatacctttcctctcctgtgtcttcgtatcagagagtgactcagaca

SEQ ID NO: 66809 - DNA, 201 bp, Homo sapiens
atataccaactcccagcccacagcctgttttgttttagtcagttcccttattgtttttatttaatgccattatattatatttgcatatgccataacatttrcaaaatgcccattctctccagcttcggcttaagaaggagtgggggagaccatacatatgctaagtccatgttcaatgttgtactcctacactttgcacaa

SEQ ID NO: 66810 - DNA, 201 bp, Homo sapiens
taacatcacccccaacaggatgcttgctcggtctgcactctccccatacctttcctctcctgtgtcttcgtatcagagagtgactcagacatctcctctayaagtacctaacccatcctggatgcaccaccattcatacctcatgcagccttcaggttcagttctgacaccagggatggaccatcccatttctctccagcc

SEQ ID NO: 66811 - DNA, 201 bp, Homo sapiens
gcttgcagtgagccgagattgcgccactgcagtccgcagtccggcctgggcgacagagcgagactccgtctcaaaaaaaaaaaaaaaaaaaaaaaaaaaaragttaatttctagctttattgcattgtgatcacaatattgtttgtactctttctgctttgtggaacactctgatgtttctttgtaacctaatctatcaag

SEQ ID NO: 66812 - DNA, 201 bp, Homo sapiens
taagagtatgaagttctatatatatatatatatatgaagttctatatatatatacatacacacacagacatacatacacacatatgtgtctgtacacatargatctgccttgttaactgcgatgtttaggtcttctgtatacttgcttattttttgtccacttgatttgtcttgtacaaagaatgatatattaaagtctcc

SEQ ID NO: 66813 - DNA, 201 bp, Homo sapiens
atttattctttgggagtcaagtcacctatctgaaatgtcttaactcttaaaatgccacataatagaatatgcaaaataaaaatatatgtatttgagtttcygagcgtaaagtcatctcaaaccagaaagaataatttctttcaagatagtacattccttacactgggatttgaggtcttaaagtcacaaatcctgtttgaa

SEQ ID NO: 66814 - DNA, 201 bp, Homo sapiens
ctgcttcagattagttcatagggattagcctcattcttttttatggctgcatagcactccactatgtgtatctatcagtgtttagtgaaatagtctcctawgttcatttaatttccaatattttgtctttttttttttttttttttcaaacacagtcttgctctgttgcccaggctggagggcagtggggcgatcttggct

SEQ ID NO: 66815 - DNA, 201 bp, Homo sapiens
tatatatgaagttctatatatatatacatacacacacagacatacatacacacatatgtgtctgtacacataggatctgccttgttaactgcgatgtttargtcttctgtatacttgcttattttttgtccacttgatttgtcttgtacaaagaatgatatattaaagtctcctattattactgtgtttctgtatgtgact

SEQ ID NO: 66816 - DNA, 201 bp, Homo sapiens
gatctccttttctttttctctttcttctattcttcctcctcaaatctatcctctgcaaataaacgacttatttttctgaaatgtaaatgtgagtctacccygtaatgtcttctatccatctaaaagtttaaaatctttcactggctctccaagaccatggaataaattccagtcttctgcatgtggccttctaggccctac

SEQ ID NO: 66817 - DNA, 201 bp, Homo sapiens
tttatgttgccatccttccatccttaatgtattttacacagtgacagaataagtgagatgattgcagttgaatatagcatacagtcctgatgtgaaacttyccattgaggtcctttagagtgattattttcagggcaagttgaatgatgacaaaagatttatttgtgacattttcagaagagcctatatttaattttatta

SEQ ID NO: 66818 - DNA, 201 bp, Homo sapiens
tcacagtagaaaaatacaacttctattgtttgccctgtatgttgcttccctttgatagcagggactcacattaaatgaagccaagaagttacattagagcytttgctgcccaatatgatattactagtcacagatgactgttgaaacctaaatttaaattagaattttaaaaaattaaaattcagtttcttcagtcacatg

SEQ ID NO: 66819 - DNA, 201 bp, Homo sapiens
gtgagatgattgcagttgaatatagcatacagtcctgatgtgaaactttccattgaggtcctttagagtgattattttcagggcaagttgaatgatgacaraagatttatttgtgacattttcagaagagcctatatttaattttattatttgtcagatgaaatgaaaataagcgtatgacagcaagcatttctttcttct

SEQ ID NO: 66820 - DNA, 201 bp, Homo sapiens
aaaaatcaaaaaagacacgggtttacataatggtaaagggttcaattcaataagaagacgtaactatcctaaatatatatgcacccaacataggagcaccyggattcataaagcaagttcttagagacctacaaagagatttatactcccacacaataacagtgggagacttccacattccactgacagtattaaatcctt

SEQ ID NO: 66821 - DNA, 201 bp, Homo sapiens
tgaaaaccagcacaagacaattataccctctctcaccactcccattcaacatagtattaaaagtcctggccagagtagttaggcaagagaaagaaagaaakaaagggcatccaagtaggaggagaggaagtgaaactattcatgtttgcagtcgacatggttttatgtttaggaaacccccatagtctcaatccaaaaagc

SEQ ID NO: 66822 - DNA, 201 bp, Homo sapiens
gtcaggatggtctcaatctcttgaccttgtgatctgtccgcctcggcctcccaaagtgctgggattataggcgtgagccactgtgcctggctccccacccttttttttttttttttttttaatgggttcttgatctgttgtccagggtggagtggcacagtcatagctaactgtagccttgaactcctaggcttaatccat

SEQ ID NO: 66823 - DNA, 201 bp, Homo sapiens
atatccttgcaaatgaaaacattttgctgtcatatcatctttattatagttcttgtaacataattatgatctcttgttttaggttagaactcgagaacagrttagcagatttggagaaaatgaaagtggaacatgatgtctggaggcaatctgaaaaggatcagtatgaagagaaattgcgggcttcacagatggcagaag

SEQ ID NO: 66824 - DNA, 201 bp, Homo sapiens
ccaaatgtatggatttctacccatcaacaagcaagcattcagttctgcagtggacagcagtctgacatcttctaatctaatttgattctactgctctctayatggagatagcatcagatcctgcgggttgaaggcttggtcccacaagattgccaccatttcagacaccagtctcactttcaggactctggaacttctgat

SEQ ID NO: 66825 - DNA, 201 bp, Homo sapiens
ctgagtagccagactacactgctggaataattggaaccacagatgtcgcaataggacatgggatgtgctggcttctgctgtggcttctctcttgggggggycaccaagtataatacttttcatgcagtacattttacctgagctccctagctcacctgtgtgctgaccctgatttttcttctttttttccatatatatata

SEQ ID NO: 66826 - DNA, 201 bp, Homo sapiens
tctactaaaaatacaaaaaattagccgggcgtggtggtggatgcctgtaatcccagctacttgagaggctgaggcaggagaatcacttgaacccaggaggyggaggttgcggtgagctgagatcacaccattgcactccagcctgggcaacaagagtgaaactccatctctaaaaaaagaaaaaaaaaaaaagaaatagta

SEQ ID NO: 66827 - DNA, 201 bp, Homo sapiens
taattttccatgaaaggccactttttcaggctgttgtttatgtatatcaaaatcctacctgtcaggtttttatccatgtagcgttccccagtacccctggrcagacttgatttctcatcctctctatgcccctagtttgtagattttcctatcacaatagcagtaatttgttttacatttttgttatacgtgaacacaacc

SEQ ID NO: 66828 - DNA, 201 bp, Homo sapiens
tttgcatttccctgcacagtaatgttggacacctttttctgtggttattggccatttggtggaatatctgtttaaggcatttgcccattttttagctgggtttttttttttttttttttggtcttactgagttgtaagagttctttatatatgctggatgaaagtttgtattgtttttaatatcagagataagatttgcaa

SEQ ID NO: 66829 - DNA, 201 bp, Homo sapiens
gacttgatttctcatcctctctatgcccctagtttgtagattttcctatcacaatagcagtaatttgttttacatttttgttatacgtgaacacaacctartttcttgaagtctcaatctttggttgtgtttgtgctctggtgtcaaacaggcattcaataaaatgactctttaattcagtgaaataaatgaatcatggat

SEQ ID NO: 66830 - DNA, 201 bp, Homo sapiens
atggcattttctttctttcttttttaagacaaagtcttactctgttccccaggctggagtgcagtggcgcgatcttggctcactgcaacctctgcctcctyggtttaagcaattctcctgcctcagcctcctgaatagctgggagtataggtgtgcatcaccacacccagctaatttttctatttttagtagaggtggggt

SEQ ID NO: 66831 - DNA, 201 bp, Homo sapiens
cttataccacagtcacattctgggtgcccatgaatttttgggagacattattcaacctaaaataagaactcataaagcctatgaattcttcctttatgatgcctctcaaattttcccccaccccatatttcttttcattcctattactaacatccttggtcagactgtcttccctacgaggtttatctgtattcatttatc

SEQ ID NO: 66832 - DNA, 201 bp, Homo sapiens
ttttttttaggaggtttatagtttaggtttttaattcaggcctctgatttattttgatcctatttttgtatatggcgtggggagcaacttgaagttctttktgtgtgtgtgtgtgtgtgtatggaaaaggcaattgttccaggaccatttgttgaaaagactatcctttcttcactgaattgactgcatttttgtcagaaa

SEQ ID NO: 66833 - DNA, 201 bp, Homo sapiens
aggggtgggctgccatctttgctgttttgtagccttagctattgccttcattgcagccaccctatggaaaagcatccagactgcttttttatgcaggtccyagaccctgcttttcaatgggtgggggacctcccgaccagggtcactagtcacccttgttggtgttttccagctggcagtggttccaagccaccctgggac

SEQ ID NO: 66834 - DNA, 201 bp, Homo sapiens
catttgtatatcttttgagaattgtctattcatgtcctttccctaatttttgatgggaatatttggtttttttcttgcagatttgtttgagttcctcgtarattctggatattagtcctttgtgggatgcatagtttgtgaatattttctcccactctgtgggttgcctgttcactctgctgattatttcttttgctgtgc

SEQ ID NO: 66835 - DNA, 201 bp, Homo sapiens
ccattcatacctcatgcagccttcaggttcagttctgacaccagggatggaccatcccatttctctccagcctgcctccatgatgggaccccttacccagyaactgggccatctctgcctcagcagcacaggcatgtatatgctgacggctgcagctatgcaaggagcttacatctcccagtacacccctgtgccttcctt

SEQ ID NO: 66836 - DNA, 201 bp, Homo sapiens
tcactgcaagctccgcctcctgtgttcataccattctactgccttagcctcctgagtagctgggactataggtgcccgccaccacgcctggttaatttttwaattttttattgttagtagacatggggtttcaccatgttagccaggatggtctcaatctcctgagctcgtgatctgcctgcctcggcctcccaaagtgct

SEQ ID NO: 66837 - DNA, 201 bp, Homo sapiens
aaaaagatggaagataaaaattttacctatctcaggaatgaaagagtatcactcatgaccttgcagacattagaagggaaatcagataatcctttgaacarctctactctaataaatttgacaatgcagatgaaatgaatcaatttcttaaaaggcacaaacgaccacaactcatttaatgtgaaattggcagtttgtata

SEQ ID NO: 66838 - DNA, 201 bp, Homo sapiens
ccaaatccaagatggtgattttttttttccccagccagtggtacaggagtacaatggtatgttttgaagagtagaagttactttttattttgttacatgaygctctgtcagtatttactggttttctgaattaaaagttgtcagtatcattgtaccttaaacatgaagcagttcattgtgagactatttatgttgccatcc

SEQ ID NO: 66839 - DNA, 201 bp, Homo sapiens
acagtgggattcccctccccatctttactgagtagaaatgaattcttggagatactcatgctcccaaattccagagggttaaccaggaatggagaccatcygtcggccctgctaaggactaacacttagccatcgtttttcacaggcctgggcctggaaaaagaaatctctatgttcctgccctttactgttgctgatgga

SEQ ID NO: 66840 - DNA, 201 bp, Homo sapiens
gtgggattcccctccccatctttactgagtagaaatgaattcttggagatactcatgctcccaaattccagagggttaaccaggaatggagaccatccgtyggccctgctaaggactaacacttagccatcgtttttcacaggcctgggcctggaaaaagaaatctctatgttcctgccctttactgttgctgatggagcc

SEQ ID NO: 66841 - DNA, 201 bp, Homo sapiens
aatccttattatatgactatatctaattttagaagctccttaccaaagagaagggctatggaaaatgaatttatatgatttatacttgttcctgcccccartcccctacctaatacttgtgcacatgcgcacacagacacagtctatacacattacactattttgtcaccagattcaattgattcttccttcccccctccg

SEQ ID NO: 66842 - DNA, 201 bp, Homo sapiens
tcattttactttttaaaatgtgatctatggattgtgatttaagtcatagtgaaattgttaaggtcaattcagtgaatgattatgacctagaattgtcctaytatgtgggacactgccctaggagcttacaagtttacatcaattaaaatagaaaaacatcatgtgtaacttagaaatacaattaaaaagtatataagtatg

SEQ ID NO: 66843 - DNA, 201 bp, Homo sapiens
tctgccttgtctttacatgatggtctccctgtgtatctgtagctctgtgtccagatttcactcctgttatgtaaggacaccagtcatagtggatttagggyccactcgaatccaatctaacttcatcttaacttgattacatttgtagaccctatttccaaataaggttactctagggtgttttccaataccagcaatcat

SEQ ID NO: 66844 - DNA, 201 bp, Homo sapiens
  misc_feature (1)...(201): n = A,T,C or G, or insertion/deletion polymorphism (see Tables 1-2)
gcaatctgaaaaggatcagtatgaagagaaattgcgggcttcacagatggcagaagagatcaccaggaaggagcttcagagtgttaggttatatatacatntatatttaaagtttttcatgttgaaataaggtcagagttaacaaaatgatgtacaactagtacaaagaattcccatgtgctcttcaccctgatctcccaa

SEQ ID NO: 66845 - DNA, 201 bp, Homo sapiens
ggtttttgaattgagaagtgatatctgaattacatttttgaagaatctctggctgttgtgtagaggggcagaataggagtcagggaaaccatgttttagtygtccaggttacagatcagcactaaaaaagatgagtttagaactaaaaaaatacaataacaataattaactcaatggatagatttaatagcaaacaacatc

SEQ ID NO: 66846 - DNA, 201 bp, Homo sapiens
tttccctattatacttggtttttttggccttttttcccttgcttaaaaattttttttaaattaccttactttttaagagttctttatatattaggattatrctgcagatattttctgccagtgtgtgtcagcagtcctttgattttgcttccgttatttttttgccatgcaaaaatttttattatgtaatcaaatttaatc

SEQ ID NO: 66847 - DNA, 201 bp, Homo sapiens
ctaacatcatacttactgattaaaaatattgactgcttccccttacttacccaaggtcaggaacagatgtctactatcaccattttgtttaatattttatyggaggttctagttagtgtaataaggcaagaaaaagaaatggagggggaggctggtcaagatggccaactagaagcagctggtgtgtgccactttcatgga

SEQ ID NO: 66848 - DNA, 201 bp, Homo sapiens
ttttaaattaccttactttttaagagttctttatatattaggattatgctgcagatattttctgccagtgtgtgtcagcagtcctttgattttgcttccgytatttttttgccatgcaaaaatttttattatgtaatcaaatttaatctgttattgcctctgggtattaagtcagagttagtactctctccctgaactgag

SEQ ID NO: 66849 - DNA, 201 bp, Homo sapiens
agagcaatcaggacagtcatccacttgggagtgacacagagccagaggagcctcctcttcccagggaagtggtgagtgagtgagtgaccccagcgacccamgcttctcccttggatctttgcaacccacaggtcaggagatccccttgtgagcccactccaccagggtctgcagcctgttacacagaattatgtggagtct

SEQ ID NO: 66850 - DNA, 201 bp, Homo sapiens
aaaacaaacacataaatcaatggaacagaatagagtaaccagaattaaggcctcacagctacaatcatctgatcttcaacaaagctgacaaaaacaagcartgggaaaaaggacaccccattcattaaatggtgctgggataaacagctagccatatgcagaagattgaaactagacctcttccttacaccatatgcaaaa

SEQ ID NO: 66851 - DNA, 201 bp, Homo sapiens
ggaaagaatttaaattttcattaacaggaaaatgtataaaatgtggtatatttgtacaatgaatgacaacattgcaatgaaaaagaagtactgtgacaatrcataaccatggcttagtcatatagataaaatgttgagaaaaaagtccagatacaaaagagcataaatttatgatttctttcatatgaatgggtggatgga

SEQ ID NO: 66852 - DNA, 201 bp, Homo sapiens
atagataaggaaactgattcagagtgaagtgacttgcataaggtcatagctaataagtgacaaagtttcaaacctaaacctgttgaatccaaaacccgggytctttctattgtatcaagcccctgaggtattgaaggaatcagattgattctttttcagaagatgggagtattaataagtaattatgttttataacataag

SEQ ID NO: 66853 - DNA, 201 bp, Homo sapiens
ccctttgatagcagggactcacattaaatgaagccaagaagttacattagagcctttgctgcccaatatgatattactagtcacagatgactgttgaaacytaaatttaaattagaattttaaaaaattaaaattcagtttcttcagtcacatgaagtacatttcaagtgtgcactagcaacatgttgctagtgactatca

SEQ ID NO: 66854 - DNA, 201 bp, Homo sapiens
ttgtgcaccatcttggcccagtattagggtattttattacagcctagcttggcttccacctaatctttgcttgtgtggatgggggtggaactacagttttkttttgtgtgtgtgtgtgtgtgtgtgtgtgtatggtatttggatagagtagattgtaattgtctacatattatcttgctaggctccctcttttttgttcct

SEQ ID NO: 66855 - DNA, 201 bp, Homo sapiens
cattcattcattttccagcctgctctagggttcaggctttctggtggctagagcctatcctggcacagaaccaaccctggacaggatgacattccattgcrtggtgcacttaaatacacacccatactcattcctactgggacaatttcaatctcccagtgaatctaatgtgcacatctttaggatatgagaagaggaaac

SEQ ID NO: 66856 - DNA, 201 bp, Homo sapiens
gtgcttatttgattttgaaatacttgaaaaatgatgaattttaaactattttgtttgtatgaaaggctgaaaaacaatcagctaatttacgggcagaacgyttggaaaaagagctacaatcaagcagtgaacaaaatacctttttaattaataaattgcataaagctgaacgagaaataaatacattgtccagtaaagtaa

SEQ ID NO: 66857 - DNA, 201 bp, Homo sapiens
gtgcaccatcttggcccagtattagggtattttattacagcctagcttggcttccacctaatctttgcttgtgtggatgggggtggaactacagttttttkttgtgtgtgtgtgtgtgtgtgtgtgtgtatggtatttggatagagtagattgtaattgtctacatattatcttgctaggctccctcttttttgttccttt

SEQ ID NO: 66858 - DNA, 201 bp, Homo sapiens
taagattcctaggaggtaagaaaaagttagagatgctttgtcagagacctcagatcagaagacccctaaactgttgtatgctattagattgcacaggccartggtgaggtgcacaccattacaggatttaaagcactgttgtttccaagaggcatctgtgatgtaattgaacatataatgctagaagctgcatggatattg

SEQ ID NO: 66859 - DNA, 201 bp, Homo sapiens
cactaatagatgccaacactgagatgcagaggtgttagaattatttgacaaacatttcaaagcagccatggtaagaatgattcaatgaggaattataaacstggttgaaacaaacaaacaaacaaaacccaaaagacttagcaaagaaacagagaataaagagaagaaaattggaaattttagaactgaaagagtgactaa

SEQ ID NO: 66860 - DNA, 201 bp, Homo sapiens
tcctctttcacctcctttggagactcttaattacattctaatattagaccacttaaagttctgccatagcttgctgatgttgtttattaatttatttttartattttttgtctctgtgcttcattttggttagtttctgttgccatgttttcagattgattgattttttcttctgcagtatctaacctgccattaattcca

SEQ ID NO: 66861 - DNA, 201 bp, Homo sapiens
gtaaaatgtaatattttgaatacaatatttggactcttcataaaaaaggaaactgaacattatcatttttatagaaattaatatacatgcaaactttagattttttttttttttttttacaactagtatttgttcctccttcattcatgaaatagttgagtggttcctatgtgccagacattggtgggaggtattgggaat

SEQ ID NO: 66862 - DNA, 201 bp, Homo sapiens
cctgcattcgaaatctgatgactaatctatttttcacttatgaaggactaagtgattctcattaaaatttttaaggggttggtatagtcattaatttatcattattattattattatttttgagatggagtcttgctctgtcgcccaggctggggtgcagtgatgcaatctcggcttactgcagcctctgcctcccaggtt

SEQ ID NO: 66863 - DNA, 201 bp, Homo sapiens
ggctaatttttttgtgtttttagtagagacggggtttcactgtgttaggcaggatggtcttgatctcctgacctcatgatctgcccaccttggcctcccamagtgttgggattacaggcgtcccgagtcaccacacccagccaaaatatgaactttaagtatgtaagtaatttaagtgatattttcttcatgtaaggaatg

SEQ ID NO: 66864 - DNA, 201 bp, Homo sapiens
ctgcattcgaaatctgatgactaatctatttttcacttatgaaggactaagtgattctcattaaaatttttaaggggttggtatagtcattaatttatcattattattattattatttttgagatggagtcttgctctgtcgcccaggctggggtgcagtgatgcaatctcggcttactgcagcctctgcctcccaggttc

SEQ ID NO: 66865 - DNA, 201 bp, Homo sapiens
ctttgatgttcacacaacaatgaaattacttaacaatgagtttatcagagcatatccttgttaagtgatgcatggagataatatttgtgcatttcattatrtgtaaattttacttaaaggactataaacaagcacatgaataaaggagaaatagtagaataaatttttaaaaaatgaatattacatatccatgtggtagcc

SEQ ID NO: 66866 - DNA, 201 bp, Homo sapiens
tgcattcgaaatctgatgactaatctatttttcacttatgaaggactaagtgattctcattaaaatttttaaggggttggtatagtcattaatttatcattattattattattatttttgagatggagtcttgctctgtcgcccaggctggggtgcagtgatgcaatctcggcttactgcagcctctgcctcccaggttca

SEQ ID NO: 66867 - DNA, 201 bp, Homo sapiens
tctgcagaaagggtgccactcactagcagtcttgccatgagagcacatacaaacaaaggagacagggtcatttataatctaatgcgtccatgctatggctktgtccagtttccattggctggaacgggacttcacattctgttcttgtcctgattggctagcaacttagaacctcccaaaagaggtaaaggtaggggagaa

SEQ ID NO: 66868 - DNA, 201 bp, Homo sapiens
cccaggcccccaccccctgacaggccccagtgtgtgatgtgtctttatagtagcataatttataatcctttgggtatgtacccaataatgggattgctggrtcaaatggtatttctagttctagatccttgagggattgccacactgtcttccacagtggttgaactaatttacactcccaccaacagtgtaaagcattcc

SEQ ID NO: 66869 - DNA, 201 bp, Homo sapiens
tctccagctgtatctgtgttgctgcaaaggacaagatttcattcatttttatggctgtatagtattccgtggtgtatatgtaccatattttctttatccarttcaccattgatgggaacccaggttgattccatgtttttgctattgtgaatagtgctgtgatgaacatatgagtgtgtgtgtcaatttaatagaatgatt

SEQ ID NO: 66870 - DNA, 201 bp, Homo sapiens
agatatatatatttatttattaaatgctgtggcccatgataatttttaattacagttataaggacagtattttaatattcagaattttaaaaactcaataraaatatcatccaggttttaagttacttgtgtgattgacttgtaactttatatcatgaggtattttttgctatatccctatgaaatccaagatttgtattt

SEQ ID NO: 66871 - DNA, 201 bp, Homo sapiens
tgggagtgacacagagccagaggagcctcctcttcccagggaagtggtgagtgagtgagtgaccccagcgacccacgcttctcccttggatctttgcaacycacaggtcaggagatccccttgtgagcccactccaccagggtctgcagcctgttacacagaattatgtggagtctcagcaatgcagccgctcagatacac

SEQ ID NO: 66872 - DNA, 201 bp, Homo sapiens
cacaggtcaggagatccccttgtgagcccactccaccagggtctgcagcctgttacacagaattatgtggagtctcagcaatgcagccgctcagatacacrtagagccctgggagctttagatacccaggtttcccatcaaaagcaactgcaactccagccaagcaggacgttagacccctgtacatacccctaggaaaga

SEQ ID NO: 66873 - DNA, 201 bp, Homo sapiens
tgtggagtctcagcaatgcagccgctcagatacacgtagagccctgggagctttagatacccaggtttcccatcaaaagcaactgcaactccagccaagcrggacgttagacccctgtacatacccctaggaaagaggctgtatacaggggatagagcagtgacagtctgcaggccccactaccatggcaccttgcaggat

SEQ ID NO: 66874 - DNA, 201 bp, Homo sapiens
taaaaatcatgttcattaagtggtaggctatgttttgagacagagttcttgatctgcattacttaggaaagaattacttcaggcagaggtatacttattayttacttaggttttataactttatttaaattgttagtggctgtgattctaaaagcatgaatctgtaatagattttaagaaccaatcttgtctgtccttttg

SEQ ID NO: 66875 - DNA, 201 bp, Homo sapiens
ggccactttttcaggctgttgtttatgtatatcaaaatcctacctgtcaggtttttatccatgtagcgttccccagtacccctggacagacttgatttctyatcctctctatgcccctagtttgtagattttcctatcacaatagcagtaatttgttttacatttttgttatacgtgaacacaacctagtttcttgaagtc

SEQ ID NO: 66876 - DNA, 201 bp, Homo sapiens
cctactatgtgggacactgccctaggagcttacaagtttacatcaattaaaatagaaaaacatcatgtgtaacttagaaatacaattaaaaagtatataastatgtataattttaggactggaagggatcttagcattcaaatagcttttacaagttagcaacctaaagtaggaggtacccaagattacttaactagtaag

SEQ ID NO: 66877 - DNA, 201 bp, Homo sapiens
ctccccatacctttcctctcctgtgtcttcgtatcagagagtgactcagacatctcctctacaagtacctaacccatcctggatgcaccaccattcatacytcatgcagccttcaggttcagttctgacaccagggatggaccatcccatttctctccagcctgcctccatgatgggaccccttacccagcaactgggcca

SEQ ID NO: 66878 - DNA, 201 bp, Homo sapiens
agagaatgtttgtgttaactgcagtaaaatatcagttaaactcagttttaagtatcaatttctctttaacttttcagattacggcataaatctcatagaartaaaattaaatcaggatttatttaaaaaacaattttcaggatatgctgttgcatcagtagataatctttattgtgtattagcagccatattatgggtagc

SEQ ID NO: 66879 - DNA, 201 bp, Homo sapiens
aggggtcctgtggggcagcaaaatgtttgaatttgtatagggagctggctaatacggggctgtgagtttagctgggaaatttagatttgagtcaggaaagmataaggattatcataggagttatagtgacgaaggcaatgtatgagaaagattgttttggtgatatttgtaggctatgtaagaatgagaaaatactaaagt

SEQ ID NO: 66880 - DNA, 201 bp, Homo sapiens
tggctttgcaaggatggagtccacagagaagtgtgaagccatcatcacccactttaatggaaaatatattaagacaccccctggagtaccagccccatccratcccttgctttgcaaatttgctgatggcgggccaaagaaacgacagaaccaaggaatatttgtgcaaaatggacgggcttggccaaggaatggagacat

SEQ ID NO: 66881 - DNA, 201 bp, Homo sapiens
agatcaagatttaagtaccatctctttggaatctgtatccagagcttcttaggtaatacatattgtcaattatatttccatttcttgcttatttatgctgkgctcttgtgtgtctttctgtgagtatgtgtactttaacagatactgaccccctgtaaaatgcccagttttgccagttttgacatttattaaagttttgtt

SEQ ID NO: 66882 - DNA, 201 bp, Homo sapiens
ttttatatgtatgtatccagttttcccaacactgtttgttgacaacattgccctttcttcattgaatgaccttggtactcttgtcaaaaatcatttgaccstatatgggagggtttatttactcattctgtattctattccagttgcttatatgttggtctttatgtcagtgtcacactattttgattattataactttgc

SEQ ID NO: 66883 - DNA, 201 bp, Homo sapiens
tctcagcaggtttctttgtagaaattagaaagtagattctaaaattcatctgaaagtacaaaggactagaatacccaaagcaatcttgaagaacaataaarctagaggacttaaaactaccaggtatcaacactaaatataagctacagtaattcagtgtggtattggcataaggataaacaggcaaatggaacagtatag

SEQ ID NO: 66884 - DNA, 201 bp, Homo sapiens
gcacaagtttggcttcgggaagtgctctggagcttcttctccatccagccactgaggtggtcattgccggtagtcgtatgaaatccactttttgtcgcatrtcacaatctgcttgagaaatagtttgttgttgcatagaataagagaagactacacttcaaaatgacgatattttaaattttcactcagttcatgagacac

SEQ ID NO: 66885 - DNA, 201 bp, Homo sapiens
gataaaatgttttaaaatgtttaaacttctatactttaataagcttctttggctaactgctattattcttaagatatatatatttatttattaaatgctgwggcccatgataatttttaattacagttataaggacagtattttaatattcagaattttaaaaactcaatagaaatatcatccaggttttaagttacttgt

SEQ ID NO: 66886 - DNA, 201 bp, Homo sapiens
tcatctgcaaacagggacaatttgacttcctcatttcctaattgaataccctttatttctttctcttgtctggttgccctggccagaacgtccaacactgytgaatatgagtggtgagaaagggcatccttgtcttgtgctggtttttaaaggaaatgcttccagtttttgcccattcagtatgatattggctgtgggttt

SEQ ID NO: 66887 - DNA, 201 bp, Homo sapiens
ccctggccagaacgtccaacactgttgaatatgagtggtgagaaagggcatccttgtcttgtgctggtttttaaaggaaatgcttccagtttttgcccatkcagtatgatattggctgtgggtttgtcataaatagcttttattattttgagatacgttccatcaatacctagtttattgagagcttttagcatgaagttc

SEQ ID NO: 66888 - DNA, 201 bp, Homo sapiens
acaaaaagccagctaatacaaactttgtttaagatctggagtctcataacttaattccccaaatgtccaagtttccattgaaaattgcttgtcacaccacraactaggaaggtctgaaactgaatgtaaaacacactaatagatgccaacactgagatgcagaggtgttagaattatttgacaaacatttcaaagcagcca

SEQ ID NO: 66889 - DNA, 201 bp, Homo sapiens
gcctcccaggttcaagtgattctcttgcctcagcctcctgagcagctggattacaggtgtgtgccaccatgcctggctaatttattgattaattgattgaytgttatttttagtagagacggggtttcactgtgttggccaggctggtctccaactcttgacctcaagtgatccacctgccttggcctcccaaagtactga

SEQ ID NO: 66890 - DNA, 201 bp, Homo sapiens
  misc_feature (1)...(201): n = A,T,C or G, or insertion/deletion polymorphism (see Tables 1-2)
ggggatagatagttggggagatcaggaaagggaaagaatgagttctagaccctgattgcttgcccctggtctccagaggtgaggagcttctgaaatgcctnagaggttaggaaacagtttgaaacccactgatttggaggcccacgaagtccagcagtgataattggcatgaatgacaagaccactggtgtctctgctctg

SEQ ID NO: 66891 - DNA, 201 bp, Homo sapiens
cctgtaacactcactgccaaggtgtgtagcttcactcctcaagtcagcgagaccaccaacccaccgggaggagctaacagctgtgctacgcgccacctgtragagctgtaacactcgctgcgaaggtcggcggcctcacggggaggaagaaacagctcccgacgcgccacctgtaagagcttaacgctcactgtgaaggtc

SEQ ID NO: 66892 - DNA, 201 bp, Homo sapiens
aaacgcaccaatcagcactctttaaaaacggaccaatcagcactctgtaaaatggaccaatcagcactctgtaaagtggaccaatcagcaggatgtgggcrgggccaaataagggcataaaagctggccaccgaaaccagcaagcgccaaccgtggcgggttctgttccaagctgtgggggctttgttcttttgctcttcg

SEQ ID NO: 66893 - DNA, 201 bp, Homo sapiens
agcaaggcagggcccttctttagaagcctgcaattccaggaaaggaggcctgcaagaatctcaggaacacagtgatgagtgctctcaggcaggccagagasgacccgtttcagccacagcataagacagaaacaccatcttcagataacacccactcaggcaggcagtgaccccacctccctccaaacgggacaggaacat

SEQ ID NO: 66894 - DNA, 201 bp, Homo sapiens
ggtgcctgctggggcggggcccacagggctcctggcggggcagaggtggggggtgccagccacgcccctgccctgctccccgcaaaagcacctgtgtgctyggggcagggggcggctgccgcaagggtgggacccgcgggttccgaggctttcctggtggtggagacgcgccgaggccgtttccactccaagccccttttc

SEQ ID NO: 66895 - DNA, 201 bp, Homo sapiens
ggagggagcccctccacctgcgtcctccaggaactgagtcctggaccccctgccggtccaggcctgaccgccgggctctcctgcagtttacctgtacggcraggcagccaggatggacagtcgccggaccctgccggccatccgggccggggagtacgaggccctccctaagaaggtgcccccaccccgggcggtcgggcc

SEQ ID NO: 66896 - DNA, 201 bp, Homo sapiens
cactctagcctgggcaacagaacgacaccctgtctctaatgtaaacatatgtatataaaacataggaacaattttatgtttagaaatttaaaataaggtgmataattaaaaaacaagtaggaaaagtacatagatgaaaatgtaatcaagggacaggaaggaaacaagacgtgtggtttagagaaccatgagcggggacag

SEQ ID NO: 66897 - DNA, 201 bp, Homo sapiens
gtcagcgtggatgagtgtgtgctctgcgcccaggcctttggccagaggctggcagaggagctggacgtgccaggtgagcgtgcccccccgcccccctcacyctgctcccgtctcattggtgtgggttattggctccttctgtatcccccagttccctgcccttgactgctcttgcaagggcagagtgttccaaaaagccaa

SEQ ID NO: 66898 - DNA, 201 bp, Homo sapiens
cacctggcctcctgcccggcctcgccgtctctctgcaggagagcacccccgcatgggggccctagacgtctgccccttcatccccgtgaggggcgtcagcrtggatgagtgtgtgctctgcgcccaggcctttggccagaggctggcagaggagctggacgtgccaggtgagcgtgcccccccgcccccctcactctgctc

SEQ ID NO: 66899 - DNA, 201 bp, Homo sapiens
ggctgatggggcagcttgagtggctaaggcccaggccatggaggaggtggtgggcttggtgtcccgggtcgtcttcccaggatgggcagagccgctgcccrtgggccccaaggacatcccgtggctcagggccctggggagtgcctgacccaggggtgggtggaacacgactggtgcttgtgggggctgaggcttggctgt

SEQ ID NO: 66900 - DNA, 201 bp, Homo sapiens
catattccccactgagaaccccttggccagggctctggccacagtccgtgtgagtagggctcccagtgggtccttggaaggttggtgtgtggtcccagctrtgctcttccacacggggtgggtccgaggagccgagtgccttacggtgacgccgtgagctacacacatgagcacctaggaaaggccagtgcctgtgaccgg

SEQ ID NO: 66901 - DNA, 201 bp, Homo sapiens
ggcctgtgtcccaggtgatcgacgccatctctggagccatcacacagaccccgggctgcgtgctgctggatgtggacgcaggcccttccaccaaccgcacygtgtacaccttcgtggggccgccggagtgcgtggtggagggggccctcaacgctgcccgggtagcttcccgacttatcgacatgagcaggcaccaaggtg

SEQ ID NO: 66902 - DNA, 201 bp, Homo sapiens
ggaggtgaggcccgaagagctggtcaagcatctagggctgatggggcagcttgagtggctaaggcccaggccatggaggaggtggtgggcttggtgtcccrggtcgtcttcccaggatgggcagagccgctgcccgtgggccccaaggacatcccgtggctcagggccctggggagtgcctgacccaggggtgggtggaac

SEQ ID NO: 66903 - DNA, 201 bp, Homo sapiens
atacatatgagccaggcacggtggtgcctgtggtcccagctacttgggaggctgaggcaggagaattgcttgagcacaggaggtcaaggctgcagtgagcygtgatcacaccactgcgctccagccttggtgacagagcaagaccctgggtcaaaaacaacaaaacacgagaaagcacacaaggcagctcttggaagtaga

SEQ ID NO: 66904 - DNA, 201 bp, Homo sapiens
tttgtaaacacaccagtcagcactgtgtctagctactggggtgggaacttggagaacttctctgtctagctaaagtattgtaaaaacgcaccagtcagtgstctgtgtctagctaaaggtttgtaaacgcaccaatcagcactctttaaaaacggaccaatcagcactctgtaaaatggaccaatcagcactctgtaaagt

SEQ ID NO: 66905 - DNA, 201 bp, Homo sapiens
gccttgctggttaatgagaagccggtggggaggtgctgccggtgagcgtataaaggccctggcggcggctgcggagcactggccctgtccttccatctgcycagagaggagcatctggatcaaggtgctggccatgtcccagctggtggaatgcgtccccaacttttcggaggggaagaaccaggaggtgaggcccgaaga

SEQ ID NO: 66906 - DNA, 201 bp, Homo sapiens
tcccgggcggccgctgtgtgcgggcactttcggtgggagctcagcttgtcggagagcccccaaaggcttggcccgcctcctcagcccccatttgtgtctcrgggtgcagccacctccaagctccttttccttctttcaaacggggagactgaggtgtgggggccgggcctgtgtcccaggtgatcgacgccatctctggag

SEQ ID NO: 66907 - DNA, 201 bp, Homo sapiens
acccttggccaagatctgcccagggagaccatggacaccgcaaggcctgggtgtgagagagtgttcgtagcgcgagtcgcagcttgaggatggctgtcctkcctccgcctgcaactgctacagacccttgtgcagaggacagcctgggagaggggctgcagccaggaggcctggtctggatgatgccccagccagtcaggg

SEQ ID NO: 66908 - DNA, 201 bp, Homo sapiens
ggcagggccaaaggtgtgtggacacacgggcgctggccaggggctgggctgtgggccgctcatgagaggccagggatccacagtgatcctgaggggtggayggatgagaagcttatctctaagtggccagccctgggcggtggcggcaaaggcgggggaggctggcgtcccctggggtgggcgccgacccacggcttggtg

SEQ ID NO: 66909 - DNA, 201 bp, Homo sapiens
gtgctgggtgtttgggaatgacttcccatcgcccgcttctgcagcctgctcagccctgttggggtgcagtgtgtccactgcctgcctgtgtgtgccgctgygctcaggctctcctcttgctcctttcaggcgcacggcggccctacaggagggtctgaggcgggcagtctctgtgccgctgacgctggcggagacggtggc

SEQ ID NO: 66910 - DNA, 201 bp, Homo sapiens
gccccaggggtccaggctcctccaggaacaaacgcaggccccacgggctgcctggaaggcctcccagaaggcagcacagggtcacgagggtcacccgcagkggcacagggaggcctcgtcacgacaggattccagccaggctggcctgatgctcctgggggtcctcggcacatgccccttcaccctggcatgtgcttcttt

SEQ ID NO: 66911 - DNA, 201 bp, Homo sapiens
ctgcctctcgggccttgcggggcgctggggtccctgcgtggagacccggctgagtcctcccagcgcctccctttgggcgcctactcggcctgcgccaagcmggggtctgggggctgaggggggcacagagaccccggccgggtccccgcaggttctcagccgagtggtcacctccccgtgggtgcagacgggcgtggggcc

SEQ ID NO: 66912 - DNA, 201 bp, Homo sapiens
gcctcaggttccccaagggcaactcagggtgatggctgtttccagaagcctgtacggggtgcctgctggggcggggcccacagggctcctggcggggcagmggtggggggtgccagccacgcccctgccctgctccccgcaaaagcacctgtgtgctcggggcagggggcggctgccgcaagggtgggacccgcgggttcc

SEQ ID NO: 66913 - DNA, 201 bp, Homo sapiens
aagagcttaacgctcactgtgaaggtcggcggcctcacggggaggaagaaacagctcccgacgcgccacctgtaagagcttatggctcactgtgaaggtckgcggcctcaccgggaggaagaaacagctcccgacgcgccacctgtaagagctcactgagaaggtctccggcttcactcctgaagtcaggcaagaccacga

SEQ ID NO: 66914 - DNA, 201 bp, Homo sapiens
atcctttctgtctaagcagcagctgtcgcttctccacatttccttgtcttcttatgtgtgaggccccgtctgctttccagtgtggcgttttgtcttcttcttttttttttttttttttgagatggagtctcactttgtcacccaggccggagtgcagtggtgtgatctcggctcactgcaacctccacctcccggattgaa

SEQ ID NO: 66915 - DNA, 201 bp, Homo sapiens
tcctttctgtctaagcagcagctgtcgcttctccacatttccttgtcttcttatgtgtgaggccccgtctgctttccagtgtggcgttttgtcttcttcttttttttttttttttttgagatggagtctcactttgtcacccaggccggagtgcagtggtgtgatctcggctcactgcaacctccacctcccggattgaag

SEQ ID NO: 66916 - DNA, 201 bp, Homo sapiens
tcctgccactgactgaaagggctgtgtgaggtcacacgaggtggcccagcatggtccccactgccgcctctccatctccactggagttagcttgctgagcycccaccctgcagccaccatcctcactggacccaaaacgaagtaggcacagagggggcagcaggcccccaggtccggcctctcgccttccacagccctgag

SEQ ID NO: 66917 - DNA, 201 bp, Homo sapiens
gcttctccacatttccttgtcttcttatgtgtgaggccccgtctgctttccagtgtggcgttttgtcttcttcttttttttttttttttttgagatggagyctcactttgtcacccaggccggagtgcagtggtgtgatctcggctcactgcaacctccacctcccggattgaagcagttctctgcctcagcctctcgagt

SEQ ID NO: 66918 - DNA, 201 bp, Homo sapiens
ctttcggtggggggttgggcagatctctgggcctcaaagggccttggtgctcccccctgaaaatggggctcctgccactgactgaaagggctgtgtgaggycacacgaggtggcccagcatggtccccactgccgcctctccatctccactggagttagcttgctgagctcccaccctgcagccaccatcctcactggacc

SEQ ID NO: 66919 - DNA, 201 bp, Homo sapiens
tctagctactggggtgggaacttggagaacttctctgtctagctaaagtattgtaaaaacgcaccagtcagtgctctgtgtctagctaaaggtttgtaaaygcaccaatcagcactctttaaaaacggaccaatcagcactctgtaaaatggaccaatcagcactctgtaaagtggaccaatcagcaggatgtgggcgggg

SEQ ID NO: 66920 - DNA, 201 bp, Homo sapiens
ttgagtggctaaggcccaggccatggaggaggtggtgggcttggtgtcccgggtcgtcttcccaggatgggcagagccgctgcccgtgggccccaaggacrtcccgtggctcagggccctggggagtgcctgacccaggggtgggtggaacacgactggtgcttgtgggggctgaggcttggctgtggcttcaggggcctt

SEQ ID NO: 66921 - DNA, 201 bp, Homo sapiens
tagcattttggaaaaccaaggtgggcaaatcccttgagctcaggtgtttgaaaccagcctagaccacacaccaagaccctgtatttacccacccaaaaagaaaaaaaaaaaataaagccaggcgtggtagcaggtacctgtggtcccagctactcaggaggcttaagtgggggtagcttgaggccaggagtttgaggctgc

SEQ ID NO: 66922 - DNA, 201 bp, Homo sapiens
gcccagagaggagcatctggatcaaggtgctggccatgtcccagctggtggaatgcgtccccaacttttcggaggggaagaaccaggaggtgaggcccgargagctggtcaagcatctagggctgatggggcagcttgagtggctaaggcccaggccatggaggaggtggtgggcttggtgtcccgggtcgtcttcccagg

SEQ ID NO: 66923 - DNA, 201 bp, Homo sapiens
gcgctccagccttggtgacagagcaagaccctgggtcaaaaacaacaaaacacgagaaagcacacaaggcagctcttggaagtagatgcctcacactgacrggccacagctgggcagagggtcccagagaaggagcgtctctctcatgggctcagcactttctgcagctgccctaagacctcatggtcttcgggttcttta

SEQ ID NO: 66924 - DNA, 201 bp, Homo sapiens
cctcgtcacgacaggattccagccaggctggcctgatgctcctgggggtcctcggcacatgccccttcaccctggcatgtgcttcttttccgggaacccayactctggctgagtggagccatcccctctgggtcaacagcacccggggtggctctgcagcaccccactccgcggctgcacagggaccttggccccactgct

SEQ ID NO: 66925 - DNA, 201 bp, Homo sapiens
acgggctgcctggaaggcctcccagaaggcagcacagggtcacgagggtcacccgcagtggcacagggaggcctcgtcacgacaggattccagccaggctsgcctgatgctcctgggggtcctcggcacatgccccttcaccctggcatgtgcttcttttccgggaacccacactctggctgagtggagccatcccctctg

SEQ ID NO: 66926 - DNA, 201 bp, Homo sapiens
ccatcgtgtttccagcctcctgcaggaagccaagacccaggctgcactggtgctggactgcttggagacccggcaggagtgacggtgcgggaggcctctcygggctctgtggcccctccctcgcccatccccagagggcagagctgtgacctcggtggggacacagcttgttcgtgtggggcccggagggtaggtgggcag

SEQ ID NO: 66927 - DNA, 201 bp, Homo sapiens
agacgaggcatttaaggaccaggtgagcaggaggcaggtgtggtgcccggaccccacgtgggggcctggattcacagcctcagggtgattgccgactggcygtgggcagtgggggtcggaggttgctgcccagcaagctgggctgaagactggaactaccagacccctctttccctgtgtccatcagatccaccatcgtgt

SEQ ID NO: 66928 - DNA, 201 bp, Homo sapiens
tttggcgcatatttcaacgtgctcatcaacctgagggacatcacagacgaggcatttaaggaccaggtgagcaggaggcaggtgtggtgcccggaccccaygtgggggcctggattcacagcctcagggtgattgccgactggccgtgggcagtgggggtcggaggttgctgcccagcaagctgggctgaagactggaact

SEQ ID NO: 66929 - DNA, 201 bp, Homo sapiens
cgtcaggcagagaccctccttccggcagtttgctcagccttgatccatgtaggggctccctggggtccttgcaggtggcggccaaagccctggagatgggygtgtttggcgcatatttcaacgtgctcatcaacctgagggacatcacagacgaggcatttaaggaccaggtgagcaggaggcaggtgtggtgcccggacc

SEQ ID NO: 66930 - DNA, 201 bp, Homo sapiens
atcagcactctgtaaaatggaccaatcagcactctgtaaagtggaccaatcagcaggatgtgggcggggccaaataagggcataaaagctggccaccgaarccagcaagcgccaaccgtggcgggttctgttccaagctgtgggggctttgttcttttgctcttcgaactaaatcttgctgctgcttactctttgggcctt

SEQ ID NO: 66931 - DNA, 201 bp, Homo sapiens
ggttcctagagtggcggagagcctccagtgtgactgctcccaggcctcctgtggggctgagccctgcttggataagagaaagttttgttttctaagctcartggtggggcttagccctctgtggggcgaaagcgggggctgcgctgggctccttgtgaggaggaggacgaagtccggcctgtcccagagcccgtcaggcag

SEQ ID NO: 66932 - DNA, 201 bp, Homo sapiens
gctcactgtgaaggtcggcggcctcacggggaggaagaaacagctcccgacgcgccacctgtaagagcttatggctcactgtgaaggtctgcggcctcacsgggaggaagaaacagctcccgacgcgccacctgtaagagctcactgagaaggtctccggcttcactcctgaagtcaggcaagaccacgaacccgccagaa

SEQ ID NO: 66933 - DNA, 201 bp, Homo sapiens
tgaagctgcctccgggggccctccaggggatgactgtctctagaactgtggtcctggttcctagagtggcggagagcctccagtgtgactgctcccaggcytcctgtggggctgagccctgcttggataagagaaagttttgttttctaagctcagtggtggggcttagccctctgtggggcgaaagcgggggctgcgctg

SEQ ID NO: 66934 - DNA, 201 bp, Homo sapiens
gccgctgctgctgtgaggggcgagccgatctgtcccgtgggcagggcgggggccccacatcctccagccagggccattctccagccagcccccagggggtracgctgcctgtgccttggcaggagctgagcctcccagtggtgggctcacagctggtgggcctggtgcccctgaaggctctgctggatgcggccgccttct

SEQ ID NO: 66935 - DNA, 201 bp, Homo sapiens
gtcccagagcccgtcaggcagagaccctccttccggcagtttgctcagccttgatccatgtaggggctccctggggtccttgcaggtggcggccaaagccytggagatgggcgtgtttggcgcatatttcaacgtgctcatcaacctgagggacatcacagacgaggcatttaaggaccaggtgagcaggaggcaggtgtg

SEQ ID NO: 66936 - DNA, 201 bp, Homo sapiens
acggcggccctacaggagggtctgaggcgggcagtctctgtgccgctgacgctggcggagacggtggcctcgctgtggccggcgctgcaggaactggcccrgtgtgggaacctggcctgccggtcagacctccaggtaggggggcccgggggaccccaggcctcctgccgcaaagcaggaagcagctgttggggctgagtt

SEQ ID NO: 66937 - DNA, 201 bp, Homo sapiens
ttgctcctttcaggcgcacggcggccctacaggagggtctgaggcgggcagtctctgtgccgctgacgctggcggagacggtggcctcgctgtggccggcsctgcaggaactggcccggtgtgggaacctggcctgccggtcagacctccaggtaggggggcccgggggaccccaggcctcctgccgcaaagcaggaagca

SEQ ID NO: 66938 - DNA, 201 bp, Homo sapiens
aggcccccaggtccggcctctcgccttccacagccctgaggtccaggctcctccgggaacaaacgcaggccctaagggccacctggaaggcctcccagagsgcagcaccaggccacaggggtcacccgcaggggtgcagggaggcctcgtcatgccgggattccagccagcaccaaggccctgggacagggcaagatttgg

SEQ ID NO: 66939 - DNA, 201 bp, Homo sapiens
ggaggcctctccgggctctgtggcccctccctcgcccatccccagagggcagagctgtgacctcggtggggacacagcttgttcgtgtggggcccggaggrtaggtgggcaggcagcggggcatcgcctgggaatggaggcgctggcagggacagaaggcccctagtcccatgtgacctccagtaaagttttggcaccaaa

SEQ ID NO: 66940 - DNA, 201 bp, Homo sapiens
gagtcctggaccccctgccggtccaggcctgaccgccgggctctcctgcagtttacctgtacggcgaggcagccaggatggacagtcgccggaccctgccrgccatccgggccggggagtacgaggccctccctaagaaggtgcccccaccccgggcggtcgggcctgggaaggaggtggacctgcccctttgtcctggct

SEQ ID NO: 66941 - DNA, 201 bp, Homo sapiens
acgtaacccccgtcacggtcatgccagtccccccgaaggaaatcccgacgcagggcccacgtcacagtcacactggtgtgcgggttcacgagtttttcctyttctctgccgttatatttatgtggttgcttgcggttctgtttatcatacaaagaaaacagaagcatgaacgtcctgccgttagcatgtcccacatgttcc

SEQ ID NO: 66942 - DNA, 201 bp, Homo sapiens
tgtgtgccgctgtgctcaggctctcctcttgctcctttcaggcgcacggcggccctacaggagggtctgaggcgggcagtctctgtgccgctgacgctggyggagacggtggcctcgctgtggccggcgctgcaggaactggcccggtgtgggaacctggcctgccggtcagacctccaggtaggggggcccgggggaccc

SEQ ID NO: 66943 - DNA, 201 bp, Homo sapiens
caatgcaaaggtcgacttttgaaaaacataaggagatatctgtaccttgcaccaaatacataagtaatttccagatggaatagaaaactgtatttccccaycaccaacacaaccaagcctcacgataaatcacagaaaacaaaacggaccgggcgggcaggcctcggccggacgcagatgaggccacctaaagcacaccct

SEQ ID NO: 66944 - DNA, 201 bp, Homo sapiens
tctgcagcctgctcagccctgttggggtgcagtgtgtccactgcctgcctgtgtgtgccgctgtgctcaggctctcctcttgctcctttcaggcgcacggyggccctacaggagggtctgaggcgggcagtctctgtgccgctgacgctggcggagacggtggcctcgctgtggccggcgctgcaggaactggcccggtgt

SEQ ID NO: 66945 - DNA, 201 bp, Homo sapiens
gcgtgctgggtgtttgggaatgacttcccatcgcccgcttctgcagcctgctcagccctgttggggtgcagtgtgtccactgcctgcctgtgtgtgccgcygtgctcaggctctcctcttgctcctttcaggcgcacggcggccctacaggagggtctgaggcgggcagtctctgtgccgctgacgctggcggagacggtg

SEQ ID NO: 66946 - DNA, 201 bp, Homo sapiens
atcttctggactttgaggtcacggcactgcacacggtctacgaggagacctgccgagaagcacaggtgagcccgggagcagccgctgctgctgtgaggggygagccgatctgtcccgtgggcagggcgggggccccacatcctccagccagggccattctccagccagcccccagggggtgacgctgcctgtgccttggca

SEQ ID NO: 66947 - DNA, 201 bp, Homo sapiens
tcaccttcttggatccccggccacgtctctggcatctgtctgtcggagcagagcccgtgagtctctcctggaggcaccacctgcagccccttgtggggacygtgcttgggcctggagtgactgtggctgctgtgagggttcccgggcggccgctgtgtgcgggcactttcggtgggagctcagcttgtcggagagccccca

SEQ ID NO: 66948 - DNA, 201 bp, Homo sapiens
ggaaggcctcccagaaggcagcacagggtcacgagggtcacccgcagtggcacagggaggcctcgtcacgacaggattccagccaggctggcctgatgctmctgggggtcctcggcacatgccccttcaccctggcatgtgcttcttttccgggaacccacactctggctgagtggagccatcccctctgggtcaacagca

SEQ ID NO: 66949 - DNA, 201 bp, Homo sapiens
acataggaacaattttatgtttagaaatttaaaataaggtgaataattaaaaaacaagtaggaaaagtacatagatgaaaatgtaatcaagggacaggaargaaacaagacgtgtggtttagagaaccatgagcggggacagtgagactgtgctaggcatcagtggtcgaaatcagtggattggtttacgctccctgtgag

SEQ ID NO: 66950 - DNA, 201 bp, Homo sapiens
caggagtgacggtgcgggaggcctctccgggctctgtggcccctccctcgcccatccccagagggcagagctgtgacctcggtggggacacagcttgttcrtgtggggcccggagggtaggtgggcaggcagcggggcatcgcctgggaatggaggcgctggcagggacagaaggcccctagtcccatgtgacctccagta

SEQ ID NO: 66951 - DNA, 201 bp, Homo sapiens
tgtggacgcaggcccttccaccaaccgcaccgtgtacaccttcgtggggccgccggagtgcgtggtggagggggccctcaacgctgcccgggtagcttccygacttatcgacatgagcaggcaccaaggtgaggtctctgggctctcctgtggctgccgtgtctcagaatgtcagggccgagccctgtcctggtgtcctgg

SEQ ID NO: 66952 - DNA, 201 bp, Homo sapiens
gagggggtaggcccggggcccaggcttggaacgtggggtccagtggggctggctctggctctcctaggaggaccctggagtgtgggggtcatggcccccakcctgcctgcagggctgtgctctgggggacccccaggtcgccacgctcccacagcaccgggccaccttcacggctgggtggggggagggggccacgccggg

SEQ ID NO: 66953 - DNA, 201 bp, Homo sapiens
tggggctggctctggctctcctaggaggaccctggagtgtgggggtcatggcccccagcctgcctgcagggctgtgctctgggggacccccaggtcgccaygctcccacagcaccgggccaccttcacggctgggtggggggagggggccacgccggggaaggtttgtgggccccgtccacctgcccactcgtcaaggggg

SEQ ID NO: 66954 - DNA, 201 bp, Homo sapiens
gggccctgagggaactacctgcttctcacatccccgggtctctgaccatctgctgtgtgccccgaccccccctaccctgctcctccaccaagcctgatgcyaagggctataaaccactggcccaacagaagcttggttcccagagaactggtccctgcctgggacatgctccttgctacagccccttgtgggagctcagag

SEQ ID NO: 66955 - DNA, 201 bp, Homo sapiens
ccacgccggggaaggtttgtgggccccgtccacctgcccactcgtcaagggggctgagagccagtcttggagcaggcactggtgggggaagggctgcctgraagctgacctgtcaacagcccacaagccaaacacctcggtgggcaggcagggccaaaggtgtgtggacacacgggcgctggccaggggctgggctgtggg

SEQ ID NO: 66956 - DNA, 201 bp, Homo sapiens
agtgatcctgaggggtggacggatgagaagcttatctctaagtggccagccctgggcggtggcggcaaaggcgggggaggctggcgtcccctggggtgggygccgacccacggcttggtgtagccacagcgagggactcagctagtgagaagaatgctctggaaacgcagagtggattctcggcttcaggggagggggttg

SEQ ID NO: 66957 - DNA, 201 bp, Homo sapiens
ctggggccccacccctcagcattcccccaacatctaggacacagcgtggctggaaggcagggcctaggctgggcgggggcctgccggggtgggcctccggygtctgacccttggggcctccgtttccctgtggcaagcgaagtttctctggccctccccggccagctcagtgagggacggaggagaaccacagcacccacc

SEQ ID NO: 66958 - DNA, 201 bp, Homo sapiens
ctgggtgtttgggaatgacttcccatcgcccgcttctgcagcctgctcagccctgttggggtgcagtgtgtccactgcctgcctgtgtgtgccgctgtgcycaggctctcctcttgctcctttcaggcgcacggcggccctacaggagggtctgaggcgggcagtctctgtgccgctgacgctggcggagacggtggcctc

SEQ ID NO: 66959 - DNA, 201 bp, Homo sapiens
tgtctgacccttggggcctccgtttccctgtggcaagcgaagtttctctggccctccccggccagctcagtgagggacggaggagaaccacagcacccacscaggcacaggctcctccccgtccagctggggaatgcaagtgccaggagagactggcagggccaggcaggatgagcttcctagtccaggctggggaacgct

SEQ ID NO: 66960 - DNA, 201 bp, Homo sapiens
aggcctttaaaatgcccggcatcttcctggggttttctgcggaaggaggctttgccttgtggcttgctggttctatgccacggggaggcactctccacccygcccggctgctgtccgtctctgtggggtggggtgggggtcgcatagccaacgtgttctgaatgggtttcccagaatgaattctaatcttaaatgggactg

SEQ ID NO: 66961 - DNA, 201 bp, Homo sapiens
tgtgtggactgggggctgcccaggccggagaggacagagggtccgagaaccccgtggagctcccacccgctcccacacctggcctcctgcccggcctcgcygtctctctgcaggagagcacccccgcatgggggccctagacgtctgccccttcatccccgtgaggggcgtcagcgtggatgagtgtgtgctctgcgccca

SEQ ID NO: 66962 - DNA, 201 bp, Homo sapiens
ggggcagtggtgctggggggcggcgaagcatgagcagcagtttgctgaggggtccccagggggcaactcctttctctgggcctcaggttccccaagggcamctcagggtgatggctgtttccagaagcctgtacggggtgcctgctggggcggggcccacagggctcctggcggggcagaggtggggggtgccagccacgc

SEQ ID NO: 66963 - DNA, 201 bp, Homo sapiens
agtttgaggctgcagtgagtcgtgattgcaccactgcactctagcctgggcaacagaacgacaccctgtctctaatgtaaacatatgtatataaaacatargaacaattttatgtttagaaatttaaaataaggtgaataattaaaaaacaagtaggaaaagtacatagatgaaaatgtaatcaagggacaggaaggaaac

SEQ ID NO: 66964 - DNA, 201 bp, Homo sapiens
gctggggggcggcgaagcatgagcagcagtttgctgaggggtccccagggggcaactcctttctctgggcctcaggttccccaagggcaactcagggtgayggctgtttccagaagcctgtacggggtgcctgctggggcggggcccacagggctcctggcggggcagaggtggggggtgccagccacgcccctgccctgc

SEQ ID NO: 66965 - DNA, 201 bp, Homo sapiens
acccaccttgcccacccctgtggtccagctccaccccctgcttcctgacccttctgctccaacgcccacccctaccagccctcttctaaacacatcctacrcccactcccagaatctgtctcaggaagggtaaggttctcagacactgccgacatcagcattgtctcgtgtacagctcccttccctgcagggcgcccctgg

SEQ ID NO: 66966 - DNA, 201 bp, Homo sapiens
ggtgcccgttcctgggcagctggtctcaggaaggaagtcccagaactgttagcccatctcttggcctcagataatggagtatttcaggacttggagtccaragaaaagctccagtggctttatgtgtgggggtagatagggaaagaatagaggttaatttctcccataccgccttttaatcctgacctctagtggtcccag

SEQ ID NO: 66967 - DNA, 201 bp, Homo sapiens
gttattcctcttgtcacatgtggaacggtaggagatggaagacggagacagaacaagcaaaggagggccctgggcacagaggtctgtgtgtgtagccatcyaagccactggaccccagcagacgagcacctaagctcaggcttaacccagtgcacgtgtgcgcacatacatgtgccccgcacctgacagtccactcaaccc

SEQ ID NO: 66968 - DNA, 201 bp, Homo sapiens
gcacctaagaattggaggggctgattccccttcctccaccagaaaaatatccccaacatctgccgactgggctccttctcagcagctccgagtccactccracgcccgcgcgacccggcgctccccacccgccagggcccgggccggccgcggggtgcactcaccgcctcgcaggcgcacagcacgcagcgcatcaccccg

SEQ ID NO: 66969 - DNA, 201 bp, Homo sapiens
tcaccttcagcttggccaccctaacccaatctacattcacctatgatgatagcctgtggataagatgatggcttgcaggtccaatatgtgaatagatttgmagctgaacaccatgaaaagctggagagaaatcgctcatggccatgcctttgacctattcccgttcagtcttcttaaattggcatgaagaagcaagactca

SEQ ID NO: 66970 - DNA, 201 bp, Homo sapiens
aagatgatggcttgcaggtccaatatgtgaatagatttgaagctgaacaccatgaaaagctggagagaaatcgctcatggccatgcctttgacctattccygttcagtcttcttaaattggcatgaagaagcaagactcatatgtcatccacagatgacacaaagctgggaagtaccactaaaataacaaaagactgaatc

SEQ ID NO: 66971 - DNA, 201 bp, Homo sapiens
ttcaaattcaaggccttccaacgcccccatcccctttactatcattctcagtgggactctgatcccatattcttaacagatctttactcttgagaaatgawtaagctttctctcagaaatgctgtccctatacactagacaaaactgagcctgtataaggaataaatgggagcgccgaaaagctccctaaaaagcaaggga

SEQ ID NO: 66972 - DNA, 201 bp, Homo sapiens
cccatactcccaggaagacaccatcacttcctctaactccttgacccaatgactattcttcccatattgtccccacctactgatcacactctctgacaagrattattcttcacaatacagcccgcatttaaaagctctcgtctagagatagtactcatggaggactagcctgcttattaggctaccatagctctctctatt

SEQ ID NO: 66973 - DNA, 201 bp, Homo sapiens
gacattctgggagcagtgacccttctgctggagggagtgatggcagcacggggacaactgggacccacttgcctctcatccctcctggggcagctttctgracaggtccgtctcctccttggggccctgcagagcctccttggaacccaggtaagtccccagtcaagggatctgtagaaactgttcttttctgactcagtc

SEQ ID NO: 66974 - DNA, 201 bp, Homo sapiens
cagctgtccccagcagaacctctctagtcctcacactgaacgagctcccaaacaggacttctggattgttggagacaaacttcactgcctcagccagaacwactggctctgggcttctgaagtggcagcagggattcagagccaagattcctggtctgctgaaccaaacctccaggtccctggaccaaatccccggatacc

SEQ ID NO: 66975 - DNA, 201 bp, Homo sapiens
gtaacttatcctcaggcgcattcgacagtcccctcttgctttctcacccccttccttcacccaagggaccctctgcctctccagcccactcccagcctccyttctcttggttccctggtcatgcctgcctccctgtctcctgtctctccctcccacacacacccactatcctcccagctatcccagcaccctccttcctaa

SEQ ID NO: 66976 - DNA, 201 bp, Homo sapiens
ccgactccccgcccgcgcctcccccgggcgcccacctacctgccgctccccgaacgggcagcggctccttctcagaacggatgggcagcacggggggctckgggccggcgccgcgggccggccgggagccgagcagcagcagcccgaggagcagcagcggggccggcggggccgggaggctcggcatgacgcgaacgggac

SEQ ID NO: 66977 - DNA, 201 bp, Homo sapiens
acatcctacacccactcccagaatctgtctcaggaagggtaaggttctcagacactgccgacatcagcattgtctcgtgtacagctcccttccctgcaggrcgcccctgggagacaactggacaagatttcctactttctcctgaaacccaaagccctggtaaaagggatacacaggactgaaaagggaatcatttttcac

SEQ ID NO: 66978 - DNA, 201 bp, Homo sapiens
gtaagtccccagtcaagggatctgtagaaactgttcttttctgactcagtccccctagaagacctgagggaagaagggctcttccagggagctcaagggcmgaagagctgatctactaagagtgctccctgccagccacaatgcctgggtactggcatcctgtctttcctacttagacaagggaggcctgagatctggccc

SEQ ID NO: 66979 - DNA, 201 bp, Homo sapiens
catgttttatgggcaatagtttaaaaaactaaaatctatcctcaagaaccctagcgtcccttcttccttcaggactgagtcagggaagaagggcagttcckatgggtcccttctagtcctttcttttcatccttatgatcattatggtagagtctcatacctacatttagtttatttattattattatttgagacggagtc

SEQ ID NO: 66980 - DNA, 201 bp, Homo sapiens
acgggagtttttgaagcagaggctgatgaccagctgtcgggagactgtgaaggaattcctgccctgggtgggaccttggtcctgtccagttctcagcctgwatgattcactctgctggctactcctaaggctccccacccgcttttagtgtgccctttgaggcagtgcgcttctctcttccatctctttctcaggaggaga

SEQ ID NO: 66981 - DNA, 201 bp, Homo sapiens
catctcaagccctccccagcatctgttcaccctgccaggcagtctcttcctagaaacttggttaaatgttcactcttcttgctactttcaggatagattcytcacccttggcccgcctttgccccaccctactctgcccagaagtgcaagagcctaagccgcctccatggccccaggaaggattcaggggagaggccccaa

SEQ ID NO: 66982 - DNA, 201 bp, Homo sapiens
cagacaccccggccagaatggagctgactggtgagaacacacctgaggggctagggccatatggaaacatgacagaaggggagagagaaaggagacacgcygcagggggcaggaagctgggggaacccattctcccaaaaataaggggtctgaggggtggattccctgggtttcaggtctgggtcctgaatgggaattcct

SEQ ID NO: 66983 - DNA, 201 bp, Homo sapiens
aggtccgtctcctccttggggccctgcagagcctccttggaacccaggtaagtccccagtcaagggatctgtagaaactgttcttttctgactcagtcccmctagaagacctgagggaagaagggctcttccagggagctcaagggcagaagagctgatctactaagagtgctccctgccagccacaatgcctgggtactg

SEQ ID NO: 66984 - DNA, 201 bp, Homo sapiens
acccctaccagccctcttctaaacacatcctacacccactcccagaatctgtctcaggaagggtaaggttctcagacactgccgacatcagcattgtctcrtgtacagctcccttccctgcagggcgcccctgggagacaactggacaagatttcctactttctcctgaaacccaaagccctggtaaaagggatacacagg

SEQ ID NO: 66985 - DNA, 201 bp, Homo sapiens
attcacatagtttggattatcatttattgcaggtgaccaaaaatcctttcacactgggcgacagttccaatcctggacagacggagagactacaggagttwagccagaagatggaccaggtaagaggtcactggccagtcagtacttagaatcctggggctccagtgaacaggaggctgcatgctcatgtcttgccacttt

SEQ ID NO: 66986 - DNA, 201 bp, Homo sapiens
actgagacagctgcccttgtccgcagtctatcactgctggtattaattgggcaggaggcctctggttggctttctttgcttctgacttaaagcttaaactracctctcatttcacagtctgagacttgcagtgtggaaatcccagagctagaatttgaactgggaatggcagtcctcgggggcaagttcaccacactggaa

SEQ ID NO: 66987 - DNA, 201 bp, Homo sapiens
acaggaaaggagtctcctgaggggagaccgagtccagcacaagtgaaggagttaccattgaaatgatgactttcaaacagcactggcctctgtattgaccytatccttgtttgatatcatgctgttagaattcagcctcctaaagaaaattttcccgtgtatctactgtaatttggggattgcagctggcatttaattcat

SEQ ID NO: 66988 - DNA, 201 bp, Homo sapiens
tggtccaggcggtcggatcttaaataaatccccctatgtctcctagccttagtttcttttgtaaaatggtactggtgttgtcatcagctcaagtgagatamgatttgtgaaaatgctttgtaaatgttgtctgagggtatgaaatgagcagtagttgttatgaatagtattctcaccatttggacagcctggctcacacca

SEQ ID NO: 66989 - DNA, 201 bp, Homo sapiens
gtgtctttagcctgaacatcccatctgggagggctcaccctttgtcctcatgttgtgttccaggtgctccagttcagcacaaactgcccagaatgcaatgyccccgctcagaccaacatgaagctagtacgtatcttttgccaagcagttgggttgctcttcatctgactcaggcatgaagattataatcaggctgggagc

SEQ ID NO: 66990 - DNA, 201 bp, Homo sapiens
ccttattttgttagagcatcttctccagtagcttcctgggaaaaagtgcatgggaaataaaatttctgggaccttccacatctgaacatgtctttattctrttatcacactagagtgattattggctgggaatacgattctaggatagaaataattttttatcagaatttcgaagactgcactatggtcttccagtttggt

SEQ ID NO: 66991 - DNA, 201 bp, Homo sapiens
ctaggggaagttgtcttttagaaataatgttcagggacatgaggtatctcctacttccctggctttgaggacccctgagcagagggagttaatctaagatkggaattgcaggtttagaaggtgaccctgttagctctttctgatgacctggtagctttttggcctccagtgtctatctgggtcctcttctctgtctgtccc

SEQ ID NO: 66992 - DNA, 201 bp, Homo sapiens
ggtagaaagtaatggtaataccatagtgtgtttattgtagaattttagcatcactattatcagacatgaatggaaccttgcacctggccttctcattttayagatgaggaaattaagacccagagagttcaagtgaattgcccagggtcatacagggacttgatagcagagctgaggctaagtcacacttgtcttttgttc

SEQ ID NO: 66993 - DNA, 201 bp, Homo sapiens
ctttcagtgttaagggctttgctcagatgtctgataatcattgattgtcttcttacaagtagcgggctaaagacctgagtagggggtgagccttgttgacmtggggcttattacaggggaatttaacttagctgttttgctgaggtggcctccaatgccagaattgttaggtctttcctcttgggctagtcagacaaagag

SEQ ID NO: 66994 - DNA, 201 bp, Homo sapiens
cgctgctctttctgtaggttatttattagtattggatgaaggcgaaggctgggagtgtctttcccaccagcccttgcccatggtggggaggacatctggtytgagtcagagatctgtgcacactttctaaacagcttgtgatgcaagtgtgagcctattgtgttacttgaccttattttggaagttttgaattggcctagg

SEQ ID NO: 66995 - DNA, 201 bp, Homo sapiens
caagcacaccacagaacagaggacaaaataaatctctttcatggaacttgaagtctagtggggaaaaatgacaataaacagatgaggaaaacagtacatcrgatggtgattagtgtcatggaggaatgtaaagcagggaatggggctgggttgtgcaaggaaatggggagtagggaagatcttctgaacaagaaggtgata

SEQ ID NO: 66996 - DNA, 201 bp, Homo sapiens
gtcatttattttactgtaaagttaggggatgagggtccttctagcacctaaaacttcccaacataaaaaacatacatgtatgggttgacttagcccaaatrtttatctccttgatgaattatttcacttgattctctgttgggcattttgtatttgtaaattgtactttttctttgcatttcttctccaaattagtatcag

SEQ ID NO: 66997 - DNA, 201 bp, Homo sapiens
ttggcaatttgggataagttttggcacgttaccagggttgggcactgttcctggccagctcttggtgtttttggtttgggcgactgctgtttagaaggctmtttctttggtagctattaatggccctaactgattggatgtccaagcctacactccaggtctcctgggtaccaagtgaggctcaggtcttctctctgttgc

SEQ ID NO: 66998 - DNA, 201 bp, Homo sapiens
gcttatctactttatgccaagcacaccacagaacagaggacaaaataaatctctttcatggaacttgaagtctagtggggaaaaatgacaataaacagatsaggaaaacagtacatcagatggtgattagtgtcatggaggaatgtaaagcagggaatggggctgggttgtgcaaggaaatggggagtagggaagatcttc

SEQ ID NO: 66999 - DNA, 201 bp, Homo sapiens
aaggagacccacacattggatgcagtggatgaaaggactgcaataaatgcttaaaagtctctttcaaccccaaaagtcttttttttttttttttttaaggkaaattcagagtttattggcaatttgggataagttttggcacgttaccagggttgggcactgttcctggccagctcttggtgtttttggtttgggcgactg

SEQ ID NO: 67000 - DNA, 201 bp, Homo sapiens
cagagaagtggtgaagactgactctgctgccacaaggattcctgagctagattttgaaattcctgcctttagccagaaaggaggtaagtttaagatcagartatttgggctgttcgcatgtagctagaatcttaccctctttcttgcaaaaccccctggtgccaggtctagtggtttgtgtatgggttctaccatgtaatc

SEQ ID NO: 67001 - DNA, 201 bp, Homo sapiens
tcattagttaatcatgagtggaaagcttaggtaaaacagctcgagatggtagaaagtaatggtaataccatagtgtgtttattgtagaattttagcatcaytattatcagacatgaatggaaccttgcacctggccttctcattttacagatgaggaaattaagacccagagagttcaagtgaattgcccagggtcataca

SEQ ID NO: 67002 - DNA, 201 bp, Homo sapiens
gagacctcctcaaggtaacagtctgcttgggaaagtcactgttgtcctcataagttagataaactgtctctatctaggggaagttgtcttttagaaataaygttcagggacatgaggtatctcctacttccctggctttgaggacccctgagcagagggagttaatctaagattggaattgcaggtttagaaggtgaccct

SEQ ID NO: 67003 - DNA, 201 bp, Homo sapiens
gagagggagagacagctgggctgcggtctgatggaaggggacggtctggttattacttgaggagaagctgttctgcagtctctttgtactgaacgtattcytttcttcccaggacatgaacagagaagtggtgaagactgactctgctgccacaaggattcctgagctagattttgaaattcctgcctttagccagaaagg

SEQ ID NO: 67004 - DNA, 201 bp, Homo sapiens
ggcacgttaccagggttgggcactgttcctggccagctcttggtgtttttggtttgggcgactgctgtttagaaggctctttctttggtagctattaatgrccctaactgattggatgtccaagcctacactccaggtctcctgggtaccaagtgaggctcaggtcttctctctgttgctcctgactgttatcgatgcagg

SEQ ID NO: 67005 - DNA, 201 bp, Homo sapiens
gggctgttcgcatgtagctagaatcttaccctctttcttgcaaaaccccctggtgccaggtctagtggtttgtgtatgggttctaccatgtaatcattgtratcttcattagttaatcatgagtggaaagcttaggtaaaacagctcgagatggtagaaagtaatggtaataccatagtgtgtttattgtagaattttagc

SEQ ID NO: 67006 - DNA, 201 bp, Homo sapiens
cactttgtctgtcagggctctggaggtgagaggacctcagagcaggtacctcagtattctagagagagattcggtactggggtcagagctctggtccaggmggtcggatcttaaataaatccccctatgtctcctagccttagtttcttttgtaaaatggtactggtgttgtcatcagctcaagtgagataagatttgtga

SEQ ID NO: 67007 - DNA, 201 bp, Homo sapiens
cctccctacagaacgcttttgatgtgctgggcttcacttcagaggagaaaaactccatgtataagctgacaggcgccatcatgcactttggaaacatgaarttcaagctgaagcagcgggaggagcaggcggagccagacggcactgaaggtgggaggcagggattcttgggggcagctgtcaagtcatggagggccatgt

SEQ ID NO: 67008 - DNA, 201 bp, Homo sapiens
caactccactggacctcagcagccctcaaccgagttaccgtgttccccacacagaggagatctccgacttgactgagcagttgggttccagcggaaagacyatccatgagctggagaaggtccgaaagcagctggaggccgagaagatggagctgcagtcagccctggaggaggccgaggtgtgtgtgtgtgcagggcacg

SEQ ID NO: 67009 - DNA, 201 bp, Homo sapiens
agtcaggatgctttgcctcactgggcctggctccttctctctaccagctggaaggatccctggagcaagagaagaaggtgcgcatggacctggagcgagcraagcggaagctggagggcgacctgaagctgacccaggagagcatcatggacctggagaatgacaagcagcagctggatgagcggctgaaaaagtactgtg

SEQ ID NO: 67010 - DNA, 201 bp, Homo sapiens
agtgtttgacaacacaggaggactctgccccggccccacctccttctcctctcagggaagctttttgctcgaattatgtttctgatccgaatataagacgwacaaaaggtttgtctgagggcagagtgcttccgtctggggcagggcactgtggcagggaaaggcagtggggagggctgcagaagcccatacctcctcaat

SEQ ID NO: 67011 - DNA, 201 bp, Homo sapiens
ctgaagctgacccaggagagcatcatggacctggagaatgacaagcagcagctggatgagcggctgaaaaagtactgtgtcccctccctgctgcccttcckcctccccagcccataacagtacaagcagacccaagacagccatcctctgaggcaacaacctcacgcagcctccacaagtggaggcgcaaaccatgggaaa

SEQ ID NO: 67012 - DNA, 201 bp, Homo sapiens
aaaacctgctgcggctgcaggacctggtagacaagctgcagctaaaggtcaaggcctacaagcgccaggccgaggaggcggtgagtgaccctgctggggaytaggcccaggggaggcataggagagctcgtcccccaagccaggagtctgagaacccaggccccctctcacctcatgctcccacctcccgcaggaggagca

SEQ ID NO: 67013 - DNA, 201 bp, Homo sapiens
acctgggcaaatccgccaacttccagaagccacgcaatatcaaggggaagcctgaagcccacttctccctgatccactatgccggcatcgtggactacaayatcattggctggctgcagaagaacaaggatcctctcaatgagactgtcgtgggcttgtatcagaagtcttccctcaagctgctcagcaccctgtttgcca

SEQ ID NO: 67014 - DNA, 201 bp, Homo sapiens
ttagagccagctgtggaccagacatgggaaggcagtggggactgtgtggtgacagaggcagtcattttctctgtcttcaggggaagccctccttcactgcyttgacatggaggggaccagccacgccctgctgggctcaggcacagtggacgggcacagccccaatggccactcacacccactttctgactgctcccaccc

SEQ ID NO: 67015 - DNA, 201 bp, Homo sapiens
cacctttgttcccatgccctgtccctgcccaataccatctctccaaggactgattggactttgtttcctttcaaaagggcttgaatgaggagtagctttgmcacatcttgatctgctcagccctggaggtgccagcaaagccccatgctggagcctgtgtaacagctccttgggaggaagcagaataaagcaattttcctt

SEQ ID NO: 67016 - DNA, 201 bp, Homo sapiens
cagaggagaaaaactccatgtataagctgacaggcgccatcatgcactttggaaacatgaagttcaagctgaagcagcgggaggagcaggcggagccagayggcactgaaggtgggaggcagggattcttgggggcagctgtcaagtcatggagggccatgtctgctcagcagtcatctctcttctcttttttcttttttt

SEQ ID NO: 67017 - DNA, 201 bp, Homo sapiens
agagtccaccctggccacctgtacacctgggtggacagagaggggtacacccatgccccatgcccatgcagacctgaggatggtcccattctccttccctytggggaagaatccagaccctccaaagagccctctccttcccaatatcccttctgtcttccctgtgagatcctggttccttctctcttgagcactattgcc

SEQ ID NO: 67018 - DNA, 201 bp, Homo sapiens
acctgcaggaggggctcatatgaacacactgcagtcacagggtcagaggcctcaggaagggtgggagggatgaaggaaatgggatattcccaaggtttcargacctcaggtaggaaggaggcaggaggctcagcactcctttcaatgggcccctgcagagactccctgctggtaatccagtggaacattcgggccttcatg

SEQ ID NO: 67019 - DNA, 201 bp, Homo sapiens
ggattaaggagacaagttttctctccaacttacaagggatctcacttacccatcatacttctttttctggggtccgccaatatggggcctccctacagaaygcttttgatgtgctgggcttcacttcagaggagaaaaactccatgtataagctgacaggcgccatcatgcactttggaaacatgaagttcaagctgaagc

SEQ ID NO: 67020 - DNA, 201 bp, Homo sapiens
acaggggtccaaaagcagagctaagacgctggccattggttgtttaaagtggtatggacctcctgagagccagaatgtgccctgtgatcagggtgtactgrggaatggatgaggtgagacaggactggccagtatctggtgttctatcaaaccaggaagagctgaaagccatgagacagagagacacacaagccaagaaac

SEQ ID NO: 67021 - DNA, 201 bp, Homo sapiens
agacagttgtggattttgggtgtagataacctggcagcttcttgcccagggctcctactctcgggtaggcccaggcattctctcctgatttgaggcttgcyggtctccagtagtattgttcactgcccaataagcccctgtcttcacagcggagaatccggagcagggaagacagtcaacaccaagagggtcatccagtac

SEQ ID NO: 67022 - DNA, 201 bp, Homo sapiens
ctttttctggggtccgccaatatggggcctccctacagaacgcttttgatgtgctgggcttcacttcagaggagaaaaactccatgtataagctgacaggygccatcatgcactttggaaacatgaagttcaagctgaagcagcgggaggagcaggcggagccagacggcactgaaggtgggaggcagggattcttggggg

SEQ ID NO: 67023 - DNA, 201 bp, Homo sapiens
tgagaggatgttcaactggatggtgacgcgcatcaatgccaccctggagaccaagcagccacgccagtacttcataggagtcctggacatcgctggcttcsagatcttcgatgtgagttgggacccctgggagtgggagaacaatcactcactcgctcccacattcaacagctatttgcttagagccagctgtggaccaga

SEQ ID NO: 67024 - DNA, 201 bp, Homo sapiens
aagacagttgtggattttgggtgtagataacctggcagcttcttgcccagggctcctactctcgggtaggcccaggcattctctcctgatttgaggcttgytggtctccagtagtattgttcactgcccaataagcccctgtcttcacagcggagaatccggagcagggaagacagtcaacaccaagagggtcatccagta

SEQ ID NO: 67025 - DNA, 201 bp, Homo sapiens
ctaccaacttttcccaaaacagcccaggcccatctcccctgtttactttgcccagccaagcacaggctcagcctgcccaaaccagtgccttctggtggcawccttcctggtgccagccctgacctctgtgcatcagaagacagttgtggattttgggtgtagataacctggcagcttcttgcccagggctcctactctcgg

SEQ ID NO: 67026 - DNA, 201 bp, Homo sapiens
gggaaaaggcctcccaggcaagggctttcctcccctagtcccagatatcagggttagttagatggtcctccctggcaaaaagtccattgtatcccatgagwcctttcttcttgttaggcactcagtgggaatgaaaataacagccttcccccttcatacacatctctctttggagaccagttccttgacatggaggaaggc

SEQ ID NO: 67027 - DNA, 201 bp, Homo sapiens
tgctacttgccttttccttccagaggctgacaagtctgcctacctcatggggctgaactcagccgacctgctcaaggggctgtgccaccctcgggtgaaartgggcaatgagtacgtcaccaaggggcagaatgtccagcaggtgggtccatcttcagatgataatgggtgggcagggtagggagactggcatggtgggat

SEQ ID NO: 67028 - DNA, 201 bp, Homo sapiens
gaaagagagaaggagatggcctccatgaaggaggagttcacacgcctcaaagaggcgctagagaagtccgaggctcgccgcaaggagctggaggagaagawggtgtccctgctgcaggagaagaatgacctgcagctccaagtgcaggcggtgaggctcctgggctactgttggctcttccaccctgctctgccttcactt

SEQ ID NO: 67029 - DNA, 201 bp, Homo sapiens
acagcctcttccctctctccaggtcccctgcaggccttggcccctttcctcatctgtagacacacttgagtagcccaggtaagaaaagctgaagctagagygttgaaaatctagtaagactgggcattagagccccaaagccagcctatggaactctagtttctgccatgtgctggagagaatatcttggctatcaagagc

SEQ ID NO: 67030 - DNA, 201 bp, Homo sapiens
ctctgcagggcaccctggaggaccagatcatccaggccaaccctgctctggaggcctttggcaatgccaagaccgtccggaacgacaactcctcccgcttygtgagtggtccctgaccttggccttgggacttggactggtggaggaatggtctcagatatgagccttcccccaactcatcaccactctcttccatctctc

SEQ ID NO: 67031 - DNA, 201 bp, Homo sapiens
cctgcaagaatgaggaccttaccccctgaacagcctcccctctgttcctcaccttcaggaacaagacaacctggcagatgctgaggagcgctgtgatcagstgatcaaaaacaagattcagctggaggccaaggtgaaggagatgaacgagaggctggaggatgaggaggagatgaatgctgagctcactgccaagaagcg

SEQ ID NO: 67032 - DNA, 201 bp, Homo sapiens
aaggggctgaaggatccgagcccttggttccagagcctatgttgtgctgagcacccaggacagggtggcaccagggacagctgatttcccaggggcttgaragtggacacatggaggatgggcacctgcatgatgacctcccacacctgcatgtttattgggcctggtttatgcatccaaggatcaggaagtgtgagggtg

SEQ ID NO: 67033 - DNA, 201 bp, Homo sapiens
cagcttagtgaacttgggccagtcccataacccctctgggcttaatttactcatctagaacattggatatatctgttctggctaccacctatgataatagktgtgaatcatataaaaaaggaatgtgaaagccttttagttaaaaatgtggctagaagaaaatgaaacaaatgattattactaactgacttgctaagatta

SEQ ID NO: 67034 - DNA, 201 bp, Homo sapiens
tgttaatccatttttggctaattaggagacagaggctcagggacctgggttcaagacctggctctgttcttgatcagcttagtgaacttgggccagtcccrtaacccctctgggcttaatttactcatctagaacattggatatatctgttctggctaccacctatgataataggtgtgaatcatataaaaaaggaatgtg

SEQ ID NO: 67035 - DNA, 201 bp, Homo sapiens
gtgatatatgccactggggcactggccaaggcagtgtatgagaggatgttcaactggatggtgacgcgcatcaatgccaccctggagaccaagcagccacdccagtacttcataggagtcctggacatcgctggcttcgagatcttcgatgtgagttgggacccctgggagtgggagaacaatcactcactcgctcccaca

SEQ ID NO: 67036 - DNA, 201 bp, Homo sapiens
ctgatgttctcggcccctgggacctgtcctcaggcttctccagctacacttctgaggtttcaaggattgtctttgagaaggttcatgttgtttcctcttgyccccatccacaccctccatcctccccaccctctgccaccctcccctgggcaggaagaagctggcccagcggctgcaggaagctgaggaggccgtggaggc

SEQ ID NO: 67037 - DNA, 201 bp, Homo sapiens
gagcgagcggcgcatcaaggagctcacctaccaggtgcgacgggcggtgactccaggcagagccctggcaccatagccacagtgacaaccagctgaggagwatgaagagtttgctcttagcctcttccagggcgaggatgggaatgcagcccccgtttcactttgcctagccctgccccactctgaatgtcccctagctca

SEQ ID NO: 67038 - DNA, 201 bp, Homo sapiens
cctgatgttctcggcccctgggacctgtcctcaggcttctccagctacacttctgaggtttcaaggattgtctttgagaaggttcatgttgtttcctcttktccccatccacaccctccatcctccccaccctctgccaccctcccctgggcaggaagaagctggcccagcggctgcaggaagctgaggaggccgtggagg

SEQ ID NO: 67039 - DNA, 201 bp, Homo sapiens
cactttccttccaataaagagcatgtagactgtcaggccctcgcctaaaggaaggctcttcaaactatcttccccaaatcctttaattcccacctctccastggaagagctaaactgacttgctgttccagagaagccgagagccttttagagccggggggattccagtggaggggtccaggcggtgggtctgagcccttt

SEQ ID NO: 67040 - DNA, 201 bp, Homo sapiens
agaacatcgccatcgtggagcggcgcaacaacctgctgcaggctgagctggaggagttgcgtgccgtggtggagcagacagagcggtcccggaagctggcrgagcaggagctgattgagactagtgagcgggtgcagctgctgcattcccaggtgagcagctcccctgctcattcctgaagggagcacaggctggggctca

SEQ ID NO: 67041 - DNA, 201 bp, Homo sapiens
gagcaaggcggaggagacccagcgttctgtcaacgacctcaccagccagcgggccaagttgcaaaccgagaatggtgagcctagagcaggggctccatggwtcccaccacagtctccccaacctcctgagccactccagcctcgggcacaagccaatacacgcacacacagacacagagtctctccagaaaatggggcctg

SEQ ID NO: 67042 - DNA, 201 bp, Homo sapiens
aagggcagagggaaaagagctgacttttaaaagcacaggctttctacttgggttcaacctagatacacagcttaattattttgtgaccttgggcagaccakgcatcatctttgagcctcaatttcctctagacagggaataaagctgtccatttcattaagccatcatacataagtgcttggcatcagcaaatgcaattcc

SEQ ID NO: 67043 - DNA, 201 bp, Homo sapiens
atggacattacctcatcagtggccctacaaccccttggatagctggttgtccaagacagaatcttagttcaactttaaatttacctgcagaaccacttaakcccccaatgagacatattcaaattgttaatccatttttggctaattaggagacagaggctcagggacctgggttcaagacctggctctgttcttgatcag

SEQ ID NO: 67044 - DNA, 201 bp, Homo sapiens; identical to SEQ ID NO: 14249

SEQ ID NO: 67045 - DNA, 201 bp, Homo sapiens
gggtggatgctgaagaacagagccagggagaagcaggaaggtgggactggtcaggttgggcacagcctgccctgacacagcctcttccctctctccaggtyccctgcaggccttggcccctttcctcatctgtagacacacttgagtagcccaggtaagaaaagctgaagctagagcgttgaaaatctagtaagactgggc

SEQ ID NO: 67046 - DNA, 201 bp, Homo sapiens
atctgaacaagctgatgaccaacttgcgctccacccatccccactttgtacgttgtatcatccctaatgagacaaagtctccaggtgaggccacaaactcrggccaacccactgctgggcatacaccgccctgggaacaggacctcctaggacatctccctacctaccaccacagtggtttccaaaccacattcttctcct

SEQ ID NO: 67047 - DNA, 201 bp, Homo sapiens
gaggcaacaacctcacgcagcctccacaagtggaggcgcaaaccatgggaaaaggcctcccaggcaagggctttcctcccctagtcccagatatcagggtyagttagatggtcctccctggcaaaaagtccattgtatcccatgagtcctttcttcttgttaggcactcagtgggaatgaaaataacagccttcccccttc

SEQ ID NO: 67048 - DNA, 201 bp, Homo sapiens
tgggcagagcagatcactgcagagcatgggtgactctggacacttccctcctcaggtatcgcatcctgaacccagcggccatccctgagggacagttcatkgatagcaggaagggggcagagaagctgctcagctccctggacattgatcacaaccagtacaagtttggccacaccaaggtgaggaaaggagactaattaa

SEQ ID NO: 67049 - DNA, 201 bp, Homo sapiens
tggcctccattgatgacgctgaggagctcatggccactgatgtgagtgtgtgaggacccagccagggggtgggaggattggcagtgaggggcaaacagggktccaaaagcagagctaagacgctggccattggttgtttaaagtggtatggacctcctgagagccagaatgtgccctgtgatcagggtgtactggggaatg

SEQ ID NO: 67050 - DNA, 201 bp, Homo sapiens
caaggagagaccaccgtggcctccattgatgacgctgaggagctcatggccactgatgtgagtgtgtgaggacccagccagggggtgggaggattggcagygaggggcaaacaggggtccaaaagcagagctaagacgctggccattggttgtttaaagtggtatggacctcctgagagccagaatgtgccctgtgatcag

SEQ ID NO: 67051 - DNA, 201 bp, Homo sapiens
acaaagctcacccagtacagctcaccagaaagcaaatatgtagccagggtcacccccaaaagacaccaaaaacacacccatcccattcaaacaagcataadaactttttcattgcccagggcagtgtggactctagctttctgaggtgttttctagaatcagactctgaattagaatttgtttcttttccaatccaggatg

SEQ ID NO: 67052 - DNA, 201 bp, Homo sapiens
gttttcctggcctgcattgcagcccaggaaattccatcacactcatagccccaaagtcactcccagcatgtgccgaggtccagagcaggggacttcatccbgcatggggtccccggaccctgaaaaacctgctccctggagcactgcacacacacaattttgtgcataatttcaggagtcccactagttctttggactctt

SEQ ID NO: 67053 - DNA, 201 bp, Homo sapiens
ccagagttattttccagctgaaagcagagagagattatcacattttctaccaaatcctgtctaacaaaaagcctgagctgctgggtgagtcagagccaccractgagaccaactatctccatggcaacctggtcccctctgcttgtggctggactcagctggcatgccctgggtttcatggcactgctggattcaattcag

SEQ ID NO: 67054 - DNA, 201 bp, Homo sapiens
ccaaagaggaaaataagtttcagaaaggttagctgagttacccaaagcaatagtgacaaaattaaagaccatcagagctaaaaaggacctttgaaacaatstagtccgaccccctcattttacattatgagaaaacaaggaccaaagatgggaatgtcctgtagagcccaggccccatcaccctgtctacagcactcctcc

SEQ ID NO: 67055 - DNA, 201 bp, Homo sapiens
cctaccaacttttcccaaaacagcccaggcccatctcccctgtttactttgcccagccaagcacaggctcagcctgcccaaaccagtgccttctggtggcwtccttcctggtgccagccctgacctctgtgcatcagaagacagttgtggattttgggtgtagataacctggcagcttcttgcccagggctcctactctcg

SEQ ID NO: 67056 - DNA, 201 bp, Homo sapiens
ttccggcagaggtgggtatgagggtgcaccagagctcatagaacagggggagccaggctgccctgatgggaatgggatctgcaggtgaccctggaattctrtgggcagagcagatcactgcagagcatgggtgactctggacacttccctcctcaggtatcgcatcctgaacccagcggccatccctgagggacagttcat

SEQ ID NO: 67057 - DNA, 201 bp, Homo sapiens
ctctgctcccctccccagtgttcccaagttatactatcctgaaactcttcccctccccatacttctgaagctcttgccaagtggggatatcctagagttaycctcctatttgagtgatgtgcctctccttccctctacctgcaagaatgaggaccttaccccctgaacagcctcccctctgttcctcaccttcaggaacaa

SEQ ID NO: 67058 - DNA, 201 bp, Homo sapiens
acacgcaacagagaacaaggtaagggcagctccctttggctccagcccgggtctcatcaggactctcagaccatactgaccttgacccaggctagccactyggcatccagagagcagcatggaccttgacatggagctccccacagatggcaccaagctggtgacctttgaccctaaaggagatgggattcttggtcggca

SEQ ID NO: 67059 - DNA, 201 bp, Homo sapiens
atggcaccaagctggtgacctttgaccctaaaggagatgggattcttggtcggcaggtgaaaaacctgacagaggagatggctgggctggatgagatcatygccaagctgaccaaggagaagaaagctctgcaagaggcccaccaacaggctctggatgaccttcaggccgaggaggacaaggtcaacaccctgactaagg

SEQ ID NO: 67060 - DNA, 201 bp, Homo sapiens
ccttgacatggaggaaggctccacatgagagcctcttaggaaagtccctttgtggcttttcacagagagcccacagggcaccaagaaatgccctcacattmaagaagtcaggggatcagggccatttctttgttttgcttaacttgtggttccaattcttagtgtaagttcttccaaaatgtatagactttccagacttgg

SEQ ID NO: 67061 - DNA, 201 bp, Homo sapiens
actgtcccatccccagagcctaggacagagcctggcacatagtaggcattcagtgaagatttgtggagtgaatgaatgaccagtcactgaactctcttcayataaacattttacccattgcatcttagctgagcttcccatttccacatacctcccggttcccacctctgcctccctctgttttcttttatactctatacc

SEQ ID NO: 67062 - DNA, 201 bp, Homo sapiens
ctccttttctatccccagacctactcgggcctcttctgtgtcaccgtcaacccttacaagtggctgccggtgtacactcctgaggtggtggctgcctaccrgggcaagaagaggagcgaggccccgccccacatcttctccatctccgacaacgcctatcagtacatgctgacaggtgagaggccctggaagggtcttcct

SEQ ID NO: 67063 - DNA, 201 bp, Homo sapiens
gggcctagatatgccatgtctatctgtgcccagagctctgtgtgtgtgtgtgtgtgtgtgtgtgtgtgtgtgtgtgtgtgtgtgtttgtgtttatgtttakaggggggtagggttagaggatgttaacttttctgatatctttctagaaaggagctggggaatgaaaagtcagaggtggtgatcaattctgaattatgtat

SEQ ID NO: 67064 - DNA, 201 bp, Homo sapiens
ggaagggtcttcctgaagggaactgggataggccgggagggagagggagaaggaagggagaagccccacgagagcatcctgtgcagctcctgacctttccyccccaccctctccccacagacagagaaaaccagtccatcctgatcacgtgagtgtagctgctactgtattccctttcagaatctccctgatcccagcctc

SEQ ID NO: 67065 - DNA, 201 bp, Homo sapiens
acccaggctagccactcggcatccagagagcagcatggaccttgacatggagctccccacagatggcaccaagctggtgacctttgaccctaaaggagatrggattcttggtcggcaggtgaaaaacctgacagaggagatggctgggctggatgagatcattgccaagctgaccaaggagaagaaagctctgcaagaggc

SEQ ID NO: 67066 - DNA, 201 bp, Homo sapiens
agaggccctggaagggtcttcctgaagggaactgggataggccgggagggagagggagaaggaagggagaagccccacgagagcatcctgtgcagctcctracctttcctccccaccctctccccacagacagagaaaaccagtccatcctgatcacgtgagtgtagctgctactgtattccctttcagaatctccctgat

SEQ ID NO: 67067 - DNA, 201 bp, Homo sapiens
ctcttcccgtcatctcctggcctcttcacttatttacttcccatctcccttctctcctctttcccttctgtctcccaccctctctccttatccctgtctgsccccagggccccttcatctctgtgacttctcgaattctctccatctctcttttccttccttcttctcctctcttcttcctgcatctctttctggcatttt

SEQ ID NO: 67068 - DNA, 201 bp, Homo sapiens
tctcttcccgtcatctcctggcctcttcacttatttacttcccatctcccttctctcctctttcccttctgtctcccaccctctctccttatccctgtctscccccagggccccttcatctctgtgacttctcgaattctctccatctctcttttccttccttcttctcctctcttcttcctgcatctctttctggcattt

SEQ ID NO: 67069 - DNA, 201 bp, Homo sapiens
aaatcgaggacatggccatgctgaccttcctgcatgagcccgcggtgctctacaacctcaaggatcgctacggctcctggatgatctacgtgagtgctgcmcctggccctacgttgggatctctgttcttgctccatccatgtccaccccaggagccaagagtgtcttctgtttgtgtctaggcagggttacactctaacc

SEQ ID NO: 67070 - DNA, 201 bp, Homo sapiens
actggtaactcctcttgactcttgagcatggtgctaggttttggggctcccactgaaggggagagcccagggagggaagggaagaatgggcagatgggagkgcagccagcttctgctcactccaggcacagccatgggagattcggagatggcagtctttggggctgccgccccctacctgcgcaagtcagagaaggagcg

SEQ ID NO: 67071 - DNA, 201 bp, Homo sapiens
agaagaccctaatttatatacaaccagtatatcccagtttccccccaactgctagtttccagttcccttccacctaattttgtcctgcaatcttgtaactmaaacctaaaatggacatcccagagaacccgggcctggctttgttctcgcccaggcaacttccctctgaccaaccccagaaccctaccctccagaacttgc

SEQ ID NO: 67072 - DNA, 201 bp, Homo sapiens
actcactcgctcccacattcaacagctatttgcttagagccagctgtggaccagacatgggaaggcagtggggactgtgtggtgacagaggcagtcatttwctctgtcttcaggggaagccctccttcactgccttgacatggaggggaccagccacgccctgctgggctcaggcacagtggacgggcacagccccaatgg

SEQ ID NO: 67073 - DNA, 201 bp, Homo sapiens
ggtgatatatgccactggggcactggccaaggcagtgtatgagaggatgttcaactggatggtgacgcgcatcaatgccaccctggagaccaagcagccaygccagtacttcataggagtcctggacatcgctggcttcgagatcttcgatgtgagttgggacccctgggagtgggagaacaatcactcactcgctcccac

SEQ ID NO: 67074 - DNA, 201 bp, Homo sapiens
tgcagggcacggggtgcagggagctgagctccaggcttttggtccctgttctcatcccccgctttgtcgttttgttcactgtcccatccccagagcctagracagagcctggcacatagtaggcattcagtgaagatttgtggagtgaatgaatgaccagtcactgaactctcttcacataaacattttacccattgcatc

SEQ ID NO: 67075 - DNA, 201 bp, Homo sapiens
gtcagccctggaggaggccgaggtgtgtgtgtgtgcagggcacggggtgcagggagctgagctccaggcttttggtccctgttctcatcccccgctttgtygttttgttcactgtcccatccccagagcctaggacagagcctggcacatagtaggcattcagtgaagatttgtggagtgaatgaatgaccagtcactgaa

SEQ ID NO: 67076 - DNA, 201 bp, Homo sapiens
aggccgagaagatggagctgcagtcagccctggaggaggccgaggtgtgtgtgtgtgcagggcacggggtgcagggagctgagctccaggcttttggtccstgttctcatcccccgctttgtcgttttgttcactgtcccatccccagagcctaggacagagcctggcacatagtaggcattcagtgaagatttgtggagt

SEQ ID NO: 67077 - DNA, 201 bp, Homo sapiens
gctatgtgatgggtgtgtctgtgagaggaagcccacagtgtcttctctctgagaatgtccacaaagtctgacaacaaaatggggacaggatggaaaagaastctctttagagtcatcagacttgcattcaagtcttggctctcccacttgttgtcatgggctcttggccaagcaagccatttaacctcgatttcctcatct

SEQ ID NO: 67078 - DNA, 201 bp, Homo sapiens
taccaactttgctacttgccttttccttccagaggctgacaagtctgcctacctcatggggctgaactcagccgacctgctcaaggggctgtgccaccctygggtgaaagtgggcaatgagtacgtcaccaaggggcagaatgtccagcaggtgggtccatcttcagatgataatgggtgggcagggtagggagactggca

SEQ ID NO: 67079 - DNA, 201 bp, Homo sapiens
cagaagtatgaggagtcgcagtcggagctggagtcctcgcagaaggaggctcgctccctcagcacagagctcttcaaactcaagaacgcctatgaggagtscctggaacatctggagaccttcaagcgggagaacaaaaacctgcagggtgtgctgggggcccaagaggctggggaggggctgcactggcagtgttcccat

SEQ ID NO: 67080 - DNA, 201 bp, Homo sapiens
atgccccctgcagttcaacagctttgagcagctctgcatcaacttcaccaacgagaagctgcagcagttcttcaaccaccacatgtttgtgctggagcagraggagtacaagaaggagggcatcgagtggacattcattgactttggcatggacctgcaggcctgcattgacctcatcgagaaggtgcctctttggcctta

SEQ ID NO: 67081 - DNA, 201 bp, Homo sapiens
agatcctggccgagtggaagcagaagtatgaggagtcgcagtcggagctggagtcctcgcagaaggaggctcgctccctcagcacagagctcttcaaactyaagaacgcctatgaggagtccctggaacatctggagaccttcaagcgggagaacaaaaacctgcagggtgtgctgggggcccaagaggctggggaggggc

SEQ ID NO: 67082 - DNA, 201 bp, Homo sapiens
aggctccacatgagagcctcttaggaaagtccctttgtggcttttcacagagagcccacagggcaccaagaaatgccctcacattcaagaagtcaggggawcagggccatttctttgttttgcttaacttgtggttccaattcttagtgtaagttcttccaaaatgtatagactttccagacttggtaaacagtgagcttg

SEQ ID NO: 67083 - DNA, 201 bp, Homo sapiens
aaggctccacatgagagcctcttaggaaagtccctttgtggcttttcacagagagcccacagggcaccaagaaatgccctcacattcaagaagtcaggggwtcagggccatttctttgttttgcttaacttgtggttccaattcttagtgtaagttcttccaaaatgtatagactttccagacttggtaaacagtgagctt

SEQ ID NO: 67084 - DNA, 201 bp, Homo sapiens
aagtggctgccggtgtacactcctgaggtggtggctgcctaccggggcaagaagaggagcgaggccccgccccacatcttctccatctccgacaacgcctrtcagtacatgctgacaggtgagaggccctggaagggtcttcctgaagggaactgggataggccgggagggagagggagaaggaagggagaagccccacga

SEQ ID NO: 67085 - DNA, 201 bp, Homo sapiens
ggtccctgaccttggccttgggacttggactggtggaggaatggtctcagatatgagccttcccccaactcatcaccactctcttccatctctccaggggmaattcattcgaattcattttggggcaacaggaaagttggcatctgcagacatagagacctgtgagtgccatgaatctgctaggctcagcctaagctcacc

SEQ ID NO: 67086 - DNA, 201 bp, Homo sapiens
cttggccttgggacttggactggtggaggaatggtctcagatatgagccttcccccaactcatcaccactctcttccatctctccaggggaaattcattcraattcattttggggcaacaggaaagttggcatctgcagacatagagacctgtgagtgccatgaatctgctaggctcagcctaagctcacccttgctctag

SEQ ID NO: 67087 - DNA, 201 bp, Homo sapiens
cattgcccagggcagtgtggactctagctttctgaggtgttttctagaatcagactctgaattagaatttgtttcttttccaatccaggatgtcactatcyctctaagcacactttgtccttaacttagattaagtcagtgttttcctggcctgcattgcagcccaggaaattccatcacactcatagccccaaagtcact

SEQ ID NO: 67088 - DNA, 201 bp, Homo sapiens
gcctgaagcccacttctccctgatccactatgccggcatcgtggactacaacatcattggctggctgcagaagaacaaggatcctctcaatgagactgtcrtgggcttgtatcagaagtcttccctcaagctgctcagcaccctgtttgccaactatgctggggctgatgcgcgtaagtagggactgaggctcccggtaca

SEQ ID NO: 67089 - DNA, 201 bp, Homo sapiens
tcaccttcaggaacaagacaacctggcagatgctgaggagcgctgtgatcagctgatcaaaaacaagattcagctggaggccaaggtgaaggagatgaacragaggctggaggatgaggaggagatgaatgctgagctcactgccaagaagcgcaagctggaagatgagtgctcagagctcaaaagggacatcgatgatct

SEQ ID NO: 67090 - DNA, 201 bp, Homo sapiens
ggaggccaaggtgaaggagatgaacgagaggctggaggatgaggaggagatgaatgctgagctcactgccaagaagcgcaagctggaagatgagtgctcaragctcaaaagggacatcgatgatctggagctgacactggccaaagtggagaaggagaaacacgcaacagagaacaaggtaagggcagctccctttggctc

SEQ ID NO: 67091 - DNA, 201 bp, Homo sapiens
caagccgctgctgaagagtgcagaaagagagaaggagatggcctccatgaaggaggagttcacacgcctcaaagaggcgctagagaagtccgaggctcgcygcaaggagctggaggagaagatggtgtccctgctgcaggagaagaatgacctgcagctccaagtgcaggcggtgaggctcctgggctactgttggctctt

SEQ ID NO: 67092 - DNA, 201 bp, Homo sapiens
tgtagctgctactgtattccctttcagaatctccctgatcccagcctccagccccatcaggtgtcccaggccccgaggcatagactcagcctctttccccscaacctcgtgcccatctccttcttctctgaccattaccctgacccctctctttgctctccctcttcctttctgctttccatccccttcatgtttttcctc

SEQ ID NO: 67093 - DNA, 201 bp, Homo sapiens
accaggtgatgcagcagaacccacccaagttcgacaaaatcgaggacatggccatgctgaccttcctgcatgagcccgcggtgctctacaacctcaaggakcgctacggctcctggatgatctacgtgagtgctgcacctggccctacgttgggatctctgttcttgctccatccatgtccaccccaggagccaagagtgt

SEQ ID NO: 67094 - DNA, 201 bp, Homo sapiens
caatatcccttctgtcttccctgtgagatcctggttccttctctcttgagcactattgccctgtcactcaccaactcctaaccctcttgaggaaggagggraagcccaggctgacaggagggcttgggtgggggctcttgcagacagtgaccgtgaaggaggaccaggtgatgcagcagaacccacccaagttcgacaaaa

SEQ ID NO: 67095 - DNA, 201 bp, Homo sapiens
accaactttgctacttgccttttccttccagaggctgacaagtctgcctacctcatggggctgaactcagccgacctgctcaaggggctgtgccaccctcdggtgaaagtgggcaatgagtacgtcaccaaggggcagaatgtccagcaggtgggtccatcttcagatgataatgggtgggcagggtagggagactggcat

SEQ ID NO: 67096 - DNA, 201 bp, Homo sapiens
cttctgctcactccaggcacagccatgggagattcggagatggcagtctttggggctgccgccccctacctgcgcaagtcagagaaggagcggctagaagygcagaccaggccttttgacctcaagaaggatgtcttcgtgcctgatgacaaacaggagtttgtcaaggccaagatcgtgtctcgagagggtggcaaagtc

SEQ ID NO: 67097 - DNA, 201 bp, Homo sapiens; identical to SEQ ID NO: 14292

SEQ ID NO: 67098 - DNA, 201 bp, Homo sapiens
cttttgacctcaagaaggatgtcttcgtgcctgatgacaaacaggagtttgtcaaggccaagatcgtgtctcgagagggtggcaaagtcactgccgagacygagtatggcaaggtgggtgtcaggctgatgtgagagtccaccctggccacctgtacacctgggtggacagagaggggtacacccatgccccatgcccatg

SEQ ID NO: 67099 - DNA, 201 bp, Homo sapiens
cacgagcaagtatattgaccatagagcagaatccatgtccacctgtgtgaaggacactcagtgatgctctctcctgcttcctcagcccatgggcatcatgyccatcctggaagaggagtgcatgttccccaaggccaccgacatgaccttcaaggccaagctgtttgacaaccacctgggcaaatccgccaacttccagaa

SEQ ID NO: 67100 - DNA, 201 bp, Homo sapiens
ggtgatggacaaccccctggtcatgcaccagctgcgctgcaatggtgtgctggagggcatccgcatctgcaggaaaggcttccccaaccgcatcctctacrgggacttccggcagaggtgggtatgagggtgcaccagagctcatagaacagggggagccaggctgccctgatgggaatgggatctgcaggtgaccctgga

SEQ ID NO: 67101 - DNA, 201 bp, Homo sapiens
ccttttctaggctgttacccttcctaaggtaatccccaccatctctttccctcgtacccctccctagtcatggccaacacacaccttgcctgcaggtgttsttcaaggccgggctgctggggctgctggaggaaatgagggacgagaggctgagccgcatcatcacgcgtatccaggcccagtcccgaggtgtgctcgcca

SEQ ID NO: 67102 - DNA, 201 bp, Homo sapiens
gctgttacccttcctaaggtaatccccaccatctctttccctcgtacccctccctagtcatggccaacacacaccttgcctgcaggtgttcttcaaggccrggctgctggggctgctggaggaaatgagggacgagaggctgagccgcatcatcacgcgtatccaggcccagtcccgaggtgtgctcgccagaatggagta

SEQ ID NO: 67103 - DNA, 201 bp, Homo sapiens
aagcagctggaggccgagaagatggagctgcagtcagccctggaggaggccgaggtgtgtgtgtgtgcagggcacggggtgcagggagctgagctccaggmttttggtccctgttctcatcccccgctttgtcgttttgttcactgtcccatccccagagcctaggacagagcctggcacatagtaggcattcagtgaaga

SEQ ID NO: 67104 - DNA, 201 bp, Homo sapiens
tatccatgattagtgagcaggcccccaccctgccctgtgccctgactgtctgcctgcatcccctcccccaaccccttcccaggcctccctggagcacgagragggcaagatcctccgggcccagctggagttcaaccagatcaaggcagagatcgagcggaagctggcagagaaggacgaggagatggaacaggccaagcg

SEQ ID NO: 67105 - DNA, 201 bp, Homo sapiens
ccctgctgcccttcctcctccccagcccataacagtacaagcagacccaagacagccatcctctgaggcaacaacctcacgcagcctccacaagtggaggygcaaaccatgggaaaaggcctcccaggcaagggctttcctcccctagtcccagatatcagggttagttagatggtcctccctggcaaaaagtccattgta

SEQ ID NO: 67106 - DNA, 201 bp, Homo sapiens
ggtaatccagtggaacattcgggccttcatgggggtcaagaattggccctggatgaagctctacttcaagatcaagccgctgctgaagagtgcagaaagavagaaggagatggcctccatgaaggaggagttcacacgcctcaaagaggcgctagagaagtccgaggctcgccgcaaggagctggaggagaagatggtgtc

SEQ ID NO: 67107 - DNA, 201 bp, Homo sapiens
gaatgacaagcagcagctggatgagcggctgaaaaagtactgtgtcccctccctgctgcccttcctcctccccagcccataacagtacaagcagacccaakacagccatcctctgaggcaacaacctcacgcagcctccacaagtggaggcgcaaaccatgggaaaaggcctcccaggcaagggctttcctcccctagtcc

SEQ ID NO: 67108 - DNA, 201 bp, Homo sapiens
cttacccatcatacttctttttctggggtccgccaatatggggcctccctacagaacgcttttgatgtgctgggcttcacttcagaggagaaaaactccaygtataagctgacaggcgccatcatgcactttggaaacatgaagttcaagctgaagcagcgggaggagcaggcggagccagacggcactgaaggtgggagg

SEQ ID NO: 67109 - DNA, 201 bp, Homo sapiens
tagatgagggtcagagatggaaatagttagatttctgctcctacagggagctcagaatgctcttccttcccctaggagagccccagcttgaacaatagttwgttgttccttttaccctggcaggtttgctaggctgctcctctggttaaggggtaacctcaaagaggaagggactcactggtaactcctcttgactcttga

SEQ ID NO: 67110 - DNA, 201 bp, Homo sapiens
aaaatggggacaggatggaaaagaagtctctttagagtcatcagacttgcattcaagtcttggctctcccacttgttgtcatgggctcttggccaagcaasccatttaacctcgatttcctcatctgtcaaatggggtgaagactgagtaggagaaagtgcattgaagtgcttttagactggaaagtgccgaacaaatgtg

SEQ ID NO: 67111 - DNA, 201 bp, Homo sapiens
ccacagtgtcttctctctgagaatgtccacaaagtctgacaacaaaatggggacaggatggaaaagaagtctctttagagtcatcagacttgcattcaagycttggctctcccacttgttgtcatgggctcttggccaagcaagccatttaacctcgatttcctcatctgtcaaatggggtgaagactgagtaggagaaag

SEQ ID NO: 67112 - DNA, 201 bp, Homo sapiens
ggcatgtgctaccatgtctagctaatttttatattttagtagagatgcggtttcaccatgttggccaggctggtcttgaactcctgaccttgtgatccacycgcctcagcctcccaaagtacgggattacaggcgtgagccaccactcccagctcagctctaagtttcagtggttctgggaatttcagccttagggagggg

SEQ ID NO: 67113 - DNA, 201 bp, Homo sapiens
gaaggagcggctagaagcgcagaccaggccttttgacctcaagaaggatgtcttcgtgcctgatgacaaacaggagtttgtcaaggccaagatcgtgtctygagagggtggcaaagtcactgccgagactgagtatggcaaggtgggtgtcaggctgatgtgagagtccaccctggccacctgtacacctgggtggacaga

SEQ ID NO: 67114 - DNA, 201 bp, Homo sapiens
cctcagcctcccaagtagctgggattataggcatgtgctaccatgtctagctaatttttatattttagtagagatgcggtttcaccatgttggccaggctrgtcttgaactcctgaccttgtgatccactcgcctcagcctcccaaagtacgggattacaggcgtgagccaccactcccagctcagctctaagtttcagtg

SEQ ID NO: 67115 - DNA, 201 bp, Homo sapiens
cttacgtggcacacatcctgaaatgtgcacatttgctgttgaggcatatatggcaccctggggttggggtgcggattgaggtatgggaaggaagcctgtcytcatgtgagaggcatgcccaagcagcaggcatgagtgttcatcagagggcttgtggagggtgtttggctatgtgatgggtgtgtctgtgagaggaagccc

SEQ ID NO: 67116 - DNA, 201 bp, Homo sapiens
cgacaaaatcgaggacatggccatgctgaccttcctgcatgagcccgcggtgctctacaacctcaaggatcgctacggctcctggatgatctacgtgagtsctgcacctggccctacgttgggatctctgttcttgctccatccatgtccaccccaggagccaagagtgtcttctgtttgtgtctaggcagggttacactc

SEQ ID NO: 67117 - DNA, 201 bp, Homo sapiens
caatatcaaggggaagcctgaagcccacttctccctgatccactatgccggcatcgtggactacaacatcattggctggctgcagaagaacaaggatcctstcaatgagactgtcgtgggcttgtatcagaagtcttccctcaagctgctcagcaccctgtttgccaactatgctggggctgatgcgcgtaagtagggact

SEQ ID NO: 67118 - DNA, 201 bp, Homo sapiens
tctaggaagtgtgtatgccttcatgtgattctgtgaggcctggaatgtgtagctacccctgtccatgcatgcagaggttcttgtctatgcctccacgagtmatgactgttatagtatctgtaccctctgcagaaggaactcacaggcacgggggtgtaggatgttccaggtctttgtgtactgaagaacacgcagtgatgt

SEQ ID NO: 67119 - DNA, 201 bp, Homo sapiens
cttcagaggagaaaaactccatgtataagctgacaggcgccatcatgcactttggaaacatgaagttcaagctgaagcagcgggaggagcaggcggagccrgacggcactgaaggtgggaggcagggattcttgggggcagctgtcaagtcatggagggccatgtctgctcagcagtcatctctcttctcttttttctttt

SEQ ID NO: 67120 - DNA, 201 bp, Homo sapiens
gccagacggcactgaaggtgggaggcagggattcttgggggcagctgtcaagtcatggagggccatgtctgctcagcagtcatctctcttctcttttttctttttttttttttttgagatggagtcttgctctgttgcccaggctggagcgcagtggcacgatcttggctcactgccacctccacatcctgggttcaagtg

SEQ ID NO: 67121 - DNA, 201 bp, Homo sapiens
gacaaccacctgggcaaatccgccaacttccagaagccacgcaatatcaaggggaagcctgaagcccacttctccctgatccactatgccggcatcgtggwctacaacatcattggctggctgcagaagaacaaggatcctctcaatgagactgtcgtgggcttgtatcagaagtcttccctcaagctgctcagcaccctg

SEQ ID NO: 67122 - DNA, 201 bp, Homo sapiens
atcaaggggaagcctgaagcccacttctccctgatccactatgccggcatcgtggactacaacatcattggctggctgcagaagaacaaggatcctctcartgagactgtcgtgggcttgtatcagaagtcttccctcaagctgctcagcaccctgtttgccaactatgctggggctgatgcgcgtaagtagggactgagg

SEQ ID NO: 67123 - DNA, 201 bp, Homo sapiens
ccgcttcgtgagtggtccctgaccttggccttgggacttggactggtggaggaatggtctcagatatgagccttcccccaactcatcaccactctcttccmtctctccaggggaaattcattcgaattcattttggggcaacaggaaagttggcatctgcagacatagagacctgtgagtgccatgaatctgctaggctca

SEQ ID NO: 67124 - DNA, 201 bp, Homo sapiens
gtacctccctctcagcgctaccttgcacttgcagtgtgtaatgagggtgatgtgtaaggcactctgatggacattacctcatcagtggccctacaaccccytggatagctggttgtccaagacagaatcttagttcaactttaaatttacctgcagaaccacttaatcccccaatgagacatattcaaattgttaatccat

SEQ ID NO: 67125 - DNA, 201 bp, Homo sapiens
ggcctgagggctagaggaggaggtggggatagagaggagtgctgatctagaatggtgcttccccaggtgagctgtcccggcagctggatgagaaggaggcrctgatctcccagctgacccgaggcaagctcacctacacccagcagctggaggacctcaagaggcagctggaggaggaggttaaggtaagggctagactcg

SEQ ID NO: 67126 - DNA, 201 bp, Homo sapiens
agggtgtgctgggggcccaagaggctggggaggggctgcactggcagtgttcccatatggtgccacccaagggctccaagaggcgtctgggcaaagaggcrtgtccctccaactccactggacctcagcagccctcaaccgagttaccgtgttccccacacagaggagatctccgacttgactgagcagttgggttccagc

SEQ ID NO: 67127 - DNA, 201 bp, Homo sapiens
ctggtctccagtagtattgttcactgcccaataagcccctgtcttcacagcggagaatccggagcagggaagacagtcaacaccaagagggtcatccagtmctttgctgttattgcagccattggggaccgcagcaagaaggaccagagcccgggcaaggtaggcctgctgccctccaaggtcctgtaccgcagaaaggga

SEQ ID NO: 67128 - DNA, 201 bp, Homo sapiens
atcaagccgctgctgaagagtgcagaaagagagaaggagatggcctccatgaaggaggagttcacacgcctcaaagaggcgctagagaagtccgaggctcrccgcaaggagctggaggagaagatggtgtccctgctgcaggagaagaatgacctgcagctccaagtgcaggcggtgaggctcctgggctactgttggctc

SEQ ID NO: 67129 - DNA, 201 bp, Homo sapiens
aacccagaacttcagtccagtgttctcacagactcctcctacttccttcttgccacaggggtgatggacaaccccctggtcatgcaccagctgcgctgcartggtgtgctggagggcatccgcatctgcaggaaaggcttccccaaccgcatcctctacggggacttccggcagaggtgggtatgagggtgcaccagagct

SEQ ID NO: 67130 - DNA, 201 bp, Homo sapiens
ctgcagaaggaactcacaggcacgggggtgtaggatgttccaggtctttgtgtactgaagaacacgcagtgatgtgatctacttacgtggcacacatcctsaaatgtgcacatttgctgttgaggcatatatggcaccctggggttggggtgcggattgaggtatgggaaggaagcctgtcttcatgtgagaggcatgccc

SEQ ID NO: 67131 - DNA, 201 bp, Homo sapiens
aagcttcatgcaggacttcatgcagagtaccaggtccagtcactgggcacacatgtgcaggtctaaacatgggcgtatgtgccacaggagttcctaggggmagatatctgcatctgagcatatgggaccaatatgcattacagggtgtgtgtgtgtgtgtgtgtgtgtgtgtgtgtggacaagcctgcatagtctgaatgt

SEQ ID NO: 67132 - DNA, 201 bp, Homo sapiens
tgccggcatcgtggactacaacatcattggctggctgcagaagaacaaggatcctctcaatgagactgtcgtgggcttgtatcagaagtcttccctcaagytgctcagcaccctgtttgccaactatgctggggctgatgcgcgtaagtagggactgaggctcccggtacagaggagcagggattctgccaaggttctgag

SEQ ID NO: 67133 - DNA, 201 bp, Homo sapiens
gatggcagtctttggggctgccgccccctacctgcgcaagtcagagaaggagcggctagaagcgcagaccaggccttttgacctcaagaaggatgtcttcrtgcctgatgacaaacaggagtttgtcaaggccaagatcgtgtctcgagagggtggcaaagtcactgccgagactgagtatggcaaggtgggtgtcaggct

SEQ ID NO: 67134 - DNA, 201 bp, Homo sapiens
cccaaaacagcccaggcccatctcccctgtttactttgcccagccaagcacaggctcagcctgcccaaaccagtgccttctggtggcatccttcctggtgycagccctgacctctgtgcatcagaagacagttgtggattttgggtgtagataacctggcagcttcttgcccagggctcctactctcgggtaggcccaggc

SEQ ID NO: 67135 - DNA, 201 bp, Homo sapiens
tttttctggggtccgccaatatggggcctccctacagaacgcttttgatgtgctgggcttcacttcagaggagaaaaactccatgtataagctgacaggcrccatcatgcactttggaaacatgaagttcaagctgaagcagcgggaggagcaggcggagccagacggcactgaaggtgggaggcagggattcttgggggc

SEQ ID NO: 67136 - DNA, 201 bp, Homo sapiens
tgctaagattacaagctaatcagtgacaaagccaggatcagaacccagaacttcagtccagtgttctcacagactcctcctacttccttcttgccacaggsgtgatggacaaccccctggtcatgcaccagctgcgctgcaatggtgtgctggagggcatccgcatctgcaggaaaggcttccccaaccgcatcctctacg

SEQ ID NO: 67137 - DNA, 201 bp, Homo sapiens
acggggacttccggcagaggtgggtatgagggtgcaccagagctcatagaacagggggagccaggctgccctgatgggaatgggatctgcaggtgaccctrgaattctatgggcagagcagatcactgcagagcatgggtgactctggacacttccctcctcaggtatcgcatcctgaacccagcggccatccctgaggga

SEQ ID NO: 67138 - DNA, 201 bp, Homo sapiens
tcactgcagagcatgggtgactctggacacttccctcctcaggtatcgcatcctgaacccagcggccatccctgagggacagttcattgatagcaggaagrgggcagagaagctgctcagctccctggacattgatcacaaccagtacaagtttggccacaccaaggtgaggaaaggagactaattaattaaaggaagaca

SEQ ID NO: 67139 - DNA, 201 bp, Homo sapiens
gtacccctccctagtcatggccaacacacaccttgcctgcaggtgttcttcaaggccgggctgctggggctgctggaggaaatgagggacgagaggctgarccgcatcatcacgcgtatccaggcccagtcccgaggtgtgctcgccagaatggagtacaaaaagctgctggaacgtaggtgagagatctcaagaggaggt

SEQ ID NO: 67140 - DNA, 201 bp, Homo sapiens
caagaattggccctggatgaagctctacttcaagatcaagccgctgctgaagagtgcagaaagagagaaggagatggcctccatgaaggaggagttcacasgcctcaaagaggcgctagagaagtccgaggctcgccgcaaggagctggaggagaagatggtgtccctgctgcaggagaagaatgacctgcagctccaagt

SEQ ID NO: 67141 - DNA, 201 bp, Homo sapiens
aagaattggccctggatgaagctctacttcaagatcaagccgctgctgaagagtgcagaaagagagaaggagatggcctccatgaaggaggagttcacacscctcaaagaggcgctagagaagtccgaggctcgccgcaaggagctggaggagaagatggtgtccctgctgcaggagaagaatgacctgcagctccaagtg

SEQ ID NO: 67142 - DNA, 201 bp, Homo sapiens
aagccgctgctgaagagtgcagaaagagagaaggagatggcctccatgaaggaggagttcacacgcctcaaagaggcgctagagaagtccgaggctcgccrcaaggagctggaggagaagatggtgtccctgctgcaggagaagaatgacctgcagctccaagtgcaggcggtgaggctcctgggctactgttggctcttc

SEQ ID NO: 67143 - DNA, 201 bp, Homo sapiens
gcctctgcagggcaccctggaggaccagatcatccaggccaaccctgctctggaggcctttggcaatgccaagaccgtccggaacgacaactcctcccgcytcgtgagtggtccctgaccttggccttgggacttggactggtggaggaatggtctcagatatgagccttcccccaactcatcaccactctcttccatctc

SEQ ID NO: 67144 - DNA, 201 bp, Homo sapiens
acagcctcccctctgttcctcaccttcaggaacaagacaacctggcagatgctgaggagcgctgtgatcagctgatcaaaaacaagattcagctggaggcyaaggtgaaggagatgaacgagaggctggaggatgaggaggagatgaatgctgagctcactgccaagaagcgcaagctggaagatgagtgctcagagctca

SEQ ID NO: 67145 - DNA, 201 bp, Homo sapiens
atgccggcatcgtggactacaacatcattggctggctgcagaagaacaaggatcctctcaatgagactgtcgtgggcttgtatcagaagtcttccctcaasctgctcagcaccctgtttgccaactatgctggggctgatgcgcgtaagtagggactgaggctcccggtacagaggagcagggattctgccaaggttctga

SEQ ID NO: 67146 - DNA, 201 bp, Homo sapiens
caacctggcagatgctgaggagcgctgtgatcagctgatcaaaaacaagattcagctggaggccaaggtgaaggagatgaacgagaggctggaggatgagraggagatgaatgctgagctcactgccaagaagcgcaagctggaagatgagtgctcagagctcaaaagggacatcgatgatctggagctgacactggccaa

SEQ ID NO: 67147 - DNA, 201 bp, Homo sapiens
ttggggctcccactgaaggggagagcccagggagggaagggaagaatgggcagatgggagggcagccagcttctgctcactccaggcacagccatgggagmttcggagatggcagtctttggggctgccgccccctacctgcgcaagtcagagaaggagcggctagaagcgcagaccaggccttttgacctcaagaaggat

SEQ ID NO: 67148 - DNA, 201 bp, Homo sapiens
tcaaaaacaagattcagctggaggccaaggtgaaggagatgaacgagaggctggaggatgaggaggagatgaatgctgagctcactgccaagaagcgcaasctggaagatgagtgctcagagctcaaaagggacatcgatgatctggagctgacactggccaaagtggagaaggagaaacacgcaacagagaacaaggtaa

SEQ ID NO: 67149 - DNA, 201 bp, Homo sapiens
ctctttccctcgtacccctccctagtcatggccaacacacaccttgcctgcaggtgttcttcaaggccgggctgctggggctgctggaggaaatgagggasgagaggctgagccgcatcatcacgcgtatccaggcccagtcccgaggtgtgctcgccagaatggagtacaaaaagctgctggaacgtaggtgagagatct

SEQ ID NO: 67150 - DNA, 201 bp, Homo sapiens
tctctttccctcgtacccctccctagtcatggccaacacacaccttgcctgcaggtgttcttcaaggccgggctgctggggctgctggaggaaatgagggrcgagaggctgagccgcatcatcacgcgtatccaggcccagtcccgaggtgtgctcgccagaatggagtacaaaaagctgctggaacgtaggtgagagatc

SEQ ID NO: 67151 - DNA, 201 bp, Homo sapiens
catggccaacacacaccttgcctgcaggtgttcttcaaggccgggctgctggggctgctggaggaaatgagggacgagaggctgagccgcatcatcacgcrtatccaggcccagtcccgaggtgtgctcgccagaatggagtacaaaaagctgctggaacgtaggtgagagatctcaagaggaggtttcccgcttctctga

SEQ ID NO: 67152 - DNA, 201 bp, Homo sapiens
tggaagaggagtgcatgttccccaaggccaccgacatgaccttcaaggccaagctgtttgacaaccacctgggcaaatccgccaacttccagaagccacgmaatatcaaggggaagcctgaagcccacttctccctgatccactatgccggcatcgtggactacaacatcattggctggctgcagaagaacaaggatcctc

SEQ ID NO: 67153 - DNA, 201 bp, Homo sapiens
cgggccttcatgggggtcaagaattggccctggatgaagctctacttcaagatcaagccgctgctgaagagtgcagaaagagagaaggagatggcctccaygaaggaggagttcacacgcctcaaagaggcgctagagaagtccgaggctcgccgcaaggagctggaggagaagatggtgtccctgctgcaggagaagaat

SEQ ID NO: 67154 - DNA, 201 bp, Homo sapiens
tacagaacgcttttgatgtgctgggcttcacttcagaggagaaaaactccatgtataagctgacaggcgccatcatgcactttggaaacatgaagttcaarctgaagcagcgggaggagcaggcggagccagacggcactgaaggtgggaggcagggattcttgggggcagctgtcaagtcatggagggccatgtctgctc

SEQ ID NO: 67155 - DNA, 201 bp, Homo sapiens
ctctgccttagttgggtgacctctgggagcccactccagatctctgggtctccatgccctcccctgttacatggaggtttttaagagtccttcgactctgmtggcatgactttcctccttactctagagcagaagctgtgttaggtctttagttgtctggtcagacaaatacggctctctcattttcaacttttgttattt

SEQ ID NO: 67156 - DNA, 201 bp, Homo sapiens
catacctcccggttcccacctctgcctccctctgttttcttttatactctatacctgattgcctctgtttccttggcaacacttttctcttcattttcctycttgtcttcatagctggctctcccctgtgagggcctgaatcactttctcttaggcttatttttattttctcttagattctcttttcctccaccttctgct

SEQ ID NO: 67157 - DNA, 201 bp, Homo sapiens
ctgcatcccctcccccaaccccttcccaggcctccctggagcacgaggagggcaagatcctccgggcccagctggagttcaaccagatcaaggcagagatygagcggaagctggcagagaaggacgaggagatggaacaggccaagcgcaaccacctgcgggtggtggactcgctgcagacctccctggacgcagagacac

SEQ ID NO: 67158 - DNA, 201 bp, Homo sapiens
atattgaccatagagcagaatccatgtccacctgtgtgaaggacactcagtgatgctctctcctgcttcctcagcccatgggcatcatgtccatcctggargaggagtgcatgttccccaaggccaccgacatgaccttcaaggccaagctgtttgacaaccacctgggcaaatccgccaacttccagaagccacgcaata

SEQ ID NO: 67159 - DNA, 201 bp, Homo sapiens
caaaaacaagattcagctggaggccaaggtgaaggagatgaacgagaggctggaggatgaggaggagatgaatgctgagctcactgccaagaagcgcaagytggaagatgagtgctcagagctcaaaagggacatcgatgatctggagctgacactggccaaagtggagaaggagaaacacgcaacagagaacaaggtaag

SEQ ID NO: 67160 - DNA, 201 bp, Homo sapiens
aggtccactgggggtttggacatagatgaggccaagggatgatgttgagattggggtgaggagaagggcaagggtggggttgctttatggagaaagctgarcccacctcctggtgcccacccctccccaggcgaagaacgccctggcccacgcactgcagtcggcccggcatgactgcgacctgctgcgggagcagtacga

SEQ ID NO: 67161 - DNA, 201 bp, Homo sapiens
agatcgaggacttgatggtggacgtagagcgctccaatgctgctgctgcagccctggacaagaagcagaggaacttcgacaaggtgggccctgggtggggsccgcagccagcatgcagggcaagggggcatgaggggttcagtgagaggccagagccatcctccttggaggtgggggaggagggctgagcccaggcaggtc

SEQ ID NO: 67162 - DNA, 201 bp, Homo sapiens; identical to SEQ ID NO: 14344

SEQ ID NO: 67163 - DNA, 201 bp, Homo sapiens
ggggttcagtgagaggccagagccatcctccttggaggtgggggaggagggctgagcccaggcaggtcctgagacagaccctggacatggggctgaggctkgggggctgaagagtgagccttgtccccgggcagatcctggccgagtggaagcagaagtatgaggagtcgcagtcggagctggagtcctcgcagaaggagg

SEQ ID NO: 67164 - DNA, 201 bp, Homo sapiens
ttgtgatccactcgcctcagcctcccaaagtacgggattacaggcgtgagccaccactcccagctcagctctaagtttcagtggttctgggaatttcagcsttagggaggggtgccaccctagaagaccctaatttatatacaaccagtatatcccagtttccccccaactgctagtttccagttcccttccacctaattt

SEQ ID NO: 67165 - DNA, 201 bp, Homo sapiens
actctttcctggtacagatcatttaaaatatttacacatatttggtaagaaattataaggagaattcaagtgtttagtgaggatcagaaagtagaattggstcaggatatcagatgaagcagggcagggcggaggggatgctaccttctatgactgtgccatcttcaccccctgcctaccctctggcccccagacggagga

SEQ ID NO: 67166 - DNA, 201 bp, Homo sapiens
ccatcctccttggaggtgggggaggagggctgagcccaggcaggtcctgagacagaccctggacatggggctgaggctggggggctgaagagtgagccttstccccgggcagatcctggccgagtggaagcagaagtatgaggagtcgcagtcggagctggagtcctcgcagaaggaggctcgctccctcagcacagagct

SEQ ID NO: 67167 - DNA, 201 bp, Homo sapiens
tggaggccgagaagatggagctgcagtcagccctggaggaggccgaggtgtgtgtgtgtgcagggcacggggtgcagggagctgagctccaggcttttggsccctgttctcatcccccgctttgtcgttttgttcactgtcccatccccagagcctaggacagagcctggcacatagtaggcattcagtgaagatttgtgg

SEQ ID NO: 67168 - DNA, 201 bp, Homo sapiens
gctggctccctgctcatgcccactctcctgatcctcaggacacccagattcagctggacgatgcagtccgtgccaacgacgacctgaaggagaacatcgcmatcgtggagcggcgcaacaacctgctgcaggctgagctggaggagttgcgtgccgtggtggagcagacagagcggtcccggaagctggcggagcaggagc

SEQ ID NO: 67169 - DNA, 201 bp, Homo sapiens
tttgggctttgctagtcacccccacagcaggcatacccagacagagcaccctcaaacccgggatgcttccttttcatttattccacacacttgagccacayggccccagaggccaaggtaatgcagttctctgtgatttcaaggattcttccagctctaactttttttttttttttttttgagacggtgtctcactctgcc

SEQ ID NO: 67170 - DNA, 201 bp, Homo sapiens
gatgcttccttttcatttattccacacacttgagccacatggccccagaggccaaggtaatgcagttctctgtgatttcaaggattcttccagctctaactttttttttttttttttttgagacggtgtctcactctgccgcccaggctggagtgcagtggcacaatctcagctcactgcaacctctgcctcctgggttct

SEQ ID NO: 67171 - DNA, 201 bp, Homo sapiens
atgcttccttttcatttattccacacacttgagccacatggccccagaggccaaggtaatgcagttctctgtgatttcaaggattcttccagctctaactttttttttttttttttttgagacggtgtctcactctgccgcccaggctggagtgcagtggcacaatctcagctcactgcaacctctgcctcctgggttctc

SEQ ID NO: 67172 - DNA, 201 bp, Homo sapiens
tcttacctgtatgctacccctcccagtggaacatctagcaccactcccctcatcccagctccagctgccattgacctcctccctgcaatccttttctaggmtgttacccttcctaaggtaatccccaccatctctttccctcgtacccctccctagtcatggccaacacacaccttgcctgcaggtgttcttcaaggccgg

SEQ ID NO: 67173 - DNA, 201 bp, Homo sapiens
actcctcctacttccttcttgccacaggggtgatggacaaccccctggtcatgcaccagctgcgctgcaatggtgtgctggagggcatccgcatctgcagkaaaggcttccccaaccgcatcctctacggggacttccggcagaggtgggtatgagggtgcaccagagctcatagaacagggggagccaggctgccctgat

SEQ ID NO: 67174 - DNA, 201 bp, Homo sapiens
ttgtgctgagcacccaggacagggtggcaccagggacagctgatttcccaggggcttgaaagtggacacatggaggatgggcacctgcatgatgacctccyacacctgcatgtttattgggcctggtttatgcatccaaggatcaggaagtgtgagggtggtgtaggggatcataagagtgcacctattttcaaccctagc

SEQ ID NO: 67175 - DNA, 201 bp, Homo sapiens
gccagaatgtgccctgtgatcagggtgtactggggaatggatgaggtgagacaggactggccagtatctggtgttctatcaaaccaggaagagctgaaagscatgagacagagagacacacaagccaagaaacaagcatcaccgagggagcaggacgaggagggaaggccatgcagacggcatggggctggaggggctgtt

SEQ ID NO: 67176 - DNA, 201 bp, Homo sapiens
aatctgaacaagctgatgaccaacttgcgctccacccatccccactttgtacgttgtatcatccctaatgagacaaagtctccaggtgaggccacaaactmaggccaacccactgctgggcatacaccgccctgggaacaggacctcctaggacatctccctacctaccaccacagtggtttccaaaccacattcttctcc

SEQ ID NO: 67177 - DNA, 201 bp, Homo sapiens
agccagaatgtgccctgtgatcagggtgtactggggaatggatgaggtgagacaggactggccagtatctggtgttctatcaaaccaggaagagctgaaasccatgagacagagagacacacaagccaagaaacaagcatcaccgagggagcaggacgaggagggaaggccatgcagacggcatggggctggaggggctgt

SEQ ID NO: 67178 - DNA, 201 bp, Homo sapiens
ctggcattactcagattgagtgcatgcagaggttttcctttctcttctttctctcctgggatctttctctaactcccaaaatcaccagccctcccccttcrcaactggcaagtcactgctccttttctatccccagacctactcgggcctcttctgtgtcaccgtcaacccttacaagtggctgccggtgtacactcctga

SEQ ID NO: 67179 - DNA, 201 bp, Homo sapiens
agcgctccaatgctgctgctgcagccctggacaagaagcagaggaacttcgacaaggtgggccctgggtgggggccgcagccagcatgcagggcaaggggrcatgaggggttcagtgagaggccagagccatcctccttggaggtgggggaggagggctgagcccaggcaggtcctgagacagaccctggacatggggctg

SEQ ID NO: 67180 - DNA, 201 bp, Homo sapiens
caagctgtttgacaaccacctgggcaaatccgccaacttccagaagccacgcaatatcaaggggaagcctgaagcccacttctccctgatccactatgccsgcatcgtggactacaacatcattggctggctgcagaagaacaaggatcctctcaatgagactgtcgtgggcttgtatcagaagtcttccctcaagctgct

SEQ ID NO: 67181 - DNA, 201 bp, Homo sapiens
cggctgcaggacctggtagacaagctgcagctaaaggtcaaggcctacaagcgccaggccgaggaggcggtgagtgaccctgctggggactaggcccaggrgaggcataggagagctcgtcccccaagccaggagtctgagaacccaggccccctctcacctcatgctcccacctcccgcaggaggagcaagccaacacca

SEQ ID NO: 67182 - DNA, 201 bp, Homo sapiens
aggagctcatggccactgatgtgagtgtgtgaggacccagccagggggtgggaggattggcagtgaggggcaaacaggggtccaaaagcagagctaagackctggccattggttgtttaaagtggtatggacctcctgagagccagaatgtgccctgtgatcagggtgtactggggaatggatgaggtgagacaggactgg

SEQ ID NO: 67183 - DNA, 201 bp, Homo sapiens
ttgttcactgcccaataagcccctgtcttcacagcggagaatccggagcagggaagacagtcaacaccaagagggtcatccagtactttgctgttattgcrgccattggggaccgcagcaagaaggaccagagcccgggcaaggtaggcctgctgccctccaaggtcctgtaccgcagaaagggagggagaagagctctca

SEQ ID NO: 67184 - DNA, 201 bp, Homo sapiens
gatgaggaggagatgaatgctgagctcactgccaagaagcgcaagctggaagatgagtgctcagagctcaaaagggacatcgatgatctggagctgacackggccaaagtggagaaggagaaacacgcaacagagaacaaggtaagggcagctccctttggctccagcccgggtctcatcaggactctcagaccatactga

SEQ ID NO: 67185 - DNA, 201 bp, Homo sapiens
tgaggagcgctgtgatcagctgatcaaaaacaagattcagctggaggccaaggtgaaggagatgaacgagaggctggaggatgaggaggagatgaatgctragctcactgccaagaagcgcaagctggaagatgagtgctcagagctcaaaagggacatcgatgatctggagctgacactggccaaagtggagaaggagaa

SEQ ID NO: 67186 - DNA, 201 bp, Homo sapiens
ggagcagacagagcggtcccggaagctggcggagcaggagctgattgagactagtgagcgggtgcagctgctgcattcccaggtgagcagctcccctgctsattcctgaagggagcacaggctggggctcagcaagcaaggcttgagagctatgcatagatgctcaatgcttttcctgctctgcccaaccctcccccaacc

SEQ ID NO: 67187 - DNA, 201 bp, Homo sapiens
gcttcccatttccacatacctcccggttcccacctctgcctccctctgttttcttttatactctatacctgattgcctctgtttccttggcaacacttttytcttcattttcctccttgtcttcatagctggctctcccctgtgagggcctgaatcactttctcttaggcttatttttattttctcttagattctcttttc

SEQ ID NO: 67188 - DNA, 201 bp, Homo sapiens
ctgaaactcttcccctccccatacttctgaagctcttgccaagtggggatatcctagagttaccctcctatttgagtgatgtgcctctccttccctctacstgcaagaatgaggaccttaccccctgaacagcctcccctctgttcctcaccttcaggaacaagacaacctggcagatgctgaggagcgctgtgatcagct

SEQ ID NO: 67189 - DNA, 201 bp, Homo sapiens
cttgcgctccacccatccccactttgtacgttgtatcatccctaatgagacaaagtctccaggtgaggccacaaactcaggccaacccactgctgggcatwcaccgccctgggaacaggacctcctaggacatctccctacctaccaccacagtggtttccaaaccacattcttctcctcccatcccgcatgaggcctccc

SEQ ID NO: 67190 - DNA, 201 bp, Homo sapiens
tcacttcagaggagaaaaactccatgtataagctgacaggcgccatcatgcactttggaaacatgaagttcaagctgaagcagcgggaggagcaggcggarccagacggcactgaaggtgggaggcagggattcttgggggcagctgtcaagtcatggagggccatgtctgctcagcagtcatctctcttctcttttttct

SEQ ID NO: 67191 - DNA, 201 bp, Homo sapiens
cctcccggttcccacctctgcctccctctgttttcttttatactctatacctgattgcctctgtttccttggcaacacttttctcttcattttcctccttrtcttcatagctggctctcccctgtgagggcctgaatcactttctcttaggcttatttttattttctcttagattctcttttcctccaccttctgcttctt

SEQ ID NO: 67192 - DNA, 201 bp, Homo sapiens
cccatccccagagcctaggacagagcctggcacatagtaggcattcagtgaagatttgtggagtgaatgaatgaccagtcactgaactctcttcacataarcattttacccattgcatcttagctgagcttcccatttccacatacctcccggttcccacctctgcctccctctgttttcttttatactctatacctgatt

SEQ ID NO: 67193 - DNA, 201 bp, Homo sapiens
tcccatccccagagcctaggacagagcctggcacatagtaggcattcagtgaagatttgtggagtgaatgaatgaccagtcactgaactctcttcacataracattttacccattgcatcttagctgagcttcccatttccacatacctcccggttcccacctctgcctccctctgttttcttttatactctatacctgat

SEQ ID NO: 67194 - DNA, 201 bp, Homo sapiens
gaacatcgatccctggaaacacatgtgctgctgccacaggggcttccacctgcccacaaagcaggccccccaccatcagacccctctcacctttgttcccrtgccctgtccctgcccaataccatctctccaaggactgattggactttgtttcctttcaaaagggcttgaatgaggagtagctttgccacatcttgatct

SEQ ID NO: 67195 - DNA, 201 bp, Homo sapiens
agttcaacagctttgagcagctctgcatcaacttcaccaacgagaagctgcagcagttcttcaaccaccacatgtttgtgctggagcaggaggagtacaasaaggagggcatcgagtggacattcattgactttggcatggacctgcaggcctgcattgacctcatcgagaaggtgcctctttggccttaccacctgaatt

SEQ ID NO: 67196 - DNA, 201 bp, Homo sapiens
tctgaccaaccccagaaccctaccctccagaacttgccccccgaacatcgatccctggaaacacatgtgctgctgccacaggggcttccacctgcccacamagcaggccccccaccatcagacccctctcacctttgttcccatgccctgtccctgcccaataccatctctccaaggactgattggactttgtttcctttc

SEQ ID NO: 67197 - DNA, 201 bp, Homo sapiens
cactgatctcccagctgacccgaggcaagctcacctacacccagcagctggaggacctcaagaggcagctggaggaggaggttaaggtaagggctagactygggccacctggcccaagcaaggagcacactgactagccttgcatcaaatcacttcccttcccagcaataaggctggctgtggaccaacagttctccaaga

SEQ ID NO: 67198 - DNA, 201 bp, Homo sapiens
tccccaccctctgccaccctcccctgggcaggaagaagctggcccagcggctgcaggaagctgaggaggccgtggaggctgttaatgccaagtgctcctcrctggagaagaccaagcaccggctacagaatgagatcgaggacttgatggtggacgtagagcgctccaatgctgctgctgcagccctggacaagaagcaga

SEQ ID NO: 67199 - DNA, 201 bp, Homo sapiens
tagagcgctccaatgctgctgctgcagccctggacaagaagcagaggaacttcgacaaggtgggccctgggtgggggccgcagccagcatgcagggcaagrgggcatgaggggttcagtgagaggccagagccatcctccttggaggtgggggaggagggctgagcccaggcaggtcctgagacagaccctggacatgggg

SEQ ID NO: 67200 - DNA, 201 bp, Homo sapiens
tatgaggagtccctggaacatctggagaccttcaagcgggagaacaaaaacctgcagggtgtgctgggggcccaagaggctggggaggggctgcactggcmgtgttcccatatggtgccacccaagggctccaagaggcgtctgggcaaagaggcgtgtccctccaactccactggacctcagcagccctcaaccgagtta

SEQ ID NO: 67201 - DNA, 201 bp, Homo sapiens
ccgagcagatcgccctcaagggcggcaagaagcagctgcagaagctggaagcgcgggtgcgggagctggagaatgagctggaggccgagcagaagcgcaaygcagagtcggtgaagggcatgaggaagagcgagcggcgcatcaaggagctcacctaccaggtgcgacgggcggtgactccaggcagagccctggcaccat

SEQ ID NO: 67202 - DNA, 201 bp, Homo sapiens
gatcaagccgctgctgaagagtgcagaaagagagaaggagatggcctccatgaaggaggagttcacacgcctcaaagaggcgctagagaagtccgaggctbgccgcaaggagctggaggagaagatggtgtccctgctgcaggagaagaatgacctgcagctccaagtgcaggcggtgaggctcctgggctactgttggct

SEQ ID NO: 67203 - DNA, 201 bp, Homo sapiens
acagctgcctcccaacctggtgcctccatctccctgacccccggctcctggccagccttatgccagcccccagctcacccttcagtagcctccttccccargccctctggacacctctcctgcccgcagctgccccttcttcgtctcctactctgccttcttgctgcctctccacccggagacatttacagcaggtttcag

SEQ ID NO: 67204 - DNA, 201 bp, Homo sapiens
aaccgagctggtaacagctgcctcccaacctggtgcctccatctccctgacccccggctcctggccagccttatgccagcccccagctcacccttcagtakcctccttccccaagccctctggacacctctcctgcccgcagctgccccttcttcgtctcctactctgccttcttgctgcctctccacccggagacattta

SEQ ID NO: 67205 - DNA, 201 bp, Homo sapiens
tccaaggaggggaaggcaaagccctggcccctgcctgtgtccccttcttggcatgttccacatgctcggtcctgcaggccctgaccctcatcatcttcatytgcttcacggcctccatctctgcctacatggccgcggcgctactggagttcttcatcacacttgccttcctcttcctctatgccacccagtactaccagc

SEQ ID NO: 67206 - DNA, 201 bp, Homo sapiens
cctgttaaccctgcacccctggcccccaggacttcctgcgctgtgtcagtgccatcatcatcttcctggtggtctcctttgcagctgtgacctcccgggayggagctgccattgctgcttttgtgagttcagccctgcaggactccttagcccctcaagagctcaggctggtgcttgcacactttctgtatcagaagccac

SEQ ID NO: 67207 - DNA, 201 bp, Homo sapiens
tcctctctgcccctccccatgggtctctagggggctggtgcaggcagcagcagaggcactctgggcagctgggtgagggcccatctgggcaaggcccccakcgcctgccttctctcccggggccctgtgggcaagcctcctgcttcactttcaggtttctcgaagtgccttcttgctcctgtctgtttccccatcctgcca

SEQ ID NO: 67208 - DNA, 201 bp, Homo sapiens
gctgggcatacacccacgtcctctttctctatctctttgtcacaactccaatctcggcagccctgagagcagatggctttggagacaatcctttctatcaytgtttggtagcagagattcttccagcgcccgggaagctactgggtaagagcacctggcccttagaagtccacctctccagccggcctcagaggtctcccc

SEQ ID NO: 67209 - DNA, 201 bp, Homo sapiens
ttgaaagagggagtgagaaaacctttttcttttttgaccccagaaaagttagtgttgtcttctcccacaggtggccttggataagggctgctcccaattcygcctggccgtcctggactggaaccagagggccatggacttgtacaaggccctaggagcccaagatctgacggaagctgagggctggcacttcttctgctt

SEQ ID NO: 67210 - DNA, 201 bp, Homo sapiens
gctgaggctggggtgggagcaaagcaccccacagaccccactgttatcccctgtccccagagcccagccggtgtcattttctgatccccttcagctcaaasaatagctattttttgcctctttctctccacaacaggtcaagggattggttccaaaataatcaaaaaggtggctgaggtgaggagatgggtggggcgacaa

SEQ ID NO: 67211 - DNA, 201 bp, Homo sapiens
ctctctcagggccctgcgtggtgggctatgggatatactatttcatctacagtacatggaagggacgcaccatttatctggaggatatctatgtgatgccrgaatatcggggtactgggcagaagctgaggctggggtgggagcaaagcaccccacagaccccactgttatcccctgtccccagagcccagccggtgtcat

SEQ ID NO: 67212 - DNA, 201 bp, Homo sapiens; identical to SEQ ID NO: 52517

SEQ ID NO: 67213 - DNA, 201 bp, Homo sapiens
cctcaactccccaaccccacttcctctgcctgcccctcctcctccttccacgttgtctcctccacctagcagttggttggcaaccccttcctcagtcccckgctgaaaaccctccagtcagcgcttatcccttctgctctctcccctcacccagagaaatacatggagtttgaccttaatggaaatggcgatattggtgag

SEQ ID NO: 67214 - DNA, 201 bp, Homo sapiens; identical to SEQ ID NO: 52419

SEQ ID NO: 67215 - DNA, 201 bp, Homo sapiens
ccccacttcctctgcctgcccctcctcctccttccacgttgtctcctccacctagcagttggttggcaaccccttcctcagtcccctgctgaaaaccctcsagtcagcgcttatcccttctgctctctcccctcacccagagaaatacatggagtttgaccttaatggaaatggcgatattggtgagaaacgggtgatttg

SEQ ID NO: 67216 - DNA, 201 bp, Homo sapiens; identical to SEQ ID NO: 52420

SEQ ID NO: 67217 - DNA, 201 bp, Homo sapiens; identical to SEQ ID NO: 52519

SEQ ID NO: 67218 - DNA, 201 bp, Homo sapiens
ttgtggtagcaaaaggggaacctgcctttattgccctcctgccacactgcggtccctttcccgggcctgcctctctcagcatcccctctagctccttacamcctagcggggcccctcaactccccaaccccacttcctctgcctgcccctcctcctccttccacgttgtctcctccacctagcagttggttggcaacccct

SEQ ID NO: 67219 - DNA, 201 bp, Homo sapiens
agaggcctccagcttggtctgtctccccacctctaccagcatctgctgagctatgagccaaaccagggatttacagggtagggagggtgggataggcagcrgcattagatcggaggaatgagatggacagacctgggctgtgggctaggagggcagtcagctggcctagggtagcccgggctggtgtcagggtaaggagag

SEQ ID NO: 67220 - DNA, 201 bp, Homo sapiens; identical to SEQ ID NO: 52512

SEQ ID NO: 67221 - DNA, 201 bp, Homo sapiens
caccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactcta

SEQ ID NO: 67222 - DNA, 201 bp, Homo sapiens
ctttgcaaacattactattaattatagcaaatatatactttggacttaccatgtgcaagtctttgctaagggctttatgtgcattatttcatttaatcctrtaagattgatgatttgccaattttacagatgaaaaaacagacatagcagttaggggttggtggtgttttgtttgtttggagacagagtctctgtcgccca

SEQ ID NO: 67223 - DNA, 201 bp, Homo sapiens
attgcagcctcgacatcccaggctcaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattac

SEQ ID NO: 67224 - DNA, 201 bp, Homo sapiens
ctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgtt

SEQ ID NO: 67225 - DNA, 201 bp, Homo sapiens
atataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgat

SEQ ID NO: 67226 - DNA, 201 bp, Homo sapiens
agcaaatggagtccgagtggacagaaagacaagaccctgaccgtggggaatttaaaggccggccagcgtgcttccgaaggccgggggtggaggcattacckcctctccgtgccctcttctcttaacctgccctgggccaagggcctcggccccgcgaaactgcgagtcctccagaaagacacatcgctgttggggtgtcca

SEQ ID NO: 67227 - DNA, 201 bp, Homo sapiens
tcaagtccctgacttcctgcctggactccaaagccttcttattgactcctaggaatcaaggtaaggggttaaaatctcataaaacaggattaggactcacmaagtcttctggtgttacagggtgaaagaggctcgtgtgatgtcaccagagggatgtggctaagagctgtgatgtcacctgagggaggcaggatgggttct

SEQ ID NO: 67228 - DNA, 201 bp, Homo sapiens
acccgggaggtggagattgcagtgagccaagatcgcgccactgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctcgg

SEQ ID NO: 67229 - DNA, 201 bp, Homo sapiens
ttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctataagattgatgatttgccaattttacagatgaaaaaacagacat

SEQ ID NO: 67230 - DNA, 201 bp, Homo sapiens
taccagcgctttctcctctacagtgagtagggatacaaggcaggaagggttggagggaaacaagggagggcaggagaactcctcactctgggtcctatgayaccctcccaggaagagctaggtgcttccaggggttttgactggcctgaccccaccttgcccttccagatcgctcaccacatcctcccgaaaagtgtgtgg

SEQ ID NO: 67231 - DNA, 201 bp, Homo sapiens
tcaccacatcctcccgaaaagtgtgtggaggaattcaagtccctgacttcctgcctggactccaaagccttcttattgactcctaggaatcaaggtaaggkgttaaaatctcataaaacaggattaggactcaccaagtcttctggtgttacagggtgaaagaggctcgtgtgatgtcaccagagggatgtggctaagagc

SEQ ID NO: 67232 - DNA, 201 bp, Homo sapiens
gtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgag

SEQ ID NO: 67233 - DNA, 201 bp, Homo sapiens
tgaatgagacaggccagggttaccagcgctttctcctctacagtgagtagggatacaaggcaggaagggttggagggaaacaagggagggcaggagaactmctcactctgggtcctatgacaccctcccaggaagagctaggtgcttccaggggttttgactggcctgaccccaccttgcccttccagatcgctcaccaca

SEQ ID NO: 67234 - DNA, 201 bp, Homo sapiens
ttgccgccgtggctctaaggcctaccaccttcagaagtcgacctgtggcaaatgtggctacgctgccaagcgcaagagaaagtataactggagtgccaagkctaaaagacaaaataccaccggaactggtggaatgaggcacctaaaaattgtataccacagattcaggcatggattctatgaaggaacaatacttaaacc

SEQ ID NO: 67235 - DNA, 201 bp, Homo sapiens
acaatacttaaacccaagagggcagctgttgcagcatccagttcatcttaagaatgtctatgattagtcatgcaataaatgttctggttttaaaaaatacaaaaaaaaatactgaatgtttactcctgaaacttatgatgcctaggttgagaaagactcaattttcctcatgctaaatactttatacatgtcctttattca

SEQ ID NO: 67236 - DNA, 201 bp, Homo sapiens
ggtcttggccgcagaagccagatgacgaagggaacgtcattgtttggaaagcgtcgcaataagacgcacacgttgtgttgccgccgtggctctaaggcctrccaccttcagaagtcgacctgtggcaaatgtggctacgctgccaagcgcaagagaaagtataactggagtgccaaggctaaaagacaaaataccaccgga

SEQ ID NO: 67237 - DNA, 201 bp, Homo sapiens
agcgatcctcctgccttagcctcccaagtagctgggactacaggtgcatgccaccatgctaagttttgtatttcttttttgttttcctcgagacagtttcrttcttgtcgcccagactggagtgcaatggggcgatcttggctcactgcaacctacgcctcgcaggttcaagcgattctcctgcctcagcctctcaagtag

SEQ ID NO: 67238 - DNA, 201 bp, Homo sapiens
tgtgggtggcggggactggcagccgttctatctacctacttttctgtccacttgtctgtttacaaaggaaaaacaaaggtgacactggagaaaccgacacrtttgaggttctaaaaattaaacgagccacaatataaacagtctcacatcttggtacctcaccaaatgtcccctcattttttcctgtttttacgactttcg

SEQ ID NO: 67239 - DNA, 201 bp, Homo sapiens
cctcagcctcctgagtagctgggattacaggcgcgtacgaccatgcacagctaatttttatgttttagtagagacagggtttcaccatgttggccagggtkgtcttgaactcctgacctcaagtgatcctcccacgtcggcctcccacagtgctgggattacaggcatgagccaccatgcccgaccaatagttcatgtctt

SEQ ID NO: 67240 - DNA, 201 bp, Homo sapiens
ctgggctgtgggtggcggggactggcagccgttctatctacctacttttctgtccacttgtctgtttacaaaggaaaaacaaaggtgacactggagaaacsgacacgtttgaggttctaaaaattaaacgagccacaatataaacagtctcacatcttggtacctcaccaaatgtcccctcattttttcctgtttttacga

SEQ ID NO: 67241 - DNA, 201 bp, Homo sapiens
gtggcacggtcttggctcactgcagcctctacttcccaggctcaagcgatcctcctgccttagcctcccaagtagctgggactacaggtgcatgccaccakgctaagttttgtatttcttttttgttttcctcgagacagtttcattcttgtcgcccagactggagtgcaatggggcgatcttggctcactgcaacctacg

SEQ ID NO: 67242 - DNA, 201 bp, Homo sapiens
gggccttgggttggacaagcttgtggtgaactgtcttccaaagtggctgcagcatcttgcattctcaccagcagtgaacaagggttgctattgctccagaycctcaccagcatttggtgttgtcagtgtttggatgtttgccattctgataggtgtgtgtggcatctcattgttctagtttgcatttccctgctgacatat

SEQ ID NO: 67243 - DNA, 201 bp, Homo sapiens
ctcagctaatttttgcaattttaatttactttatttttaaatttaatttttgtatttttagtagagacagggtttcaccatgttggccaggatggtctctyttgaccttgtgatccactcgcctcggcctcccaaagttctgggattacgcaggtgtgagccaccgtacctggcccttttttttttatttttaagacaagg

SEQ ID NO: 67244 - DNA, 201 bp, Homo sapiens
tccctgtgtagcccaggctggtcttgaactcctgggtacaagcagtcctccctcgtgggcctcccaaagtgctgggattacaggcgtgggctcccgtgacyagcctggaacgtgctgatgagcctctttttctcctgaaaccccggtgggaacagatggtggatgcttccaaaagcatcgaagctgtccatgaggacatcc

SEQ ID NO: 67245 - DNA, 201 bp, Homo sapiens
cttccacgggagaggagaccctggcgtgtgtgtggcagaaaagacactgccaaggacctcgtgcctgtgtccggacccagctgctctgtgctgcaggcgtyctaggccgggggtctccaggggttctgtacatagactgtttgctcctggccagcaggcctgtagctgcgctgggagggcctccatggggcctgggctgtg

SEQ ID NO: 67246 - DNA, 201 bp, Homo sapiens
tgccttctacgcccctggcagattttctagaatttgctgtcccagaagcttgagaagggtccggtgccacccgacagcagaagccgggatgccgctgagaygccagcgcttctgagtccctctcactgcctgccttctggtggagagaaggctgtcctgcgggcttatgccctccccacgctcctcgcaccgttcacgcca

SEQ ID NO: 67247 - DNA, 201 bp, Homo sapiens
gcgtgtgtgtggcagaaaagacactgccaaggacctcgtgcctgtgtccggacccagctgctctgtgctgcaggcgttctaggccgggggtctccaggggytctgtacatagactgtttgctcctggccagcaggcctgtagctgcgctgggagggcctccatggggcctgggctgtgggtggcggggactggcagccgtt

SEQ ID NO: 67248 - DNA, 201 bp, Homo sapiens
ccacttgtctgtttacaaaggaaaaacaaaggtgacactggagaaaccgacacgtttgaggttctaaaaattaaacgagccacaatataaacagtctcacrtcttggtacctcaccaaatgtcccctcattttttcctgtttttacgactttcgaaacaaaaacctagactacactaagctttaactgttgggttctttct

SEQ ID NO: 67249 - DNA, 201 bp, Homo sapiens
tcccctcattttttcctgtttttacgactttcgaaacaaaaacctagactacactaagctttaactgttgggttctttcttggcagaatttttccctagaytggtgtaaacagccagacgtgggccttcccaaacccgacctggtcctgttcctccagttacagctggcggatgctgccaagcggggagcgtttggccatg

SEQ ID NO: 67250 - DNA, 201 bp, Homo sapiens
accacagtgtgccaggaggttcaggttggccttccagagcccggcctgtgtgaaatccccacgagcacagaggacagaacgaaacatggtgttgttttgaracagggtgttactgtgtcacccaggctggagtagagtggtgccacattttttgtagagacggggtgtccctgtgtagcccaggctggtcttgaactcctg

SEQ ID NO: 67251 - DNA, 201 bp, Homo sapiens
agaagagcaaacatttatgtagctagagattgtttcacagatagaaccatagttggtatttggattatattttccacacgcttttttttttttttttggggagacagtctctcattctgtcacccaggctggagtgcagtggcacgatctcagctcattgcaacctctgcctcctgagttcaagcgattatcctgcctcag

SEQ ID NO: 67252 - DNA, 201 bp, Homo sapiens
ccaggctggagtacagtggaacaagcaaagctcgctataacaactcttgggcccaagtgatcctcccgcttcagcctcccaaagtgctgggattacaggcdcgagccaccgtgcccggccacgccctcactttttaattctgccatttcttcatgtgttagcttgagtccttcccctctgaagtattacgttgtataataa

SEQ ID NO: 67253 - DNA, 201 bp, Homo sapiens
tgtggcctgcagtcacagcctttctggtcctacctttcctccggaaacaggacagcatttggagggagatgggatgagtaagggagggagagagggtgctsgcacagccctggcaagaagggccagtggatgagactaggctggcacataacaggctctaggagtgcctgtcttcttcctgctcttccacgggagaggaga

SEQ ID NO: 67254 - DNA, 201 bp, Homo sapiens
agagaagccgctgggggagctatggaagtgacccaaggctgcccactggagacgcctctccctgcagtcccccgagaggtgggagactcgcggaaggcccygtccccagcggagtccagaccccacaacttcaggagctctttcccggcagcagagatctgcaggctgcctcttctgccccggagctggggtgcactgggg

SEQ ID NO: 67255 - DNA, 201 bp, Homo sapiens
gcaggctggccgcctctgctcctcccgaccgcagcccctacctctctcccagactccagtcgcccgtgcccaccgctgcccacgtggcctctttccaggcrgcagccagggcttctggcacgtcgggcgccagcactgtcgcttgtggccacggcccgcggagcttcagtcccttgagctcctcctccagagcagggccga

SEQ ID NO: 67256 - DNA, 201 bp, Homo sapiens
cgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttc

SEQ ID NO: 67257 - DNA, 201 bp, Homo sapiens
ctgggggagctatggaagtgacccaaggctgcccactggagacgcctctccctgcagtcccccgagaggtgggagactcgcggaaggccccgtccccagcrgagtccagaccccacaacttcaggagctctttcccggcagcagagatctgcaggctgcctcttctgccccggagctggggtgcactggggacccccgtgg

SEQ ID NO: 67258 - DNA, 201 bp, Homo sapiens
agaggtgggagactcgcggaaggccccgtccccagcggagtccagaccccacaacttcaggagctctttcccggcagcagagatctgcaggctgcctcttytgccccggagctggggtgcactggggacccccgtggtggggaccttggcagtgtggacatgagcagagcgatggagcagtctcctgccctctcccctgtc

SEQ ID NO: 67259 - DNA, 201 bp, Homo sapiens
gggataattttctttttctttttttgagatggagtctcgctgtgtcacccaggctggaatgcagtggtgtgatctcggctcactgcaacctccacctcctrggttcaagcaattctcctgcctcagcctcccgagtagctgggattacaggtgcctgccaccatgtccagctaatattttgtattagtagagacagggttt

SEQ ID NO: 67260 - DNA, 201 bp, Homo sapiens
tcacctgctggctgtgcccacgcttcccccgccaccatcctctgctctcttctttgcctgtgctttcttcttcctcgacagggtagagctggcctctctgmccaagacagctgacagtgcatctcctttcccctgccgtgtttctggaacattgaactttaccagttgtgtttgttactatttagtaaggttatcttctcc

SEQ ID NO: 67261 - DNA, 201 bp, Homo sapiens
gtcatgagcatggatgagtcacctgctggctgtgcccacgcttcccccgccaccatcctctgctctcttctttgcctgtgctttcttcttcctcgacaggrtagagctggcctctctgaccaagacagctgacagtgcatctcctttcccctgccgtgtttctggaacattgaactttaccagttgtgtttgttactattt

SEQ ID NO: 67262 - DNA, 201 bp, Homo sapiens
cgggggtctccaggggttctgtacatagactgtttgctcctggccagcaggcctgtagctgcgctgggagggcctccatggggcctgggctgtgggtggcrgggactggcagccgttctatctacctacttttctgtccacttgtctgtttacaaaggaaaaacaaaggtgacactggagaaaccgacacgtttgaggttc

SEQ ID NO: 67263 - DNA, 201 bp, Homo sapiens
tctccggccgtccagcccgcgccgcgtcacctcccctcccggagcgaagggccctgctcgcccgaggacggaggcccgcacgggacacggggccccagttyccgccccggaagcccaggacacggctccagtggcggcgcggcccagggcgcaggcgcgggtgtcggtcccaccgcgcgtcgtcctcgccccggccccggc

SEQ ID NO: 67264 - DNA, 201 bp, Homo sapiens
gatcttggctcactgcaacctacgcctcgcaggttcaagcgattctcctgcctcagcctctcaagtagctgtgatcacaggtgcccaccaccacgcccggctaatttttctattttttagttagtgatggggtttcgtcatgttggccaggctggtcttgaactcctgacctcaggtgatccacctgctttagcctcccaa

SEQ ID NO: 67265 - DNA, 201 bp, Homo sapiens
tgtggggtatcccggaggtcaccacagtgtgccaggaggttcaggttggccttccagagcccggcctgtgtgaaatccccacgagcacagaggacagaacraaacatggtgttgttttgaaacagggtgttactgtgtcacccaggctggagtagagtggtgccacattttttgtagagacggggtgtccctgtgtagccc

SEQ ID NO: 67266 - DNA, 201 bp, Homo sapiens
cgcagccaggggccaacgagagccgacgctgggcgggcagcgtccgggagcccctccgaccctgcgctcccctcgtccgcgccctgaccccgcgtctccgrccgtccagcccgcgccgcgtcacctcccctcccggagcgaagggccctgctcgcccgaggacggaggcccgcacgggacacggggccccagtttccgccc

SEQ ID NO: 67267 - DNA, 201 bp, Homo sapiens
ttttcctaaagcatttttcatcccagcttgtttgcagattgctgttattgctcagagaaattcctttggcttccgcagaagatccaagcctgtctagagawttagtaaagtaaaattcaacgtgagacttgagtccgggagaaattcagtccaaactatattgtaatatagagggaaagcctgatctcacttgcattttgt

SEQ ID NO: 67268 - DNA, 201 bp, Homo sapiens
aagccgggatgccgctgagatgccagcgcttctgagtccctctcactgcctgccttctggtggagagaaggctgtcctgcgggcttatgccctccccacgytcctcgcaccgttcacgccattgtgcagcacagctgttaggaccaaattcatcttccccgcaaggacgagtcaggcccagtgttgcactggtcctgctgt

SEQ ID NO: 67269 - DNA, 201 bp, Homo sapiens
tactgaagttcagtgataactctgagcagtttcattgtgatcactgtaaatggtaatcagttggaattctcctaaatgtcttccagacactagtaaaaaamgacctgaaaattgtttgtggaacgcttcacttttcttagactgaggacggagctggctttgaatgggaacctccatcccaggagagaagagccttcattg

SEQ ID NO: 67270 - DNA, 201 bp, Homo sapiens
tcgcccgtgcccaccgctgcccacgtggcctctttccaggcggcagccagggcttctggcacgtcgggcgccagcactgtcgcttgtggccacggcccgcrgagcttcagtcccttgagctcctcctccagagcagggccgagggtctcgccccagcccgactggctgtgcctgcagatgatgctggtcacgcagcttttc

SEQ ID NO: 67271 - DNA, 201 bp, Homo sapiens
ttgctctgggtgccaacccaggctggagtgcaatggcacgatctcagctcactgcaacctccgcttcttgggttcaagtgattctcctgcctcagcctccrgagtagctgggattacaggcacgtgccatcatgcctggctaattttttttgtagagatggggtttctccacgttggtcaggctggtctccaactcctgac

SEQ ID NO: 67272 - DNA, 201 bp, Homo sapiens
agagccgacgctgggcgggcagcgtccgggagcccctccgaccctgcgctcccctcgtccgcgccctgaccccgcgtctccggccgtccagcccgcgccgygtcacctcccctcccggagcgaagggccctgctcgcccgaggacggaggcccgcacgggacacggggccccagtttccgccccggaagcccaggacacgg

SEQ ID NO: 67273 - DNA, 201 bp, Homo sapiens
cttctgctgcggaacttcctcaccttccaggcagggcccaggagccacaggagcgtgggcagggcagggtctgccctctgtgcttccgactcgccgcttgygagctggagggacagtcacctcgacctggtgggctgggtgggcctggctgtgctgtgggctgtgcctcactcctgcaagtgggcactcagcggggttggg

SEQ ID NO: 67274 - DNA, 201 bp, Homo sapiens
gacgagtcaggcccagtgttgcactggtcctgctgtctggcttctgctgcggaacttcctcaccttccaggcagggcccaggagccacaggagcgtgggcrgggcagggtctgccctctgtgcttccgactcgccgcttgcgagctggagggacagtcacctcgacctggtgggctgggtgggcctggctgtgctgtgggc

SEQ ID NO: 67275 - DNA, 201 bp, Homo sapiens
gccacaggagcgtgggcagggcagggtctgccctctgtgcttccgactcgccgcttgcgagctggagggacagtcacctcgacctggtgggctgggtgggyctggctgtgctgtgggctgtgcctcactcctgcaagtgggcactcagcggggttggggtcacgaggctgaggtcggcttaaagcaggagtgggcagttgg

SEQ ID NO: 67276 - DNA, 201 bp, Homo sapiens
tccgtcacggtcacacctcatgaaatggttagattcttccaagtgccttctacgcccctggcagattttctagaatttgctgtcccagaagcttgagaagkgtccggtgccacccgacagcagaagccgggatgccgctgagatgccagcgcttctgagtccctctcactgcctgccttctggtggagagaaggctgtcct

SEQ ID NO: 67277 - DNA, 201 bp, Homo sapiens
cggaggcccgcacgggacacggggccccagtttccgccccggaagcccaggacacggctccagtggcggcgcggcccagggcgcaggcgcgggtgtcggtyccaccgcgcgtcgtcctcgccccggccccggccaatcccttcgaatttggccgaggccgggaaatactagctaatcacggcgcgcgctgttgacgccggc

SEQ ID NO: 67278 - DNA, 201 bp, Homo sapiens
gctgtgctgtgggctgtgcctcactcctgcaagtgggcactcagcggggttggggtcacgaggctgaggtcggcttaaagcaggagtgggcagttggcacrtcatgtttctcctgcatcagggctgtggcaggaatgccgggtgactaccgtagacacttgtcaaggttgaggttcagagaaaggtgtggggtatcccgga

SEQ ID NO: 67279 - DNA, 201 bp, Homo sapiens
gtgcggcctctcgctgggcatgggccctgcagcagcacctggccatctaagttcaggagggtgctgtgtgctgcctctcccttcagtcctgcctccttcaytctcagcagtcccaggtctggctctgctcccaggacgctggactctcccctcccagtggactcgcaggctggccgcctctgctcctcccgaccgcagccc

SEQ ID NO: 67280 - DNA, 201 bp, Homo sapiens
ggtcggcttaaagcaggagtgggcagttggcacatcatgtttctcctgcatcagggctgtggcaggaatgccgggtgactaccgtagacacttgtcaaggytgaggttcagagaaaggtgtggggtatcccggaggtcaccacagtgtgccaggaggttcaggttggccttccagagcccggcctgtgtgaaatccccacg

SEQ ID NO: 67281 - DNA, 201 bp, Homo sapiens
cccaggctggtcttgaactcctgggtacaagcagtcctccctcgtgggcctcccaaagtgctgggattacaggcgtgggctcccgtgaccagcctggaacrtgctgatgagcctctttttctcctgaaaccccggtgggaacagatggtggatgcttccaaaagcatcgaagctgtccatgaggacatccgcgtgctctct

SEQ ID NO: 67282 - DNA, 201 bp, Homo sapiens
tgtacatagactgtttgctcctggccagcaggcctgtagctgcgctgggagggcctccatggggcctgggctgtgggtggcggggactggcagccgttctrtctacctacttttctgtccacttgtctgtttacaaaggaaaaacaaaggtgacactggagaaaccgacacgtttgaggttctaaaaattaaacgagccac

SEQ ID NO: 67283 - DNA, 201 bp, Homo sapiens
caagcaattctcctgcctcagcctcccgagtagctgggattacaggtgcctgccaccatgtccagctaatattttgtattagtagagacagggtttcaccrtgttagccaggatggtctcgatctcctgaccttgtgatccgcccgcctcagcctcccaaagcgctgggattataggggtgagccactgcgcacagcctgt

SEQ ID NO: 67284 - DNA, 201 bp, Homo sapiens
gtccggacccagctgctctgtgctgcaggcgttctaggccgggggtctccaggggttctgtacatagactgtttgctcctggccagcaggcctgtagctgygctgggagggcctccatggggcctgggctgtgggtggcggggactggcagccgttctatctacctacttttctgtccacttgtctgtttacaaaggaaaa

SEQ ID NO: 67285 - DNA, 201 bp, Homo sapiens
tgctgtacttgttgtcatatgagatttctgagttgtattgttgggataattttctttttctttttttgagatggagtctcgctgtgtcacccaggctggartgcagtggtgtgatctcggctcactgcaacctccacctcctgggttcaagcaattctcctgcctcagcctcccgagtagctgggattacaggtgcctgcc

SEQ ID NO: 67286 - DNA, 201 bp, Homo sapiens
gttaacacacctggctaatttttgtaaaattttttgtagcgatggagtctcactattgttgcccaggctggtcttgaactcctggacccaagcagtcctcytgccttggtttcccaaagtgctgtgattagaggcatgagccaccctgcctggccttatttttttttaggagaaatgtcttgctctgttgcccaggctgga

SEQ ID NO: 67287 - DNA, 201 bp, Homo sapiens
caaaaacctagactacactaagctttaactgttgggttctttcttggcagaatttttccctagactggtgtaaacagccagacgtgggccttcccaaaccygacctggtcctgttcctccagttacagctggcggatgctgccaagcggggagcgtttggccatgagcgctatgagaacggggctttccaggagcgggcgc

SEQ ID NO: 67288 - DNA, 201 bp, Homo sapiens
ctttcttggcagaatttttccctagactggtgtaaacagccagacgtgggccttcccaaacccgacctggtcctgttcctccagttacagctggcggatgmtgccaagcggggagcgtttggccatgagcgctatgagaacggggctttccaggagcgggcgctccggtgtttccaccagctcatgaaagacacgactttg

SEQ ID NO: 67289 - DNA, 201 bp, Homo sapiens
ctgggctcaagcaatcctcctgcctctgcctccttgaaagctgggattacaggcgtgagccaccgtgccaggcctgtgattcattttgaatttatgttcgyggagggtatacggtctggtctagatttattctctttcatgaggatgtccagttgttccagcagcgtttattgaggaaaatgcctttgcaccattgcatcc

SEQ ID NO: 67290 - DNA, 201 bp, Homo sapiens
cactgccacagagaagccgctgggggagctatggaagtgacccaaggctgcccactggagacgcctctccctgcagtcccccgagaggtgggagactcgcrgaaggccccgtccccagcggagtccagaccccacaacttcaggagctctttcccggcagcagagatctgcaggctgcctcttctgccccggagctggggt

SEQ ID NO: 67291 - DNA, 201 bp, Homo sapiens
gagtctcgctgtgtcacccaggctggaatgcagtggtgtgatctcggctcactgcaacctccacctcctgggttcaagcaattctcctgcctcagcctccygagtagctgggattacaggtgcctgccaccatgtccagctaatattttgtattagtagagacagggtttcaccatgttagccaggatggtctcgatctcc

SEQ ID NO: 67292 - DNA, 201 bp, Homo sapiens
tacaggtgcctgccaccatgtccagctaatattttgtattagtagagacagggtttcaccatgttagccaggatggtctcgatctcctgaccttgtgatcygcccgcctcagcctcccaaagcgctgggattataggggtgagccactgcgcacagcctgttgggataatttaagcttgacagttcaaggcctatgaaaca

SEQ ID NO: 67293 - DNA, 201 bp, Homo sapiens
gtgtagggagtcactctccttccgtcacggtcacacctcatgaaatggttagattcttccaagtgccttctacgcccctggcagattttctagaatttgcygtcccagaagcttgagaagggtccggtgccacccgacagcagaagccgggatgccgctgagatgccagcgcttctgagtccctctcactgcctgccttct

SEQ ID NO: 67294 - DNA, 201 bp, Homo sapiens
ttcccctgctatgtagttacacaggcctcctgcagcttagtttcagcttttctagtttttcatggctcccagagggaatattttctatgccgtatagcctsttttcacatgaagccattttggggtgttatagtaacagctggtgacttgattttatttatgttgctatgtgctgaaagctttatgaatgttctggctgtg

SEQ ID NO: 67295 - DNA, 201 bp, Homo sapiens
gacatggctgcacaccctcgcgtgagttcactcactcaggatgtattgagccattgttccagggcaggtagcattcaaagcatcaggggtgctgttatagscaaggctacagtttattacagcagaaggacacggaataaaatcagcaaagggaagagccacatagggcagaggccaggagagaccatcccgaaggggaac

SEQ ID NO: 67296 - DNA, 201 bp, Homo sapiens
tgtggggcttccatcttaaggagggcaagcaggcaatgggcagatcaggaaacgaagatatgacttgccaaagggtggtaagtgccatggccaaaaggagscagagagagatggggtgtctgcttagttgggaagtcacagaagagcgggacgtgatgtttgaacagagacgataattataatggccactttcagaacact

SEQ ID NO: 67297 - DNA, 201 bp, Homo sapiens
caggaaacgaagatatgacttgccaaagggtggtaagtgccatggccaaaaggaggcagagagagatggggtgtctgcttagttgggaagtcacagaagascgggacgtgatgtttgaacagagacgataattataatggccactttcagaacacttactatttgttggataagtaataacagtaatatatgtaccaggca

SEQ ID NO: 67298 - DNA, 201 bp, Homo sapiens
ccgttagactgtggtacctggatctcaaacccaggcaatccggctccagagtgtttttaaccatttccctgcactgcctcctgccggtcaaaagaataaaygcatatgcaggcaagaatgaatgggtggtcccatttccgtagaaggggaaaccgaggtcggggagctgggcggggagaccccagcatcctctgacctctt

SEQ ID NO: 67299 - DNA, 201 bp, Homo sapiens
aggccactggccacacatggctacagaatgcttaatgaggccagtatgactgaggaactgaatttgtcatttaatttatcgaaatgtaaacaacctaatgkagctagtggcttctggattggacagcgcagctctgcacatatacaggtcaatttgcatgtctgtatgtttaactttaatttttaactttatttcctcttt

SEQ ID NO: 67300 - DNA, 201 bp, Homo sapiens
catttaatttatcgaaatgtaaacaacctaatgtagctagtggcttctggattggacagcgcagctctgcacatatacaggtcaatttgcatgtctgtatktttaactttaatttttaactttatttcctctttctgccccgccaccccccacccccagcaagcagggcagcctagtgtacacgctgtttttgtttgtttg

SEQ ID NO: 67301 - DNA, 201 bp, Homo sapiens
ccccagcatcctctgacctctttccttgcctccctgcccccgcccgcaggtgaagctggtgttcgtggaggaccaggctgtggtggagacggtgttcttcytgacgtcgcgcaccagggcgctgctgcggcgcttccctcgcatgctgctggtggaccggctgccggggctgcagggcgcgctggatctgctggccgtgct

SEQ ID NO: 67302 - DNA, 201 bp, Homo sapiens
ttttgctaagattcttccatttgtttcagaaatataaaacactctgaaacctgctgagttgggtttgaattctactaaccttgggcattactttcaggttygcagaattagacacaatataactggaaccaaagttcaggggttccattgggggcgaagtctgcaggcgcacaccatggaagcgatcttcctcatcatcta

SEQ ID NO: 67303 - DNA, 201 bp, Homo sapiens
catttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagt

SEQ ID NO: 67304 - DNA, 201 bp, Homo sapiens
tagttctacttcaagataaggtatagacaactgcaaaattccactgtccttacgatcacaatcatgaagaggatggagctgcagaatctgagcatataaaracttttatgaattctaacgcccaaccccaacttgagcattcattgcgctggtcctaattcacattcaaacgccctgagaatggagctaacaggatacact

SEQ ID NO: 67305 - DNA, 201 bp, Homo sapiens
ttttcccaaagcagcccagttacttattaacatactgctttttccagtgacacgtgttcacagttattaagtcgatctcccgccaaaatagaagctctatsttgttttccattgtatccccagtgcctagaacagtgcctgttgcaaagtaagctttgagttaaaaaaaaagatgaaagaatgaaaatggcagactgccta

SEQ ID NO: 67306 - DNA, 201 bp, Homo sapiens
tcccagcactttgggagactgaggtgaccgattgcttgaggtcaggagctcaagaccagcctggccaatatgttgaaacccccatctctactaaaaatacracaattagccaggcgtggtggcaggtgcctgtagtcccagctactcaggaggctgaggcaggagaatcgcttgaacccagggaaagaaggttgcagtgag

SEQ ID NO: 67307 - DNA, 201 bp, Homo sapiens
agccaggcgtggtggcaggtgcctgtagtcccagctactcaggaggctgaggcaggagaatcgcttgaacccagggaaagaaggttgcagtgagcagacaytgcgccactgcactccagcctgggcgacagagtaagactctgtctcaaaaaaagattatcacctcaggttgcaattgccacttcttatctcacatttact

SEQ ID NO: 67308 - DNA, 201 bp, Homo sapiens
tacctcacttacgttttctgtatgtcactttcctttttctgtccataaatcttccaccacatggctgtgctggagtttcagcctactctggtccgaggctrcctgattcgtggatccttcattgctcaattaaactctatttatttatttagagatggagtctcgctctgttgcacaggctggagcacagtggtgcgatct

SEQ ID NO: 67309 - DNA, 201 bp, Homo sapiens
ttctgggttcaagcaattcttgtgcctcagcctcccgagtagctgggactacaggtgcccaccaccatgcctagctaatttttgtatttgtagtagagacygggttttgccatgttgaccaggctggtctcaagctcctgacttgaagccatccgccctcctcggcctcccaaagtgctgggattacaggcatgaaccaca

SEQ ID NO: 67310 - DNA, 201 bp, Homo sapiens
agaatgaaggtgagaaaaagatgtcctcagaggaagcaaaaaataagagaatctgtacctatcagaaccactctaaaagaactaaaaaacgtctatcagargaagtggaaatttgcagaacgaaatttggaaaataatgaaggaagagcaacagaaatggtaaatatctggaaaaacataacagattactcttctcatgag

SEQ ID NO: 67311 - DNA, 201 bp, Homo sapiens
tgcagaaatttgggtacccttataagttgatagaagatttgctaattggagctaccattttggaaaataattaaaaaaatttcccatgatgccttcaatgkggttttgcactttcatctagactccttgatgttttcaaagttcagatgaattttgcaacatgccccccccaccccacctttggcagcagctcagtcacca

SEQ ID NO: 67312 - DNA, 201 bp, Homo sapiens
tttaaaaaattacaaagggtgagattgttggctggaatctttttaaatggaagatgactctgaggagagtttacctcgctcaagatcatcacctctagggygggcgcggtgactcacacctgtagtcccagcactttgggagactgaggtgaccgattgcttgaggtcaggagctcaagaccagcctggccaatatgttga

SEQ ID NO: 67313 - DNA, 201 bp, Homo sapiens
aggctggtcttggactcctcggcttaagcaatcctcctgccacagcctcccaaagtgctgggattacaggtgtgagccactgtgctcagaactaggaagcttttttttttttttttttgagtcttgctctgttacccaggctggaatgcaatggcacgttcccggctcactgcaacctccacctcccaggttcaagtgatt

SEQ ID NO: 67314 - DNA, 201 bp, Homo sapiens
tcaccatgttggccaggctggtctcaaactcctgacctcaggtgacctgctcgcctcagcctcctaaagtgctgggatcacaagcgtaagccactgcgccyggcctaggaggcttctaataaagattctatcactcctaagaaggcctagagacatgatcaggcctagacctgctgatgattaccttggtatggtgtgata

SEQ ID NO: 67315 - DNA, 201 bp, Homo sapiens
tcagcctcccaaagtgctagaattacagatgtgggccattgcacctggccaatcaaagataccctaatgatttagggaagtttgagttggggtttctgttrtcgcaactgatgaaggggatttaattctattataggtgacaaagtccaggttgaagtagctcagcatttttcaaactttagcgtggacgtgagtcacgtg

SEQ ID NO: 67316 - DNA, 201 bp, Homo sapiens
gcctcccaaagtgctagaattacagatgtgggccattgcacctggccaatcaaagataccctaatgatttagggaagtttgagttggggtttctgttgtcrcaactgatgaaggggatttaattctattataggtgacaaagtccaggttgaagtagctcagcatttttcaaactttagcgtggacgtgagtcacgtgggc

SEQ ID NO: 67317 - DNA, 201 bp, Homo sapiens
aatcaaagataccctaatgatttagggaagtttgagttggggtttctgttgtcgcaactgatgaaggggatttaattctattataggtgacaaagtccagsttgaagtagctcagcatttttcaaactttagcgtggacgtgagtcacgtgggcaccttcttaaaatacagagtctgactcagtaggtctaagatagggcc

SEQ ID NO: 67318 - DNA, 201 bp, Homo sapiens
ttgtcgcaactgatgaaggggatttaattctattataggtgacaaagtccaggttgaagtagctcagcatttttcaaactttagcgtggacgtgagtcacstgggcaccttcttaaaatacagagtctgactcagtaggtctaagatagggcccaacattctagcaagctctccgatgatgtggctgtgctgggttgtgga

SEQ ID NO: 67319 - DNA, 201 bp, Homo sapiens
cagtaggtctaagatagggcccaacattctagcaagctctccgatgatgtggctgtgctgggttgtggagcacactttgagtagcaatgaaggaacttgarataaaagacaattcaggccgggtgtggtggctcacacctgtaattccagcactttgggaggctgaggtaggtggatcacttaaggccaggagttcaagac

SEQ ID NO: 67320 - DNA, 201 bp, Homo sapiens
taaagcgatttatagctcctatgcaaatgtatgttaatatccttcccttcatagagcttcattgaaatttttcatgctgtgttacccaagacaaggatctrctactattgaagatactgatttctgcatcattgtagttattcaaacagagcatggcattttacaaatgtattggagatataaatgtatctccagagattc

SEQ ID NO: 67321 - DNA, 201 bp, Homo sapiens
tttcttcaaaagacagctctctcctgagaaagggggggactagaagttcccatatcacaccctcctatcttgatccaaaaataccattctatcagcattcrtatattaagtctcaaggaagcagcaggttggatttatggaggttatcagttatccatggctacataaatgctgtgttaacaactataaaacttcctaagt

SEQ ID NO: 67322 - DNA, 201 bp, Homo sapiens
agttcccatatcacaccctcctatcttgatccaaaaataccattctatcagcattcgtatattaagtctcaaggaagcagcaggttggatttatggaggtyatcagttatccatggctacataaatgctgtgttaacaactataaaacttcctaagtatataacaataaacatgtatttggaatcaacctaaatgcccatc

SEQ ID NO: 67323 - DNA, 201 bp, Homo sapiens
tgtgaacttataaattcttgtatagtttgcttttatttttacactgtggaaagattggctgcgtacttatgaaagcacaggacagaaggacttctttttgktgcctcagcagagaactggtagctcagctgtgtctgtgaacacgtctatgatggacaagggtagagatgttacttctctccgtcacagggctgctgtgag

SEQ ID NO: 67324 - DNA, 201 bp, Homo sapiens; identical to SEQ ID NO: 67305

SEQ ID NO: 67325 - DNA, 201 bp, Homo sapiens
gggtgtcttgagagggtcgaagttagagaaagggcacctgagagggccagagattagagactggagggggccccagttggagggtgagaaagattggggaktggaaggttatgtctggagggggtcccagttggaggaccaggcgctaagaggattggaagggtatacctggagggtggcccagctggaagatcgcaggag

SEQ ID NO: 67326 - DNA, 201 bp, Homo sapiens
tgtatccccagtgcctagaacagtgcctgttgcaaagtaagctttgagttaaaaaaaaagatgaaagaatgaaaatggcagactgcctagcagaactagcycttcccgatgtttcattgttgctatagtgacgatccagtctgcacgaagatcccagcttccttaaccttgttcctacctccagccagctcacccattggc

SEQ ID NO: 67327 - DNA, 201 bp, Homo sapiens
aatatggtacatatacaccatggaatactatagagccattaaacaactagatcatgttctttgcagggacatggatggagctggaggtcattatccttaawgaactaacacaggaacagaaaaccaaatactgcatgctctcacttataagtgggagctaaatgatgagaagaaatgacacagagagaggggcaacacaca

SEQ ID NO: 67328 - DNA, 201 bp, Homo sapiens
gaacagaaaaccaaatactgcatgctctcacttataagtgggagctaaatgatgagaagaaatgacacagagagaggggcaacacacatggagacctactrgggggtggaggatgggaggagggagaggatcgggaaaaataactaatgggtactaggcttaatacctgggtgacaaaataatctgtacaacaaaccccca

SEQ ID NO: 67329 - DNA, 201 bp, Homo sapiens
ctactagggggtggaggatgggaggagggagaggatcgggaaaaataactaatgggtactaggcttaatacctgggtgacaaaataatctgtacaacaaayccccatgataaaagtttacctatacaacaaacctgcacatgtacccctgactttaaaagttaaaacaataataaaaatgaacacgtattgcttatgagtc

SEQ ID NO: 67330 - DNA, 201 bp, Homo sapiens
taatctgtacaacaaacccccatgataaaagtttacctatacaacaaacctgcacatgtacccctgactttaaaagttaaaacaataataaaaatgaacaygtattgcttatgagtcttgggtcacctgaggggttggctagacccttgcttttcagtgtggtgcatgcaacagtgtcatgaacattccctaggagcttgt

SEQ ID NO: 67331 - DNA, 201 bp, Homo sapiens
cctgaggggttggctagacccttgcttttcagtgtggtgcatgcaacagtgtcatgaacattccctaggagcttgttagaaatgcagattctcggctgggmacggtggctcacacctgtaatcccagcactttgggaggctgaggtgggcggatcacctgaggtcaggagatcgagaccatgctggccaacatggtgaaac

SEQ ID NO: 67332 - DNA, 201 bp, Homo sapiens
gtctaataaatctgcctttctttccctacgactgtcttgataaatgcctttacctcccatgatactggccccagctagtcacacccgtgatgcccatctcttttttttttttgagatggagtctcgctctgtcgcccaggctggaatgcagcagcacgatctcggctctctgcaagctctgcctcccgggttcacgccatt

SEQ ID NO: 67333 - DNA, 201 bp, Homo sapiens
tgcctctcagtgcatggagaaatgaatgttcagtgcctagaagggataatcagggaatatggaggttaaggaggcaactgaggcacagagaggttaaatcrcagggttcagaagtgttgggggtgggactcaaagctaaatgatctgcctccacaatctaagctcattaccaccagaccagtcatccttaagcatgcatag

SEQ ID NO: 67334 - DNA, 201 bp, Homo sapiens
gacagagtgagactctgtctcaaaaaaaaaaaaaaaaaaaaaaaatatataaatatatatatatatatatatatatacacacacacacacatttacatagycccgccttcatcaaatgtcaccctgccccttaaaatgccgcccatgcatgttctcccacctactgcttttgtttccaatcattcctaatggcccggatct

SEQ ID NO: 67335 - DNA, 201 bp, Homo sapiens
tggagggatggagggtgtgccggaggaatcagtctgcagtaaggggagttggggtgatattaggggaaatgggatgttttcaaggacagggagtgttttgrtgaattcctatgtaataaggagatttggggagatcattgaaatcgacaagttactagatacttgggatgctcaaggggaagtggaaacgcagtaggatcc

SEQ ID NO: 67336 - DNA, 201 bp, Homo sapiens
tagatgtgggctatctggttagtgacgggaagctgaattaattcattaattgattcaccaaataacacacagaaccctggggtggaaaagagctcagcccrtaaggtaaagagaagatgggccagtgtagatgggtcagagtgtgaaagagggagagatttggacagtgaaatccgcaagcccttaaagatagaagatgag

SEQ ID NO: 67337 - DNA, 201 bp, Homo sapiens
taattgattcaccaaataacacacagaaccctggggtggaaaagagctcagcccataaggtaaagagaagatgggccagtgtagatgggtcagagtgtgaragagggagagatttggacagtgaaatccgcaagcccttaaagatagaagatgaggtgagtctttatcctgggaggtatgggaagccttcaaaaggtttta

SEQ ID NO: 67338 - DNA, 201 bp, Homo sapiens
ttggcgttgccacagtaaccctggagtggaaggagacggggattagagacctcgcgggagaaattagactaacagcctgggaactggagggatggagggtrtgccggaggaatcagtctgcagtaaggggagttggggtgatattaggggaaatgggatgttttcaaggacagggagtgttttggtgaattcctatgtaat

SEQ ID NO: 67339 - DNA, 201 bp, Homo sapiens
aattcgtctgaagtttttcttttatcacaagtcacatcaatccctcgggcccctgctcaaatgccacctcttcctgaaagccatccctaagtagtctctcyaaagagccatccctgcccctttctttgctttatccttcacagcacttatcactacctgaaattatgccacacagctatttaccactttggcattgtgatt

SEQ ID NO: 67340 - DNA, 201 bp, Homo sapiens
ggcgttgccacagtaaccctggagtggaaggagacggggattagagacctcgcgggagaaattagactaacagcctgggaactggagggatggagggtgtrccggaggaatcagtctgcagtaaggggagttggggtgatattaggggaaatgggatgttttcaaggacagggagtgttttggtgaattcctatgtaataa

SEQ ID NO: 67341 - DNA, 201 bp, Homo sapiens
ttttcccaaagcagcccagttacttattaacatactgctttttccagtgacacgtgttcacagttattaagtcgatctcccgccaaaatagaagctctatrttgttttccattgtatccccagtgcctagaacagtgcctgttgcaaagtaagctttgagttaaaaaaaaagatgaaagaatgaaaatggcagactgccta

SEQ ID NO: 67342 - DNA, 201 bp, Homo sapiens
gcatggtttctgatgttcatgtttgtggaatctgtcgtctatggcagatgcttccccgtgctaccaatttgtgtgtctgaaaggacacccgtacattcatytgcatcctcaaaatctgttcctccgtgggtttctccatctctgcaaaatgcactgctgtccactgtgtgcctaagccagccctgtttggtcaattttttg

SEQ ID NO: 67343 - DNA, 201 bp, Homo sapiens
atctgtaaaatggggataatactatcttatagggctgttggggttgttgtgtgagaaagtgcagtgtgtatgtgtatgtgtgtgtgtgtgtgtgtgtgtgygtgtgtgtgcagaatgggtagaaccgtgcccagaagtaggaagccctgcatatgttcaatatttagctattattttgttgttgttgtttgtttgtttgtt

SEQ ID NO: 67344 - DNA, 201 bp, Homo sapiens
cctacgagaatgtaatgccaccactgatccgacaggaggcagagcgcaggcggtaatgcaagcaatggggagcagctgtaaacacagatgaagcttcgccygctcaccgtccactcacctcctctgtgcaacccggtttctaacgggccacagaccggtaccagtccctagcccgggggttggggactcctggtctacaca

SEQ ID NO: 67345 - DNA, 201 bp, Homo sapiens
aagtgcctagattccactttaagtggtacaaatgtgataacagtagaatagaaaagacataacaaactggctgactgaggataaatcctaacatattaatmattacattaacgtaagtaattgaaatcttccagttaaaagagactatcagaatgggttcaaaatacaccataaaaaaaactgactcaaccagatggtgtc

SEQ ID NO: 67346 - DNA, 201 bp, Homo sapiens
gacatggagaaacattcctcccttgtgatgttgtttgagcccatgaatcagcctccctggagtcagtcccacatctcttccttgaactcgcctgagccatsacactcttgataatttcactccatttaagttggactttctgtcatttgccacacaagactttacacagatccagaggacattgcagattgctgccttggg

SEQ ID NO: 67347 - DNA, 201 bp, Homo sapiens
cgcccggagatgcccatctcttaaaataaaaaataaaaaaaaaaaaagaaagagagaaaggaaaggaggcaggagggatcctgggaaggcaaacaacagcwattgagcgcaaaccaaatccaaaacttctccacttgcctgttttatcattagattcttagatgtgggctatctggttagtgacgggaagctgaattaatt

SEQ ID NO: 67348 - DNA, 201 bp, Homo sapiens
cacttgcctgttttatcattagattcttagatgtgggctatctggttagtgacgggaagctgaattaattcattaattgattcaccaaataacacacagarccctggggtggaaaagagctcagcccataaggtaaagagaagatgggccagtgtagatgggtcagagtgtgaaagagggagagatttggacagtgaaatc

SEQ ID NO: 67349 - DNA, 201 bp, Homo sapiens
ggagtttcagactttgagaatcgttcacttacaggattcaggatctataccaagcttagagtcaaaattcaggggtgggagattgctccttgtgtctgtarcttaatttgtggacatacaaaatcacacacattcacagagcaaatataccctttgcagtatcaaatgcattgaggtgtctcaaataatgtatcttcctca

SEQ ID NO: 67350 - DNA, 201 bp, Homo sapiens
cctaagtagtctctctaaagagccatccctgcccctttctttgctttatccttcacagcacttatcactacctgaaattatgccacacagctatttaccastttggcattgtgattaagcttatcaagtatgaagccagactgcctgggttcaaatcccagctccactacttccttgtcatgtgaccttccagcctatgtt

SEQ ID NO: 67351 - DNA, 201 bp, Homo sapiens
cggactggagagggaggggatggtctcaggatgattcaagtgcaatacatttattgtgcacctaagttctattattacattgtaatgtataatgaaataaytatacaaacaactcaccataatgtagaatcagtgggagccctgagcttgttttcctgcaactaggtggtcccatctcggggtgatgggagacagtgacag

SEQ ID NO: 67352 - DNA, 201 bp, Homo sapiens
tcctgtaatgtgatggagcgataagttatcatcaaggagaaaaaggccggggcctggagcgggacagttctaagggtgctgtttgaattggtcagggaagktctctttagcaaatgatggtgaagcagaggagatggaacagaggcaagggaccctcattctgtcatcagagggaagagaattctaggcagaaggaacagc

SEQ ID NO: 67353 - DNA, 201 bp, Homo sapiens
ctgcaacccctgcctcccaggctcaagtgattctcatgccttagcctcccgagcagctgggattacagacatgcaccaccatgcccggctaatttttgtawttttagtagagacggggtttcaccatgttggccaggctggtctcgagctcctggcctcatctgattcacccacctcggcctcccaaagtgttgggattac

SEQ ID NO: 67354 - DNA, 201 bp, Homo sapiens
gaccttccagcctatgttacagttgaggggtcataatagtacctgtctatagggctttgtgaggatgaatgaattagtgtgtgtaccagtgttctaacatygcctgcatttccatttttcccaaagcagcccagttacttattaacatactgctttttccagtgacacgtgttcacagttattaagtcgatctcccgccaa

SEQ ID NO: 67355 - DNA, 201 bp, Homo sapiens
ggttaatttaagtgtttgtgaagagtgggttattataggggaaacaggtattatagagtaattgggttgtaggaggagctggggatagtcaggaaaagtcrgagtgttgaagctaacgccaagatcagcactgactgtgtgccagagactatgctaagtactcttatttttaaaaacgttttattatggaaagtttcggcc

SEQ ID NO: 67356 - DNA, 201 bp, Homo sapiens
ggtttctccatgttggtcaggctggtcttgaactcctgacctcaggtgatccccccgccttggcctcccaaagtgctgggattacaggcatgagccaccgygcccagccccttaatgctcttgaaagaaaggaggaagaagttctaggacaggagagacagattagtgaagcaacatttaaatatttactttttgaatatg

SEQ ID NO: 67357 - DNA, 201 bp, Homo sapiens
gtagtagtaaggtataaaaggaaaggtagggaattgggccgtttgagcattgtgcagttgttataggatttttatttttattttttgagacagagtctcaytctgtcacccaggctggagtgcagtggtgcaattttggctcactgcaacctccaccttctgagttcaagcaattctcctgcctcagcctcccaagtagct

SEQ ID NO: 67358 - DNA, 201 bp, Homo sapiens
atagaaatgttccttatccaggctaggcatggttactcacacctgtaatcccagcactttgggactctgaggcagatggatcacctgatggcaggagttcragaccagcatggccaacatggcaaaacctgatctctactaaaaattcaaaattagccaggcatggtggcaggtgcctgtaatctcagctactcgggaggc

SEQ ID NO: 67359 - DNA, 201 bp, Homo sapiens
aactcacagtcaggaccttccatagggtaacaccatcactgcagaaagttctgttggacagccctgatgtgtggggtgacaagtgtggaggctttcctggytcctaaagttcgaccttatctcttagcgattgctctcgtacttcctctgactcacccctaaccttctcctctctgttctactaaaaatacaaaaattagc

SEQ ID NO: 67360 - DNA, 201 bp, Homo sapiens
ttccatagggtaacaccatcactgcagaaagttctgttggacagccctgatgtgtggggtgacaagtgtggaggctttcctggttcctaaagttcgacctyatctcttagcgattgctctcgtacttcctctgactcacccctaaccttctcctctctgttctactaaaaatacaaaaattagctgggcgtggtggtgggc

SEQ ID NO: 67361 - DNA, 201 bp, Homo sapiens
tttttttatttttgtaaatttatgaagtacattcttcaaatgtaacaatttagttctacttcaagataaggtatagacaactgcaaaattccactgtcctyacgatcacaatcatgaagaggatggagctgcagaatctgagcatataaagacttttatgaattctaacgcccaaccccaacttgagcattcattgcgctg

SEQ ID NO: 67362 - DNA, 201 bp, Homo sapiens
gagctgatattaagacctcagttcacagaaagccaaataaataataaacatcttctgttggatacaaataaaacagagtctcataagataacattcacatktcgagggtacatatcggaactactgagaatacaaggatgagctgcaaaaatctccacttgtctggcaaatgacaactcagtggacaccaaacactgaata

SEQ ID NO: 67363 - DNA, 201 bp, Homo sapiens
atcggaactactgagaatacaaggatgagctgcaaaaatctccacttgtctggcaaatgacaactcagtggacaccaaacactgaataacatgtacagtgraattatctgacaaagactttaaaagagacattataaaaatactcaaatgaggccaggcacggtggctcatgcctgtaatcccagcactttggaaggccga

SEQ ID NO: 67364 - DNA, 201 bp, Homo sapiens
agaaagatgagaaagtaggggaagaactggtttctcctcctggctgtgcctttgtctcccttgtgtgtggaagaggtcccaaggcagggtaaagtcgagaytcagctctggcacactcttcctgtcttcatctcatgcccagtaagaagccctgattcaagccaccagcccaagcccaggcctctgtcccgacataataat

SEQ ID NO: 67365 - DNA, 201 bp, Homo sapiens
gatattgtaaggatgaaagattagctgttggaactgtgcctggtgcagagaaactacttcatgtgtgctttgcacacccgaaaccttcttttttatatttrtttatccttggcctgggggctgtctcctctcactcagtggtgtgtctcatttgttctcctctgtgcctgagccagcacatggcacatcatattttctcag

SEQ ID NO: 67366 - DNA, 201 bp, Homo sapiens
tcccgccttcatcaaatgtcaccctgccccttaaaatgccgcccatgcatgttctcccacctactgcttttgtttccaatcattcctaatggcccggatcyattggatcccagcatcactgcttgttagcgcagtggccttgggcaagtcactcctctggtgcagatgggggtccctaagaccaccctcagtttccatgat

SEQ ID NO: 67367 - DNA, 201 bp, Homo sapiens
tggggtgatattaggggaaatgggatgttttcaaggacagggagtgttttggtgaattcctatgtaataaggagatttggggagatcattgaaatcgacawgttactagatacttgggatgctcaaggggaagtggaaacgcagtaggatccgcccgcctcagcctcccaaagcagtagggaaaattggggtattaagctc

SEQ ID NO: 67368 - DNA, 201 bp, Homo sapiens
gtaacaatttagttctacttcaagataaggtatagacaactgcaaaattccactgtccttacgatcacaatcatgaagaggatggagctgcagaatctgaycatataaagacttttatgaattctaacgcccaaccccaacttgagcattcattgcgctggtcctaattcacattcaaacgccctgagaatggagctaaca

SEQ ID NO: 67369 - DNA, 201 bp, Homo sapiens
gttttcaaggacagggagtgttttggtgaattcctatgtaataaggagatttggggagatcattgaaatcgacaagttactagatacttgggatgctcaargggaagtggaaacgcagtaggatccgcccgcctcagcctcccaaagcagtagggaaaattggggtattaagctcttttgccattctgcagttattataga

SEQ ID NO: 67370 - DNA, 201 bp, Homo sapiens
ggggtgggagattgctccttgtgtctgtagcttaatttgtggacatacaaaatcacacacattcacagagcaaatataccctttgcagtatcaaatgcatygaggtgtctcaaataatgtatcttcctcagtcctactcctctcatccatttcttgaagcctgtttcttcctagttggtgtttttcattgaaatcctagac

SEQ ID NO: 67371 - DNA, 201 bp, Homo sapiens
aacatgagctgccttgaaccagcatactcatccaagacccagccatccacaatctcccccatttcatctagaatttgctatcaaaaaaaaaaaagcatgaytgtgacacctggaaaaaatcttttttaaataaaaaagtaaacaatgtaaaaatattctgatgtttacagagaaatggagagtgtggtggcatttgcttac

SEQ ID NO: 67372 - DNA, 201 bp, Homo sapiens
cgaagatcccagcttccttaaccttgttcctacctccagccagctcacccattggccacctgtatctcctgctgtagcagccagaaagctacaactcccarccggctgagcgccaccagcgctttcgcgtccaagtccctttgctgagtgtgagggcctgcgcagtagaacccgcgggcccagagctccatctgagcatgt

SEQ ID NO: 67373 - DNA, 201 bp, Homo sapiens
aaccttgttcctacctccagccagctcacccattggccacctgtatctcctgctgtagcagccagaaagctacaactcccagccggctgagcgccaccagsgctttcgcgtccaagtccctttgctgagtgtgagggcctgcgcagtagaacccgcgggcccagagctccatctgagcatgtgcaggctgcggggtgtttc

SEQ ID NO: 67374 - DNA, 201 bp, Homo sapiens
caagtctgtcctgaaagcctgtgtgatagatgttacccagtcttcttctgtcttgaacactgaaatcaatgatcacatttctgtttatccatttccaatgygaacgctggattctctcttccagactacctaactgactcattttacaaattctgctgtctaagataggacacgaggtaagggtccctttcactaatgctt

SEQ ID NO: 67375 - DNA, 201 bp, Homo sapiens
tttacacagaaatttcacctttttttcacttataaaatctaatgaaagagttctatattattatgttaataatacagtagtaatataacagtataatgtaatagataattaatatattatattaattatatattataattatatattatattatatatattatatattatatattaattatatatattatatatattatat

SEQ ID NO: 67376 - DNA, 201 bp, Homo sapiens
caccagaccagtcatccttaagcatgcataggagtcccctggagggcttgtcaaactagattgctggggcccgcccccagagtttcagactcagtgggtcygaggtggccccgagaaggtgcatttctgtccaggtcccaagaaccgatggtgatgctgctggtccagggcccacattttgagacccactgccctagactg

SEQ ID NO: 67377 - DNA, 201 bp, Homo sapiens
tctaccttcaaatgactgactcatgccaaatgtcctggccacagaatgggcctgtgacccagtcctggtcaacgagtctgctcaggttgaggtgggaggcytttttatttttatatttttgtagaaacagggtcttgctatgttactcaggctggtcttggactcctcggcttaagcaatcctcctgccacagcctcccaa

SEQ ID NO: 67378 - DNA, 201 bp, Homo sapiens
ccagcactttggaaggccgaggcgggtggatcatgaggtcaggagatcaagaccatcctggccaaaatggtgaaaccctgtctctactaaaaatatttttwaaaaaaaattagccgggcgtgttggcatgcacctgtagtcctagctactcaggaggctgaggcaagagaatcgcttgagcccgggagacagaggctgcag

SEQ ID NO: 67379 - DNA, 201 bp, Homo sapiens
gaaatttaaaatatagagaacaaaatggaaattttagaactgatacatacagtgaccaaaatttaaaaggtggtgaatgcactcagtgggacgacacagayaacaacaggtgaacactccagcaaatttgaaaatagacaaattaaaattacccaatcagaataatggaaaaaatgaaaagatgttctaaataagtagaat

SEQ ID NO: 67380 - DNA, 201 bp, Homo sapiens
aaactaaagataaataccttgaaatctgacagaaaaatgacacactacatacagggaaacaacaatttgaatgactgcagatttctcatcaggaaatacgkaagctaaaaggaaactgctgaacagaaaacaatgtcaactaaaaatactacaagcaaaaaacatcactgagaatgaaggtgagaaaaagatgtcctcaga

SEQ ID NO: 67381 - DNA, 201 bp, Homo sapiens
ctttcttctccaccatgctcagcaaggcctcattcttgctctgccgtgtcttttcctgctccaccagctccttctcattctcagtaagaacctcattgtcytggagatcatcgagcacccctttcaggtcccccatcctggcttggagttgccggtggttctccttcacaaaggctgcacctggatgaaagggggagtttc

SEQ ID NO: 67382 - DNA, 201 bp, Homo sapiens
acccctttcaggtcccccatcctggcttggagttgccggtggttctccttcacaaaggctgcacctggatgaaagggggagtttcagactttgagaatcgytcacttacaggattcaggatctataccaagcttagagtcaaaattcaggggtgggagattgctccttgtgtctgtagcttaatttgtggacatacaaaat

SEQ ID NO: 67383 - DNA, 201 bp, Homo sapiens
tagctgatcctcattgcacctccagatgtgaggcatgatttctttttatttaatctgcctcaatggccttccaggcaacaacagctaggaaatggcatgaytgccatctcagaaggtgctctcttttttctcccagtggtctgttttgagacatgagttcggaaacttacactgtgtggagcctgacaatgaagccaacaa

SEQ ID NO: 67384 - DNA, 201 bp, Homo sapiens
cgggagaggagtggggaggagctctttacccgctgagcattgtggggcccgcttggatctccttgtccaaagggtctgggcgccggggctgcagtctctgkgtgaggaggcggacgcgggaaacctgcttcggtctccatggttacgagccgctcagcgcgcaggagggggattcaaaggttggcgttgccacagtaaccc

SEQ ID NO: 67385 - DNA, 201 bp, Homo sapiens
gtttgcccatttttcacaaggagttttctgtttgtttactcatgttgaatcatttttatgtattataaatatcacctgatatttacatcttcttcttagtrgcttcattctaatgaacttcttcttttttattgttgtttttctgtttttttttttttttttttgagacagaatgagactctgtcagccaggctggagtgc

SEQ ID NO: 67386 - DNA, 201 bp, Homo sapiens
ttacacagaaatttcacctttttttcacttataaaatctaatgaaagagttctatattattatgttaataatacagtagtaatataacagtataatgtaatagataattaatatattatattaattatatattataattatatattatattatatatattatatattatatattaattatatatattatatatattatata

SEQ ID NO: 67387 - DNA, 201 bp, Homo sapiens
tttgtttactcatgttgaatcatttttatgtattataaatatcacctgatatttacatcttcttcttagtagcttcattctaatgaacttcttcttttttrttgttgtttttctgtttttttttttttttttttgagacagaatgagactctgtcagccaggctggagtgcagtggtgtgatcttggctcactgcaacccc

SEQ ID NO: 67388 - DNA, 201 bp, Homo sapiens
tacacagaaatttcacctttttttcacttataaaatctaatgaaagagttctatattattatgttaataatacagtagtaatataacagtataatgtaatagataattaatatattatattaattatatattataattatatattatattatatatattatatattatatattaattatatatattatatatattatatat

SEQ ID NO: 67389 - DNA, 201 bp, Homo sapiens
ttgaatcatttttatgtattataaatatcacctgatatttacatcttcttcttagtagcttcattctaatgaacttcttcttttttattgttgtttttctktttttttttttttttttttgagacagaatgagactctgtcagccaggctggagtgcagtggtgtgatcttggctcactgcaacccctgcctcccaggctc

SEQ ID NO: 67390 - DNA, 201 bp, Homo sapiens
acacagaaatttcacctttttttcacttataaaatctaatgaaagagttctatattattatgttaataatacagtagtaatataacagtataatgtaatagataattaatatattatattaattatatattataattatatattatattatatatattatatattatatattaattatatatattatatatattatatatt

SEQ ID NO: 67391 - DNA, 201 bp, Homo sapiens
tcatttttatgtattataaatatcacctgatatttacatcttcttcttagtagcttcattctaatgaacttcttcttttttattgttgtttttctgttttkttttttttttttttgagacagaatgagactctgtcagccaggctggagtgcagtggtgtgatcttggctcactgcaacccctgcctcccaggctcaagtg

SEQ ID NO: 67392 - DNA, 201 bp, Homo sapiens
atgaaagagttctatattattatgttaataatacagtagtaatataacagtataatgtaatagataattaatatattatattaattatatattataattawatattatattatatatattatatattatatattaattatatatattatatatattatatattatattataatatattatattatatatattatatattat

SEQ ID NO: 67393 - DNA, 201 bp, Homo sapiens
tattatattataatatattatattatatatattatatattatattataatatattatattatattatatatattatatattatattattattatattataktatatatattatatataatattatatatattatatattatatatataatattatatattatattaatattataatatgtaacgcataacatgtaatattg

SEQ ID NO: 67394 - DNA, 201 bp, Homo sapiens
gaggccaggagttcaaaaccagcctggccaacatagcaaaactctgtctctactaaaaatacaaaaaattagctgggctgtggtggtgcatgcctgtaatyccagctactcaggaggctgaggcacaataatcgcttgaaccaggaggcagaggttgcagtgagctgagatcgcaccactgcactccagcctgggtaacag

SEQ ID NO: 67395 - DNA, 201 bp, Homo sapiens
ttcccagcctgagaactgtaagaaataaaattttactctttaagccactgagtccatggtattttgttatggcaacctgagcaggataaggtagtatacayacctttaacttcactgtgtaacttcagattaatttccaaaatcaagcattacctaaccaacagcagaacttacatttgtgctccatatactcaccagtag

SEQ ID NO: 67396 - DNA, 201 bp, Homo sapiens
ggagaatggtgtgaactcaggaggcgtagcttgcagcgagccaagatcgtgctactgcactccagcctgggcgacagagtgagactccatcctaaacaaamaaaaaaaaaagaataagaacaagtctaggaactattttgaaagatctctcaaacacatttttaagttaaaaaagcaaaatgcaaaactgtacataatatg

SEQ ID NO: 67397 - DNA, 201 bp, Homo sapiens
tctcaaaaaaaaaaaaagaaaagaaaagaaaaaaaaaaccatgctgaattggccaaatatttatctaggacttcccagcctgagaactgtaagaaataaarttttactctttaagccactgagtccatggtattttgttatggcaacctgagcaggataaggtagtatacatacctttaacttcactgtgtaacttcagat

SEQ ID NO: 67398 - DNA, 201 bp, Homo sapiens
taccttctccaacccttagttcatttatctgtaaaatggggataatactatcttatagggctgttggggttgttgtgtgagaaagtgcagtgtgtatgtgtatgtgtgtgtgtgtgtgtgtgtgtgtgtgtgtgtgcagaatgggtagaaccgtgcccagaagtaggaagccctgcatatgttcaatatttagctattatt

SEQ ID NO: 67399 - DNA, 201 bp, Homo sapiens
accttctccaacccttagttcatttatctgtaaaatggggataatactatcttatagggctgttggggttgttgtgtgagaaagtgcagtgtgtatgtgtatgtgtgtgtgtgtgtgtgtgtgtgtgtgtgtgtgcagaatgggtagaaccgtgcccagaagtaggaagccctgcatatgttcaatatttagctattattt

SEQ ID NO: 67400 - DNA, 201 bp, Homo sapiens
aacccaggcaatccggctccagagtgtttttaaccatttccctgcactgcctcctgccggtcaaaagaataaatgcatatgcaggcaagaatgaatgggtggtcccatttccgtagaaggggaaaccgaggtcggggagctgggcggggagaccccagcatcctctgacctctttccttgcctccctgcccccgcccgcag

SEQ ID NO: 67401 - DNA, 201 bp, Homo sapiens
gcatgatgctagaggtatggagaaggattcagctggatccccaaagcttagctggcagagctatgaaagaagagatttaactggagacatacaatgcatasaaaaggaagaacaggggaaaagatacagacttttttccatcatgtagactcagggtttacgttgtgccccatataatgtctgtataaacttggccaaatc

SEQ ID NO: 67402 - DNA, 201 bp, Homo sapiens
taaaggttagtaaaccttaaccctctatatgccccacatatatagctcacagtgttaaatcaagtttagcctaaagctgcctccttacatattttaagttyggcctgaaggtttttctgtacgtcgtgaactataacaagtggaggtgtaaacagaaggtggcctacacttgtgccaatcaccgagttttgggcaatcaaa

SEQ ID NO: 67403 - DNA, 201 bp, Homo sapiens
agcctaaagctgcctccttacatattttaagttcggcctgaaggtttttctgtacgtcgtgaactataacaagtggaggtgtaaacagaaggtggcctacrcttgtgccaatcaccgagttttgggcaatcaaatgtagccaactgttcgaactgtgtacagcaaacgccgagctgtaatcaattcagctgtttctgtacc

SEQ ID NO: 67404 - DNA, 201 bp, Homo sapiens
tttgctaattggagctaccattttggaaaataattaaaaaaatttcccatgatgccttcaatgtggttttgcactttcatctagactccttgatgttttcraagttcagatgaattttgcaacatgccccccccaccccacctttggcagcagctcagtcaccatgtcaccaagacagaataaatatgagcttcccatctc

SEQ ID NO: 67405 - DNA, 201 bp, Homo sapiens
acagaaggtggcctacacttgtgccaatcaccgagttttgggcaatcaaatgtagccaactgttcgaactgtgtacagcaaacgccgagctgtaatcaatycagctgtttctgtacctcacttacgttttctgtatgtcactttcctttttctgtccataaatcttccaccacatggctgtgctggagtttcagcctactc

SEQ ID NO: 67406 - DNA, 201 bp, Homo sapiens
tatccttcccttcatagagcttcattgaaatttttcatgctgtgttacccaagacaaggatctgctactattgaagatactgatttctgcatcattgtagktattcaaacagagcatggcattttacaaatgtattggagatataaatgtatctccagagattcaaggaactatcaggagatctttggcaaattgtctggg

SEQ ID NO: 67407 - DNA, 201 bp, Homo sapiens
ccgacatctgcacggcttcttcgcatattaaacatcacaaggagagctaagaagttgcacaaacaaaactctgacaatctgagatgctaagacattttacmgactggagggaggaggcggggagggtgcatgtggaggtgcactcatgagatgctactcatgtggagatgaggcctgggtcggctgagcatcatccaaccc

SEQ ID NO: 67408 - DNA, 201 bp, Homo sapiens
ttcaaaaccagcctggccaacatagcaaaactctgtctctactaaaaatacaaaaaattagctgggctgtggtggtgcatgcctgtaatcccagctactcwggaggctgaggcacaataatcgcttgaaccaggaggcagaggttgcagtgagctgagatcgcaccactgcactccagcctgggtaacagagttgagaccc

SEQ ID NO: 67409 - DNA, 201 bp, Homo sapiens
aagatgttctaaataagtagaatatcagggacatttaggaaaacataaaagtctaacatttccacaataagagtctcagaagaggaggaaaaaaacaaaayataatattgattgattcaacataaatactatggtttatttctagatggcaaggaaaatcacgtgtaagaggtttccatttaaaagaattccactattcat

SEQ ID NO: 67410 - DNA, 201 bp, Homo sapiens
tgggaagctggtatgatctcagtggagggcaatttagcaatatctatcaaaatgacaagaacactcacccttaggctcacaatcccactactggtgatttmtcctgcagatgtagttgcacagctgtggaaggacttacttacaaggttaatcattgttgtttgtgaaagcagcagattagaaacaacccagactccacca

SEQ ID NO: 67411 - DNA, 201 bp, Homo sapiens
acccaggcaatccggctccagagtgtttttaaccatttccctgcactgcctcctgccggtcaaaagaataaatgcatatgcaggcaagaatgaatgggtggtcccatttccgtagaaggggaaaccgaggtcggggagctgggcggggagaccccagcatcctctgacctctttccttgcctccctgcccccgcccgcagg

SEQ ID NO: 67412 - DNA, 201 bp, Homo sapiens
ctcttgggcccaagggatcctccagctcagcctcctgagtagctaggactataggctcgtgctaccacctagctaatttctttttcttttcttttcttttcttttttttaactttttgtaaagatgaggtctcttgctacgttacttgggctgttctcaaactcctggcctcaagcgatgcccctgcttcagcctcccaaa

SEQ ID NO: 67413 - DNA, 201 bp, Homo sapiens
ccccagctagtcacacccgtgatgcccatctcttttttttttttgagatggagtctcgctctgtcgcccaggctggaatgcagcagcacgatctcggctcwctgcaagctctgcctcccgggttcacgccattctcctgcctcagcctcccgagtagctgggactacaggtggccggcaccacacccggctaattttttct

SEQ ID NO: 67414 - DNA, 201 bp, Homo sapiens
cacacccgtgatgcccatctcttttttttttttgagatggagtctcgctctgtcgcccaggctggaatgcagcagcacgatctcggctctctgcaagctcygcctcccgggttcacgccattctcctgcctcagcctcccgagtagctgggactacaggtggccggcaccacacccggctaattttttctattttttagta

SEQ ID NO: 67415 - DNA, 201 bp, Homo sapiens
aatgcagcagcacgatctcggctctctgcaagctctgcctcccgggttcacgccattctcctgcctcagcctcccgagtagctgggactacaggtggccgscaccacacccggctaattttttctattttttagtagagacggggtttcaccgtgttagccaggatggtctcgatctcctgacctcatgattcgcccacct

SEQ ID NO: 67416 - DNA, 201 bp, Homo sapiens
ctcctgacctcatgattcgcccacctcggcctcccaaagtgctgggattacaggcgtgagccactgcgcccggagatgcccatctcttaaaataaaaaataaaaaaaaaaaaagaaagagagaaaggaaaggaggcaggagggatcctgggaaggcaaacaacagctattgagcgcaaaccaaatccaaaacttctccact

SEQ ID NO: 67417 - DNA, 201 bp, Homo sapiens
tcctgacctcatgattcgcccacctcggcctcccaaagtgctgggattacaggcgtgagccactgcgcccggagatgcccatctcttaaaataaaaaataaaaaaaaaaaaagaaagagagaaaggaaaggaggcaggagggatcctgggaaggcaaacaacagctattgagcgcaaaccaaatccaaaacttctccactt

SEQ ID NO: 67418 - DNA, 201 bp, Homo sapiens
aatcacttgaacccgggaggcggaggttgcagtgggccgagatcacgccactgcactccaacctgggcgacagagagactctgtctcaaaaaaaaaaaaagaaaagaaaagaaaaaaaaaaccatgctgaattggccaaatatttatctaggacttcccagcctgagaactgtaagaaataaaattttactctttaagcca

SEQ ID NO: 67419 - DNA, 201 bp, Homo sapiens
gtagtcccagctacttgggaggctgaagcatgagaattgcttgaacccaagaggcgcaggttgcagtgagccaagatcgtgccactgcactccagcctggrtgacagagcgagactctgtcaaaaaaaaaaaaaaagaaaaaaaatgattcagtggttcaagtcatgcgaagtcaaaggctttgatggcagctgactgcag

SEQ ID NO: 67420 - DNA, 201 bp, Homo sapiens
cccgggaggcggaggttgcagtgggccgagatcacgccactgcactccaacctgggcgacagagagactctgtctcaaaaaaaaaaaaagaaaagaaaagaaaaaaaaaaccatgctgaattggccaaatatttatctaggacttcccagcctgagaactgtaagaaataaaattttactctttaagccactgagtccatg

SEQ ID NO: 67421 - DNA, 201 bp, Homo sapiens
cacaataagagtctcagaagaggaggaaaaaaacaaaacataatattgattgattcaacataaatactatggtttatttctagatggcaaggaaaatcacrtgtaagaggtttccatttaaaagaattccactattcatcaaaattttcatctattctcaagactgttgatttcaaactaggtttagagtagcaaagcata

SEQ ID NO: 67422 - DNA, 201 bp, Homo sapiens
tccagccagctcacccattggccacctgtatctcctgctgtagcagccagaaagctacaactcccagccggctgagcgccaccagcgctttcgcgtccaaktccctttgctgagtgtgagggcctgcgcagtagaacccgcgggcccagagctccatctgagcatgtgcaggctgcggggtgtttccttcgtctgctggcg

SEQ ID NO: 67423 - DNA, 201 bp, Homo sapiens
tctctcttccagactacctaactgactcattttacaaattctgctgtctaagataggacacgaggtaagggtccctttcactaatgcttctgaagagcacrtccagggccaggtcccctttcttctccaccatgctcagcaaggcctcattcttgctctgccgtgtcttttcctgctccaccagctccttctcattctcag

SEQ ID NO: 67424 - DNA, 201 bp, Homo sapiens
tacatttgtgctccatatactcaccagtagtaggcattactgacttcttaataaatggaagtttgatgaatataaaatgtagtatttttatggcttttaawgaggtttctgataactagacgtatgaaattctacttttgttcattgtccattgcgatttacaaactgtaacattttactcataacgtttgcccatttttc

SEQ ID NO: 67425 - DNA, 201 bp, Homo sapiens
caagtctgtcctgaaagcctgtgtgatagatgttacccagtcttcttctgtcttgaacactgaaatcaatgatcacatttctgtttatccatttccaatgsgaacgctggattctctcttccagactacctaactgactcattttacaaattctgctgtctaagataggacacgaggtaagggtccctttcactaatgctt

SEQ ID NO: 67426 - DNA, 201 bp, Homo sapiens
ctggccaatggaacttaacccgtttcctgtgcaatgtcatggctggttgagtgggaaacagagggagagaggtaaacagctctttacatttacaatgttargaaatgcttttataccaggaagggaagaataacctagctgtcaacaccacatgagtcagagaaaaactatctgagctaccaactgaatacaaacgtctta

SEQ ID NO: 67427 - DNA, 201 bp, Homo sapiens
tccctggaaggggagttgtcttttcattttgaaggctgtcttggaatctcggctaaaccacggttggctcctgcgtctgtgttttgacctgctttcatactttttttttttttttttttgagacggagtttcgctcttgtcacccaggctggagtgcaatggcggaatcttggctcaccgcaacctccgcctcccgggttc

SEQ ID NO: 67428 - DNA, 201 bp, Homo sapiens
agactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaaga

SEQ ID NO: 67429 - DNA, 201 bp, Homo sapiens
tgtcaggcaaccatcaggtgatggtcaggcagttgttacaccgtctctctaaaataataattggttgcagccggcaccagggaaaggccgtctcctgacasagagaaaacacctgaaactggtgatcagcagcttcccaataagatctcgggaactgggccagtgggctcaagaatgtgcattaagagcagagtttaactg

SEQ ID NO: 67430 - DNA, 201 bp, Homo sapiens
ttaaaaaaatttcccatgatgccttcaatgtggttttgcactttcatctagactccttgatgttttcaaagttcagatgaattttgcaacatgcccccccmaccccacctttggcagcagctcagtcaccatgtcaccaagacagaataaatatgagcttcccatctcctgtgaggtctcacaattgagtttctggtcatt

SEQ ID NO: 67431 - DNA, 201 bp, Homo sapiens
ccattgttgtgttatcacactgataatacactgacaatagatttctcttttttttttcttttttggcaagaacattttattttattcaaactatttttttwaatttaatttaagttctgggatacatgtggaggacatgcaggtttgttacaaaggtaaacatgtgccatggtggtttgctgcacctatcaaatcatcacc

SEQ ID NO: 67432 - DNA, 201 bp, Homo sapiens
caaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagat

SEQ ID NO: 67433 - DNA, 201 bp, Homo sapiens
ctgcactccagcctgggtaacagagttgagaccctgtcttgaaaaaaaaaaagctcaaacaagcaaatgctgacacatttgcaggaaaatagaatataagscaagaaatttaaaatatagagaacaaaatggaaattttagaactgatacatacagtgaccaaaatttaaaaggtggtgaatgcactcagtgggacgacac

SEQ ID NO: 67434 - DNA, 201 bp, Homo sapiens
tgtagtgggccaagaccacaccactgcactccagcttgggcaacagagcgagactccatcaaaaaagaaggaaagaaagagagaaagagggaaagaaaggraaggaaggaaggaaggaaggaaggaaggaaggaaggaaggaaggaaggaaagaaagaaagaaaagaaagaaagaaagaaagagagaaagagggaaaaaag

SEQ ID NO: 67435 - DNA, 201 bp, Homo sapiens
aaaaagaaggaaagaaagagagaaagagggaaagaaaggaaaggaaggaaggaaggaaggaaggaaggaaggaaggaaggaaggaaggaaagaaagaaagaaaagaaagaaagaaagaaagagagaaagagggaaaaaagaaagaggaaggaaggaaggaaggaaatctatttggaaatatactagctttaagttggttaa

SEQ ID NO: 67436 - DNA, 201 bp, Homo sapiens
aaaagaaggaaagaaagagagaaagagggaaagaaaggaaaggaaggaaggaaggaaggaaggaaggaaggaaggaaggaaggaaggaaagaaagaaagaraagaaagaaagaaagaaagagagaaagagggaaaaaagaaagaggaaggaaggaaggaaggaaatctatttggaaatatactagctttaagttggttaat

SEQ ID NO: 67437 - DNA, 201 bp, Homo sapiens
tccagccagctcacccattggccacctgtatctcctgctgtagcagccagaaagctacaactcccagccggctgagcgccaccagcgctttcgcgtccaawtccctttgctgagtgtgagggcctgcgcagtagaacccgcgggcccagagctccatctgagcatgtgcaggctgcggggtgtttccttcgtctgctggcg

SEQ ID NO: 67438 - DNA, 201 bp, Homo sapiens; identical to SEQ ID NO: 67305

SEQ ID NO: 67439 - DNA, 201 bp, Homo sapiens
ttgcctcggtctctccttctgccttatgcccctcagtcaaattctgtcttctaaggaggcaagaattgaggttgctgcagacctatacggatttgctgccrgtaacgttctggtgccatgtcacttggataccttccactgtcactcaaagaccccttgatgtctcatacatacccttggctttaatgtaaacatttcact

SEQ ID NO: 67440 - DNA, 201 bp, Homo sapiens
ttgcctcggtctctccttctgccttatgcccctcagtcaaattctgtcttctaaggaggcaagaattgaggttgctgcagacctatacggatttgctgccsgtaacgttctggtgccatgtcacttggataccttccactgtcactcaaagaccccttgatgtctcatacatacccttggctttaatgtaaacatttcact

SEQ ID NO: 67441 - DNA, 201 bp, Homo sapiens
acaagactttacacagatccagaggacattgcagattgctgccttgggtgatttttaaaattaacgtggacatgaagtcatcaggagacaaggagttccaracctggatttattgcttactagatgatggaaacttggtcctctcagtgttaactctattttatttatttacttatttatttatttattttgagacaaagt

SEQ ID NO: 67442 - DNA, 201 bp, Homo sapiens
ttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggc

SEQ ID NO: 67443 - DNA, 201 bp, Homo sapiens
caatctccgcccctgggttcaagcgattctcctgcctcagccccccgagtagctgggatcacaggcatgtgccaccacgcccagctagtttttgtattttyagtagaggcagggtttcaccatgttggccaggctggtctcaaactcctgacctcaggtgatccacctgcctcggcctcccaaagtgttgggattacaagt

SEQ ID NO: 67444 - DNA, 201 bp, Homo sapiens
aattaaactctatttatttatttagagatggagtctcgctctgttgcacaggctggagcacagtggtgcgatctcagctcactacaacctccaccttctgsgttcaagcaattcttgtgcctcagcctcccgagtagctgggactacaggtgcccaccaccatgcctagctaatttttgtatttgtagtagagacagggtt

SEQ ID NO: 67445 - DNA, 201 bp, Homo sapiens
cccccgagtagctgggatcacaggcatgtgccaccacgcccagctagtttttgtatttttagtagaggcagggtttcaccatgttggccaggctggtctcraactcctgacctcaggtgatccacctgcctcggcctcccaaagtgttgggattacaagtgtgagccactgcacccagccaactctttatattaaataatg

SEQ ID NO: 67446 - DNA, 201 bp, Homo sapiens
gtccctctaacagtttaattcacagccatatcaaactactttaacttagagttccccagacgcaagatattaaatatttacccccaataatttgctgttgyatgctcttttgtgtctacatgatgtcctcacgcccttctgggactaaatcatactcattgtctgtatttatgacatcagtcattcttggcagatgacaag

SEQ ID NO: 67447 - DNA, 201 bp, Homo sapiens
aagaacttgggcaaaggtgctgtggccacagatgtttccagccaaaaaattgacaccccaaagatcccataacactagggcgcttggactttatcctgcayatatgggctgccgcaaatgggattacacagtgggcatcaggctcaggagagcacattggaagggactctgtggtggccaagtgtggtggcaaatgcctgt

SEQ ID NO: 67448 - DNA, 201 bp, Homo sapiens
cgtgaggagatattggcatgacaggagagcctctcgcattctgaaaggaaatagaggaatttttgcatcctcactgacaaaccaaatgacagaacttcatrtaggagtgaaaaatagaacaagggcacttaaaaattccaatttgattcccctatgccctataattccaagcaaaggggacctgtcctcttcaaatccatc

SEQ ID NO: 67449 - DNA, 201 bp, Homo sapiens
agcctctctttcaggaagtgatcataaaagcatccccttccacctcacaggtgctgagaatgtaagagaagaaggtcagctctccctctgccggtgggacraagggcccagtggtggcctgcaggctcaggggtgtctgctcccgctgcctggcctctatctgctcctggcacctgctcccatctcagagcggggttgggg

SEQ ID NO: 67450 - DNA, 201 bp, Homo sapiens
ccagtcccatggactggagtggggactcatggtgcctcttccagcccacccatggctgcccgtggaccaattggcatggacttcctccctgataaaaggtscataaaagccctaggctcagccagagcagatcagaggatggccagaggatgaggagagcagagagacaatggcacaaccagctgcagagaggagtactct

SEQ ID NO: 67451 - DNA, 201 bp, Homo sapiens
acccatggctgcccgtggaccaattggcatggacttcctccctgataaaaggtccataaaagccctaggctcagccagagcagatcagaggatggccagargatgaggagagcagagagacaatggcacaaccagctgcagagaggagtactctctgctgatagctggagatgatgggatgactagcagcagagaggagct

SEQ ID NO: 67452 - DNA, 201 bp, Homo sapiens
gaggcaaatacacacacgaagacacacacccagaaacacttcacacacgtacacactcgcacatgcatgcaaacacacgtcacatacatgaccaaatgtgygcacacaccaagacgttcactggccgggagaaacagtcaagatatttacaaagcagtgtggcccggacaccaacccatcacattaggagacaactgctgc

SEQ ID NO: 67453 - DNA, 201 bp, Homo sapiens
ccaaccacctcacacatttcagctgttaatggtgatgatgatgtcagagctgggagggctggagagatgccccaaacctggggttcaggtgtagcctgttraggctcccttgagaatctaatgaaagcagatgaccctctgttctgcaggcagcctcaagacagtgttttgcacgttaagaccctcctaggtgctctaaca

SEQ ID NO: 67454 - DNA, 201 bp, Homo sapiens
tgtgcacacaccaagacgttcactggccgggagaaacagtcaagatatttacaaagcagtgtggcccggacaccaacccatcacattaggagacaactgcygcagagctggaggaagatcctgttggccctacagggtcaggtattgaagctttgttgccagatcgtgggagggactgagcagcaagagtgtcggcaggga

SEQ ID NO: 67455 - DNA, 201 bp, Homo sapiens
cagctgtagcatgtatgtaagagtagtcttctgatgactatttgtccaacacattatttccctatttctgatcaactgaggaagggctttctattttaaawtttttctttttttttttttgagacagagtttcattcttgttgcccaggctggagtgcagtggcatgatcttggctcactgcaacctctgcctcctgggtt

SEQ ID NO: 67456 - DNA, 201 bp, Homo sapiens
attgaagctttgttgccagatcgtgggagggactgagcagcaagagtgtcggcagggaggcccctggtggactcgggggaatagctctttaaccaccaggragaaggaatggctcttaagccaccagggagaagaacttcaatattttggaaaacaacccacgcctttgtgttctggtgatcgcccctttgcctgaggagg

SEQ ID NO: 67457 - DNA, 201 bp, Homo sapiens
ttcccactccatctcccttctggctcccccatctgctgagagctacttccactcaataaaaacttgcactcggtccctaagcccacgtgtgatctgattcytccagtacaccaaggcaaaaaccctgggatacagaaagccctctgtccttgtgataaggcagaggatctaatcgagctgattaacacaagctgcctacag

SEQ ID NO: 67458 - DNA, 201 bp, Homo sapiens
cacgctctgatctgtgagcacacatcatgtacgtgtccacatgtgttctaagcagcaggccaggacctgcctctggggtccagcacagccactgttcccartaggggaggcacaaggcacctcaaggtaagggactagactcggggctggagtggcccccttaccttcaccacgatgggaacccttgggacaggctctcgg

SEQ ID NO: 67459 - DNA, 201 bp, Homo sapiens
tcctggggagtgctcagtcactactctgacccccagctcctgggacagagcccaaccctctgcccttcctctcctccagggcctggggacacctggacagkggcatccccacccagtgccatcctggcccacccaccgggctccagcacagccctcttggcaatgatgttgacagcggccatgcagacagactccacatag

SEQ ID NO: 67460 - DNA, 201 bp, Homo sapiens
ctgtccagattcagactaggcccttccaccacagcagtccccacagctgggtggaagcctggaggtcaggaaggaggagcgctagttgctttcaacacttyaatggtgaaatcatgcagagaagcacttctcatgttaatccatctcacacacattccaagagcacctactatgtgtaaggcacacagtgggacaagcaga

SEQ ID NO: 67461 - DNA, 201 bp, Homo sapiens
ttgaggtcaggagttcgagaccagcctggccaatatggcgaaaccccatctctaataaaaatacaaaaaaaaaaaaaattacctgggcgtggtgccttgcrcctgttgtcccagctacttgggaggcaaagacacgagaatcagttgaacctgggcagaggttggggtaagccaagattgcatcaccatactgcagcctgg

SEQ ID NO: 67462 - DNA, 201 bp, Homo sapiens
ggaactattgagataaatgctagaagaaatgcctaacagaattcgaagtattggccttggaggtcaggagtccgggagttgggagctgaggagacacactygtgagtccatttgtgataaacttcaactgtgtcatgcatcctttaaatttgaaatttttgaaaagttaaaggttaaaacaaatcaaaagggccttgcaga

SEQ ID NO: 67463 - DNA, 201 bp, Homo sapiens
ccgaaagggaaaggaaaggaaaggaaaggaaaggaaaggaaaggaaaggaaaggagaaaggaggaaggaaggaaggaaaagaaagaaagagagacagaaaraaagaaagaaaagagtgagtttgaaatattgtaaaaattaccaaaacatgacacagagacacaaagtgagcacatgctttagggaaaaaggtgtcagtac

SEQ ID NO: 67464 - DNA, 201 bp, Homo sapiens
cttccatctggaaagagttcacatttcccaaagcctgctcacacccctaagtatcgtacccataatccgtgcttcttatatcctgagtgtttgggcataascaagaccattttgcaggcgggaaatttgatgttctgggatgccctcatgagatgcacctgactggatgggctgttgagctcctctagcttctctgagtgg

SEQ ID NO: 67465 - DNA, 201 bp, Homo sapiens
actagactcggggctggagtggcccccttaccttcaccacgatgggaacccttgggacaggctctcggtagcagaggcggaaggagccatagtggccatckttgagataatacaccagcttccggctgcctcctggggagtgctcagtcactactctgacccccagctcctgggacagagcccaaccctctgcccttcctc

SEQ ID NO: 67466 - DNA, 201 bp, Homo sapiens
aggcctatgaactaaagctgaagtctcgcctgctagggtggagtctgtcaaatatttcactggcatgactgattgtaaccttgcctatcagatgaagcactaatgcagggtagaatcaatcacccctctccagaccttaagacccctacgtattccacaactttttaccctatatatgttaactgcatatttctttattta

SEQ ID NO: 67467 - DNA, 201 bp, Homo sapiens
caaaataataagagctatttatgacaaacccacagccaatatcatactgaatgggcaaaaactggaagcactccctttgaaaactggcacaagacagggaygccctctctcaccactcttattcaacatagtgttggaagttctggccagggcaatcgggcaggaggaagaaataaagggtattcattaggaaaagaggga

SEQ ID NO: 67468 - DNA, 201 bp, Homo sapiens
ggtctcaaactcctgacctcgtgatctgcccgcctctgcctcccaaagtgctgggattacaggcgtgagccaccgcgcccggccttgttttaaattttttyaatcctaaagtcccaaggtttataaaacacatcaaatggcctattcttcctcccaactcctcaaggctcttcagcaatatggttgaccatgcaacacatc

SEQ ID NO: 67469 - DNA, 201 bp, Homo sapiens
ttatgacaaacccacagccaatatcatactgaatgggcaaaaactggaagcactccctttgaaaactggcacaagacagggacgccctctctcaccactcytattcaacatagtgttggaagttctggccagggcaatcgggcaggaggaagaaataaagggtattcattaggaaaagagggagtcaaattgtccctgttt

SEQ ID NO: 67470 - DNA, 201 bp, Homo sapiens
aaaactggcacaagacagggacgccctctctcaccactcttattcaacatagtgttggaagttctggccagggcaatcgggcaggaggaagaaataaaggrtattcattaggaaaagagggagtcaaattgtccctgtttgcacatgacatgattgtatatttagaaaactccatcgtctcagcccaaaatctccttaagc

SEQ ID NO: 67471 - DNA, 201 bp, Homo sapiens
gtgaaaccccgtccgtacaaaaatacaaaaattagctgggtgtgttggcacgcacttgtaatcccagctactcaggaggctgaggcaggagaatcgcttgwgcccaggagacggaggttgcagcgagccaagaccatgctattgcactccagcctgggagagtgagactccatctcaaaaaaaaaaaaaatatatatatat

SEQ ID NO: 67472 - DNA, 201 bp, Homo sapiens
aactggcacaagacagggacgccctctctcaccactcttattcaacatagtgttggaagttctggccagggcaatcgggcaggaggaagaaataaagggtwttcattaggaaaagagggagtcaaattgtccctgtttgcacatgacatgattgtatatttagaaaactccatcgtctcagcccaaaatctccttaagctg

SEQ ID NO: 67473 - DNA, 201 bp, Homo sapiens
agaatcgcttgtgcccaggagacggaggttgcagcgagccaagaccatgctattgcactccagcctgggagagtgagactccatctcaaaaaaaaaaaaaatatatatatatatatatatttcaatggtacttctattgttatctgtttttttgtttgtttgtttgtttgtctgtttgagatggagtctcgctctgtcacc

SEQ ID NO: 67474 - DNA, 201 bp, Homo sapiens
accataaaaaccctagaagaaaacctaggcaataccattcaggacataggcatgggcaaggacttcatgtctaaaacaccaaaagcaatggcaacaaaagmcaaaattgacaaatgggatctaattaaactaaagagcttctacacagcaaaagaaactaccatcagaatgaacaggcaacctacagaatgggagaaaatt

SEQ ID NO: 67475 - DNA, 201 bp, Homo sapiens
gaatcgcttgtgcccaggagacggaggttgcagcgagccaagaccatgctattgcactccagcctgggagagtgagactccatctcaaaaaaaaaaaaaatatatatatatatatatatttcaatggtacttctattgttatctgtttttttgtttgtttgtttgtttgtctgtttgagatggagtctcgctctgtcacca

SEQ ID NO: 67476 - DNA, 201 bp, Homo sapiens
ctaaacttgaaggagttgactcctggattcacatttctaagttaagaaaagctccaacacctaaatggacttctaagtccaccagagacctccaattaaaratctctaagatttctgactcctctgaaggtgggaaggagacatctgagtagacagcatttcccaagataccagaccaggtgtgtattcatgatgattttc

SEQ ID NO: 67477 - DNA, 201 bp, Homo sapiens
tgtgttctaagcagcaggccaggacctgcctctggggtccagcacagccactgttcccagtaggggaggcacaaggcacctcaaggtaagggactagactyggggctggagtggcccccttaccttcaccacgatgggaacccttgggacaggctctcggtagcagaggcggaaggagccatagtggccatctttgagata

SEQ ID NO: 67478 - DNA, 201 bp, Homo sapiens
aggcctatgaactaaagctgaagtctcgcctgctagggtggagtctgtcaaatatttcactggcatgactgattgtaaccttgcctatcagatgaagcacraatgcagggtagaatcaatcacccctctccagaccttaagacccctacgtattccacaactttttaccctatatatgttaactgcatatttctttattta

SEQ ID NO: 67479 - DNA, 201 bp, Homo sapiens
ctggggtccagcacagccactgttcccagtaggggaggcacaaggcacctcaaggtaagggactagactcggggctggagtggcccccttaccttcaccaygatgggaacccttgggacaggctctcggtagcagaggcggaaggagccatagtggccatctttgagataatacaccagcttccggctgcctcctggggag

SEQ ID NO: 67480 - DNA, 201 bp, Homo sapiens
tggggagtgctcagtcactactctgacccccagctcctgggacagagcccaaccctctgcccttcctctcctccagggcctggggacacctggacagtggyatccccacccagtgccatcctggcccacccaccgggctccagcacagccctcttggcaatgatgttgacagcggccatgcagacagactccacatagaag

SEQ ID NO: 67481 - DNA, 201 bp, Homo sapiens
cctgggccagggcagcactgatcactctcgccaactggaatggggtggagggacagcaggaagaggttaactcatccagcacgtgttgatgtgccagcgcytgtgccaacgccttacctgcatcagtcctttcatccccgaggcaccctgcaggtaggcattagaattatccctgtttaccaaagaggaaacagaagttga

SEQ ID NO: 67482 - DNA, 201 bp, Homo sapiens
tcacttgtgtggggttgctggccaccaggctccctgagaagtccaaaggtgcagcaatttaatctgatgcaccgtaagaaggcgagtgtcttgtggacccrgggaatgtaaactcccaactgtaactgtaactgtattggtgatgctaacaagaattctacattctacaggaaaacatatacacatacagacacacagaca

SEQ ID NO: 67483 - DNA, 201 bp, Homo sapiens
cagcctacctgagctcatctgcccgtgcaaaatgatttccagcctccagcgcctgcctccctttgcttctcattctgtgggctttctccagcaccctcggmaactagctggaatgtgaggaaattaacacccccagaccacagccttcaaccaaagaaggacaggagttggtgaataaaggaccagccccatgtcctctag

SEQ ID NO: 67484 - DNA, 201 bp, Homo sapiens
tccaattaaagatctctaagatttctgactcctctgaaggtgggaaggagacatctgagtagacagcatttcccaagataccagaccaggtgtgtattcaygatgattttcttctgcatataccttttgtttttgcattttcctgtcacgataatgagtatctagtaacatcctctcctttgtttgatccccatttctctt

SEQ ID NO: 67485 - DNA, 201 bp, Homo sapiens
tttgtaaaacaaaacaaaacaaaacaaaaacacaacaaatatctgcaggtgcaacaaagcaagtgcaagaaaatgaggggtgcctgtactgtaaattgctyttgtaaagatgcacagctctaccaagtgccacgaacaatgagcatagcttcccttcctccactcctgaccctgaacacccctgcccaagggttcttcttt

SEQ ID NO: 67486 - DNA, 201 bp, Homo sapiens
tgagagaatacatttctgtcatttttattttattttatttttaaaaataagacagagtctttctatgttgcctaggctggccttaaactgctgggctcacrtgatcctcctgttggatacaatgagttcaaaatttctcttcaaagaatcaatatgtcaatatgttcagttctttgtcctccattttaaagtttaacttcc

SEQ ID NO: 67487 - DNA, 201 bp, Homo sapiens
caaacatgtttttagccaaagaaggaggaaatactcatgatagttacagtccgcatttctgcagctggtcacatggtcataggtggtattgatgattaccwtcttctactacccattctgtattccctttgccttcagcaagcacctcagcaggttgtggtttttttcctggtggagtgacccaaaccttcattcctgagg

SEQ ID NO: 67488 - DNA, 201 bp, Homo sapiens
tgggatacagaaagccctctgtccttgtgataaggcagaggatctaatcgagctgattaacacaagctgcctacagatagcaaaactaaaagagcgctctktaacacacacccattggggcttcaggaactgtaagcattcacccctagacactgccgtggggttgaagccccacaacctgcccatctgcatgctccccct

SEQ ID NO: 67489 - DNA, 201 bp, Homo sapiens
aggcaaagacacgagaatcagttgaacctgggcagaggttggggtaagccaagattgcatcaccatactgcagcctgggtaacaaagctagacccgaaagggaaaggaaaggaaaggaaaggaaaggaaaggaaaggaaaggaaaggagaaaggaggaaggaaggaaggaaaagaaagaaagagagacagaaagaaagaaa

SEQ ID NO: 67490 - DNA, 201 bp, Homo sapiens
ggcaaagacacgagaatcagttgaacctgggcagaggttggggtaagccaagattgcatcaccatactgcagcctgggtaacaaagctagacccgaaagggaaaggaaaggaaaggaaaggaaaggaaaggaaaggaaaggaaaggagaaaggaggaaggaaggaaggaaaagaaagaaagagagacagaaagaaagaaag

SEQ ID NO: 67491 - DNA, 201 bp, Homo sapiens
gactacaggtgtgtgccaccatgcctggctaatttttttttttttgagtagagacggggtttcaccatgttagccaggatggtctcgatctcctgacctcrtgatctgccagccctggcctcccaaagtgctgagattacaggcgtgagccactgcgcccagcctgttatctgttttaacaagtcccagtcttccttccag

SEQ ID NO: 67492 - DNA, 201 bp, Homo sapiens
gcaaagacacgagaatcagttgaacctgggcagaggttggggtaagccaagattgcatcaccatactgcagcctgggtaacaaagctagacccgaaagggaaaggaaaggaaaggaaaggaaaggaaaggaaaggaaaggaaaggagaaaggaggaaggaaggaaggaaaagaaagaaagagagacagaaagaaagaaaga

SEQ ID NO: 67493 - DNA, 201 bp, Homo sapiens
cccccagacaccttgctgcagctgcagtggacaccctgtgccacctcccctcagcctacctgagctcatctgcccgtgcaaaatgatttccagcctccagygcctgcctccctttgcttctcattctgtgggctttctccagcaccctcggaaactagctggaatgtgaggaaattaacacccccagaccacagccttcaa

SEQ ID NO: 67494 - DNA, 201 bp, Homo sapiens
caaagacacgagaatcagttgaacctgggcagaggttggggtaagccaagattgcatcaccatactgcagcctgggtaacaaagctagacccgaaagggaaaggaaaggaaaggaaaggaaaggaaaggaaaggaaaggaaaggagaaaggaggaaggaaggaaggaaaagaaagaaagagagacagaaagaaagaaagaa

SEQ ID NO: 67495 - DNA, 201 bp, Homo sapiens
aaagacacgagaatcagttgaacctgggcagaggttggggtaagccaagattgcatcaccatactgcagcctgggtaacaaagctagacccgaaagggaaaggaaaggaaaggaaaggaaaggaaaggaaaggaaaggaaaggagaaaggaggaaggaaggaaggaaaagaaagaaagagagacagaaagaaagaaagaaa

SEQ ID NO: 67496 - DNA, 201 bp, Homo sapiens
aagacacgagaatcagttgaacctgggcagaggttggggtaagccaagattgcatcaccatactgcagcctgggtaacaaagctagacccgaaagggaaargaaaggaaaggaaaggaaaggaaaggaaaggaaaggaaaggagaaaggaggaaggaaggaaggaaaagaaagaaagagagacagaaagaaagaaagaaaa

SEQ ID NO: 67497 - DNA, 201 bp, Homo sapiens
gggccaagccctggggccttgaatggcagcgggaggcagacagagtcctgggcagaagggggcaggtccccagtaagaccccactttcaggtcagggaagkcctgaaggctgcgggccaggctgccagtcccatggactggagtggggactcatggtgcctcttccagcccacccatggctgcccgtggaccaattggcat

SEQ ID NO: 67498 - DNA, 201 bp, Homo sapiens
tccctttgcttctcattctgtgggctttctccagcaccctcggaaactagctggaatgtgaggaaattaacacccccagaccacagccttcaaccaaagarggacaggagttggtgaataaaggaccagccccatgtcctctagtgggatgattctgaggttctacattgtccccagggggactggtgcagcggcccacag

SEQ ID NO: 67499 - DNA, 201 bp, Homo sapiens
tgcttttgggggatatcaaagccaagacatgcacatacacacatacccacctgtgcacacagagcacagagatacaccagagagacctaaacacacagagrtacatgcatgaacacagactccccacacacacccatgcctgggcacacatgcggacctccctgaacacccccagcgcccgtaccagctcacctcctcaaa

SEQ ID NO: 67500 - DNA, 201 bp, Homo sapiens
aaaatgaatgaaggaaagctcttctatgcagaagaatttcagctactacatgaagaaaaaattagaatcagaaaattatcattttttaagcccctaagaawataactgattcaagcaatggttttcaatggatgccaaaatcactcagtgaaaggttgatggagaacttctcagtgaagggtaaggttgccattgcctgaa

SEQ ID NO: 67501 - DNA, 201 bp, Homo sapiens
aaaccacaaagccacacagactgtggataaccgcaacagagacagagaggcacagtcacacataaggcatgaagccactggggccaaatgcagaaacaaasagcggaaacataactgattacactggcataagtgtgtgctttcagacagctgcacactcaggccaacgaggcacctacgaaggggcactcaccctgagta

SEQ ID NO: 67502 - DNA, 201 bp, Homo sapiens
ctttgagcctgttctgctgctgatctgggcaagtacttgacctttctgtgcttccattttcctctgccaaatggtgaggctaacacatgctacttggtagkgttgttatgaggactgaataagccaatacacatgaaaggctgaggataacttttcctttgcagtcacaactacgctgtttggtataagaggcctaacttt

SEQ ID NO: 67503 - DNA, 201 bp, Homo sapiens
gcagatgaaaaagagcaggagaagaaaagaagatacagaaagaaaataaaagttactgggcactgttggggaagttggggcaccaacttattactctaaarattgttaattaaaggaaaagaattaagcattttttatgcctaactgcattttctggtaattaaatagccaaaatgaatgaaggaaagctcttctatgcag

SEQ ID NO: 67504 - DNA, 201 bp, Homo sapiens
taacacatgctacttggtagtgttgttatgaggactgaataagccaatacacatgaaaggctgaggataacttttcctttgcagtcacaactacgctgttwggtataagaggcctaactttcggcctattttggctttcaatacacttacctcactaagtttaatatttctagcttttgatttagagcaagggatgtgtga

SEQ ID NO: 67505 - DNA, 201 bp, Homo sapiens
catctcctagggtattgaagtaccctacttctagccagcagatgaaaaagagcaggagaagaaaagaagatacagaaagaaaataaaagttactgggcacygttggggaagttggggcaccaacttattactctaaagattgttaattaaaggaaaagaattaagcattttttatgcctaactgcattttctggtaattaa

SEQ ID NO: 67506 - DNA, 201 bp, Homo sapiens
gtagtgttgttatgaggactgaataagccaatacacatgaaaggctgaggataacttttcctttgcagtcacaactacgctgtttggtataagaggcctamctttcggcctattttggctttcaatacacttacctcactaagtttaatatttctagcttttgatttagagcaagggatgtgtgacattttcacttaaaca

SEQ ID NO: 67507 - DNA, 201 bp, Homo sapiens
ttgggctgggtgtggtggcgcacacctgtaatcccagcactttgggagactgaaatgggcagatcgcttgaggtcaggagttcgagaccagcctggccaayatggcgaaaccccatctctaataaaaatacaaaaaaaaaaaaaattacctgggcgtggtgccttgcgcctgttgtcccagctacttgggaggcaaagaca

SEQ ID NO: 67508 - DNA, 201 bp, Homo sapiens
aaaaaaaaaattagctgggggtgttggcccatgcctgtagcctcagctactcgggaagctgaggtggtaggatcacttgagcctgggaggtcgaggctgcmgtgagccatgatcacaccactgcactccagcctgggcaacagagcaagaccctgtctcaaaaacaaaacaaaataatatgtggtatatgggaaaagaatg

SEQ ID NO: 67509 - DNA, 201 bp, Homo sapiens
gaaggtgttcttgaattctgaagcagacatctggagcctgcgactgagcagctgccatgataggaaaggggaaagacctctggttaccttccagaaagackagagaaggtgcctgtctcctccacgacctaactgtacacagcaggatgcaattacctctagaaccactgaggaagcagacagtaaactggacatccatct

SEQ ID NO: 67510 - DNA, 201 bp, Homo sapiens
aaatatttgcaggcacctcccctgtccagattcagactaggcccttccaccacagcagtccccacagctgggtggaagcctggaggtcaggaaggaggagygctagttgctttcaacacttcaatggtgaaatcatgcagagaagcacttctcatgttaatccatctcacacacattccaagagcacctactatgtgtaag

SEQ ID NO: 67511 - DNA, 201 bp, Homo sapiens
ggtctgccctccaatccaacttccaatctgaacgacctcatctaagaacagatgtgatcatggttaatcccttttgaaaatctttcaatgggccgggcacrgtgactcatgcctgtaatcccagcacttttggaggatgaggtgggctgatcacctgaggtcaggaattcaagaccagcctggccaacatggtgaaacccc

SEQ ID NO: 67512 - DNA, 201 bp, Homo sapiens
ttggctcactgcaagctccacctcctgggttcaagcaattcccttgcctcagcctcccaagtagctaggactacaggtgtgtgccaccatgcctggctaatttttttttttttgagtagagacggggtttcaccatgttagccaggatggtctcgatctcctgacctcatgatctgccagccctggcctcccaaagtgctg

SEQ ID NO: 67513 - DNA, 201 bp, Homo sapiens
ccaagaggctcaagaaaagccttcagagaggggaaagcagatatagctaacaaaaatggcggtgctttttctccacttgcaaattatggtatggacccaamgacagactagttttgcctttgggatttcaattttctatgtcacaacatgtctatgagctcactcactgggggcctgaaaaaatgattgcccagggaaaac

SEQ ID NO: 67514 - DNA, 201 bp, Homo sapiens
ctttgggatttcaattttctatgtcacaacatgtctatgagctcactcactgggggcctgaaaaaatgattgcccagggaaaacaattattattgggaatyctcacccacaatagcacatagactttatgctaaatgtccaatttgtcctaaacctaatccaggaaagtgtcttcacagatttcaagggcatttccctttg

SEQ ID NO: 67515 - DNA, 201 bp, Homo sapiens
catctccaatcctggccactcactgttctctgagcagaggctcattcccatgcctgagccaagttgttcccacacctgagccacgcttcctacccactttyacctactgattctgctctgcctccaggtcccaccattctccctccaagaagccacccactcctccaaatggatggcttccacctgaactgtcctcaaagt

SEQ ID NO: 67516 - DNA, 201 bp, Homo sapiens
tcacatttcccaaagcctgctcacacccctaagtatcgtacccataatccgtgcttcttatatcctgagtgtttgggcataaccaagaccattttgcaggygggaaatttgatgttctgggatgccctcatgagatgcacctgactggatgggctgttgagctcctctagcttctctgagtggcctctgttaccccaatct

SEQ ID NO: 67517 - DNA, 201 bp, Homo sapiens
gaactgaacactggacagatgacctgcctgcagagaggagctacacactgccagtctctgagctgttgtaacactaaataaaactcttcttcatcttgttygctctttgcttgtctgcatacctcattcttcctggacacaggacaagaacttgggcaaaggtgctgtggccacagatgtttccagccaaaaaattgacac

SEQ ID NO: 67518 - DNA, 201 bp, Homo sapiens
ccccccaggggcaaagaaaactcactggaatgtcttccatctggaaagagttcacatttcccaaagcctgctcacacccctaagtatcgtacccataatcygtgcttcttatatcctgagtgtttgggcataaccaagaccattttgcaggcgggaaatttgatgttctgggatgccctcatgagatgcacctgactggat

SEQ ID NO: 67519 - DNA, 201 bp, Homo sapiens
aactagtgaggggctggaacctgacagtgacctgggagagagggaagaagggaggggctgtgtgcatgagacattctgggggtagaacaggaaggatttcaaaaaaaaaaaaaaagctgttggcacacagttggctttctctaccacctccagtgtgaatgacttggtggcccattgatgagggaggtgatggagaagttc

SEQ ID NO: 67520 - DNA, 201 bp, Homo sapiens
ctccattttaaagtttaacttccccgtagtttcagtaaacaacatttccccccagttttaatcagcagttcacatctgttcccctggttacctgctctgcrtcctgactcatcccagtcacctgctttgacctgaatcacccctggtcacctgctctgacctaactcacctttagttacctgttcctaactgtccttccca

SEQ ID NO: 67521 - DNA, 201 bp, Homo sapiens
caaagtatgtcccatgttcctccctgtgctgcagccagctgcgcctgcctttagctttccacaggcctgaggacaactcaaagactgggtctgtgcctgcytcccctgtccccctagcatcgggcacacatcctggcttggcctgagtgggacaccctaccaacactctctgaaaagacccaggatgcacggtggggtctc

SEQ ID NO: 67522 - DNA, 201 bp, Homo sapiens
cctaagaaaataattctaattgcaatgatcacctcttttctccataacgtgaggagatattggcatgacaggagagcctctcgcattctgaaaggaaatasaggaatttttgcatcctcactgacaaaccaaatgacagaacttcatgtaggagtgaaaaatagaacaagggcacttaaaaattccaatttgattccccta

SEQ ID NO: 67523 - DNA, 201 bp, Homo sapiens
atatgtactgaaacacatgttccaaaccacaaagccacacagactgtggataaccgcaacagagacagagaggcacagtcacacataaggcatgaagccaytggggccaaatgcagaaacaaagagcggaaacataactgattacactggcataagtgtgtgctttcagacagctgcacactcaggccaacgaggcaccta

SEQ ID NO: 67524 - DNA, 201 bp, Homo sapiens
atgtactgaaacacatgttccaaaccacaaagccacacagactgtggataaccgcaacagagacagagaggcacagtcacacataaggcatgaagccactggggccaaatgcagaaacaaagagcggaaacataactgattacactggcataagtgtgtgctttcagacagctgcacactcaggccaacgaggcacctacg

SEQ ID NO: 67525 - DNA, 201 bp, Homo sapiens
aaaaaccactgaattgtatgctttgagaggtcaaattttatggtatatgaatcatatctcaacaaagttgtttaaaaaaacagattgtgtgctcgcttcgrcagcacatacactaaaattggaacgatacagagaagattatcatggcccctgcacagggatgacacgcaaattcgtgaagcgttccatatttttaatgat

SEQ ID NO: 67526 - DNA, 201 bp, Homo sapiens
gttgtttaaaaaaacagattgtgtgctcgcttcggcagcacatacactaaaattggaacgatacagagaagattatcatggcccctgcacagggatgacaygcaaattcgtgaagcgttccatatttttaatgatcaagtgggcttcatccctcggatgcaaggctggttcaacatatgcaaatcaataaaagtaatccag

SEQ ID NO: 67527 - DNA, 201 bp, Homo sapiens
attcttcctggacacaggacaagaacttgggcaaaggtgctgtggccacagatgtttccagccaaaaaattgacaccccaaagatcccataacactagggmgcttggactttatcctgcacatatgggctgccgcaaatgggattacacagtgggcatcaggctcaggagagcacattggaagggactctgtggtggccaa

SEQ ID NO: 67528 - DNA, 201 bp, Homo sapiens
ttctgggacaaggcaagggcatgaataaataaaaagcggggaggagcggcaggatgaatttaaggatgtaaactgacaccagctaggtatgaactgagcargtgtgtgggctgcattatttaacgtaaaagatcaatagcccattttttgtagtcgctctgagaagaagtagcttctaatgcgtccccttcaaccactgct

SEQ ID NO: 67529 - DNA, 201 bp, Homo sapiens
agaaaactcactggaatgtcttccatctggaaagagttcacatttcccaaagcctgctcacacccctaagtatcgtacccataatccgtgcttcttatatyctgagtgtttgggcataaccaagaccattttgcaggcgggaaatttgatgttctgggatgccctcatgagatgcacctgactggatgggctgttgagctc

SEQ ID NO: 67530 - DNA, 201 bp, Homo sapiens
aaaataatgagcaggctaggccattgtgtctcttgtggacattatagagagcaatcccttgcctacagtagaatcagcacagttagctgagttaatagggytcgccagagcttgtcaagtggccaaaaatcaaatggctaatgtttacgttgacagctattctgctttgggtgtagctcatgattttggaatgttgtggaa

SEQ ID NO: 67531 - DNA, 201 bp, Homo sapiens
ttggggaattccttccaaattacatcgcaataggggactcattttactggagagattatccactccatttgtaaaatctggctcattttccaacattttcrttttgcttaccatccacagtcttctgaattggtggaatggagaaatgaaataataataacccagctggaaaaattaatgaaagcttttcctattatgtgg

SEQ ID NO: 67532 - DNA, 201 bp, Homo sapiens
aaaaaaaaaattacctgggcgtggtgccttgcgcctgttgtcccagctacttgggaggcaaagacacgagaatcagttgaacctgggcagaggttggggtragccaagattgcatcaccatactgcagcctgggtaacaaagctagacccgaaagggaaaggaaaggaaaggaaaggaaaggaaaggaaaggaaaggaaag

SEQ ID NO: 67533 - DNA, 201 bp, Homo sapiens
agcaaaagcctctaaaacatggccaaccattttggatacagaagcacaaggtgtgcatttatggaaaaaaatcctcttcttcctggaaaattactaccagkgtgtgtagcctaatttgctgcactctacagctttagcaccggatatggtttggctgtgtcccctcccaaatctcatcctgaattgtaattcccataatcc

SEQ ID NO: 67534 - DNA, 201 bp, Homo sapiens
tggaacaccaaacatatttggtttcacaatctgtacctaaattgcacttctgctataattgttcaatggcaacaacatgtttggtggataaaacagcactrgccaactaaggtaaaaagaaacttaggtgcaacaggggaataacttgtgatattaggacaagataaaaatgtattttatgaaaaaagacattcacaagaa

SEQ ID NO: 67535 - DNA, 201 bp, Homo sapiens
aaggtcagatggacactttgacttcagtgagtcaacaggggaagggagattccctggggccagttcccaccccaagctcaaatgagtgtgaggtttcctgyttcctcttcaaccccaacccctaggcacctgagctgggggcccatggtgtagcagatggtggcaggcaggaagccattgaagctggagctcatggaggac

SEQ ID NO: 67536 - DNA, 201 bp, Homo sapiens
tcccaccccaagctcaaatgagtgtgaggtttcctgcttcctcttcaaccccaacccctaggcacctgagctgggggcccatggtgtagcagatggtggcrggcaggaagccattgaagctggagctcatggaggacatgtaggcacccatggaggggaagaccagccaatcgcctacatccagctcgggcagccgcacat

SEQ ID NO: 67537 - DNA, 201 bp, Homo sapiens
agccaatcgcctacatccagctcgggcagccgcacatcctccaagaagagcctgtcaaaggcatcgcacatgggacatagagggtgcaggggaagaggggyggctctgagcagaactcctgtgtgacataggaaagggggtcagaaaagacagcaggctggcctatcccacccccttatctggaaggcactgaaagacccg

SEQ ID NO: 67538 - DNA, 201 bp, Homo sapiens
tgactgtatccctagtgtaaaaactctacatgagaattgacacagtttcttcaggaagtcaatagcactgagaacaaatataggaagaggaattaatttaygttaaaagagagttagaggctgggcacagtggctcatgcctgtaatcccagcgatttgggaggctaaggcagccagatcacttgaagtcaggagtttgag

SEQ ID NO: 67539 - DNA, 201 bp, Homo sapiens
tgggaagaaacacacttacaagcctctgctggtgaactttgtcccattgagagcaattgtatgggagggttgttccttttttttttgttttttgttttttktttttgagacggagtcttgctctgtcgccaggctggagttcagtggcgcgatctcggctcactgcaacctccgcctcccgggttctagcgattctcctgc

SEQ ID NO: 67540 - DNA, 201 bp, Homo sapiens
actggtcatgcctcacacctagatcctggagggtgatgtataggaatacattcttcctcacagtgagggtgactttctctcctagacttaaaaatcagcarcaacatatcctaattttccactcaggtccaggcaaaagaacgagacagcagagtgagagcaaaacatcttagggaattaagatgaacaaataatggaaaa

SEQ ID NO: 67541 - DNA, 201 bp, Homo sapiens
gtgcctggtagctaccttactgcacaacaatatagatggtttttatcatgccagaaaattctcctggagagcactgatctagaaatacacttttcagccgsgcacagtggctcactcctatactcccagcgctctgggatgctgaagcgggcggatcacctgaggtcagaagttcaacaccagcctggccatggtgaaacc

SEQ ID NO: 67542 - DNA, 201 bp, Homo sapiens
ccaggtagcatgaagacttgcaattggtatctgccatgagagcagccttgcagaactcatgtctgacattcagttcaggtggttggtgtcagaaccgagtygaagtgacaccaagctggtgttagagcactggtgtcaaagcattatgacctcttagccactgttcggatatttagttaatagtggttcaaaactgcgata

SEQ ID NO: 67543 - DNA, 201 bp, Homo sapiens
cacacacacacacacacacacacacacacacccctaaggggtaggcaaattactcacggtcaatcatatgctcagtccaggaaatttgaatcttatgacargagaattaaaccagttggtgcagtctttgagaccatggttacctaaacaaacatctattaggtggtttctggagcttagatcctctcggctcagccttca

SEQ ID NO: 67544 - DNA, 201 bp, Homo sapiens
ccagcccacgcccaccagcctccagaccgctacatgaacagtcaacattcattttgtatgagccgcctgagttttctgttacatgcagctgaaccctgcaygttaaagaaattcatatccctcgcctttattttttaagactctccatcaatcaaatcactgtctcattttgacatttatgttcattaagtatttgaataa

SEQ ID NO: 67545 - DNA, 201 bp, Homo sapiens
aaacagaaagtatacaggacgaacctgaaacatctcatcatatcgtaaagcaaggaagctatgagattactagagacgtgtcagaaggactcaggtgccarcctaaataagcctacactgcccaaagagggagcaatttgagcatcgaaaggacagtaactgcaatggactgaaacacaccacgtatgctaaaataggcgt

SEQ ID NO: 67546 - DNA, 201 bp, Homo sapiens
gactgctcccaattacctaagttatctgcggggaatatcctacagtcttaagctactctaaaacttcagccctagagcgtgatggctgaaaggaaaaagtrtacttgtagcgcttatgcttcttaacccactgaccatgtcctcaaatcaaactgcactgtacaaaatggtagtcactagccacatatggttaaattaagt

SEQ ID NO: 67547 - DNA, 201 bp, Homo sapiens
attacctaagttatctgcggggaatatcctacagtcttaagctactctaaaacttcagccctagagcgtgatggctgaaaggaaaaagtgtacttgtagcscttatgcttcttaacccactgaccatgtcctcaaatcaaactgcactgtacaaaatggtagtcactagccacatatggttaaattaagtacaattaaaca

SEQ ID NO: 67548 - DNA, 201 bp, Homo sapiens
cctcccagctaattgccccaagcgggtcaaacttcggaatcggcgtcctgctctgcgttgtggagcgcatggcaaagaggaagggttggtgctcggaacaraatctccgtgatttgccagaggaaacagcacagactccagacagcagaagcgccgggatttccatgcagctgccacgacaggtgacccggcccgctctgc

SEQ ID NO: 67549 - DNA, 201 bp, Homo sapiens
tcccatgtcaagctaccctgcttggttaaactttggccacaatttctctaagctcaaataatgctgacgtgaaaataagctataatttattttactaaaamagaaatttgattttacaaaaagcagcttccgaatttgttcagcaggttcaaattttcaatcttgaaggattttttgttagcactggtgatggcggcattt

SEQ ID NO: 67550 - DNA, 201 bp, Homo sapiens
tgtcaagctaccctgcttggttaaactttggccacaatttctctaagctcaaataatgctgacgtgaaaataagctataatttattttactaaaaaagaamtttgattttacaaaaagcagcttccgaatttgttcagcaggttcaaattttcaatcttgaaggattttttgttagcactggtgatggcggcattttgttt

SEQ ID NO: 67551 - DNA, 201 bp, Homo sapiens
ccttactgcacaacaatatagatggtttttatcatgccagaaaattctcctggagagcactgatctagaaatacacttttcagccgcgcacagtggctcaytcctatactcccagcgctctgggatgctgaagcgggcggatcacctgaggtcagaagttcaacaccagcctggccatggtgaaaccccatctctactaaa

SEQ ID NO: 67552 - DNA, 201 bp, Homo sapiens
ataactcagagtccaaagtttctgctgtctcaagcccttcagccaccaagacactcagcacagggatagggaaactggatcctggacataaggagatggcrgaggagtcagagcttttgaagaataagatgcaagcccctcccctttcgaggtgtcctgagagccaaaaatgccagcaccagctgaggcttcatcactgga

SEQ ID NO: 67553 - DNA, 201 bp, Homo sapiens
tccttatgcagaaggcttaaacactaatgaacattttttttttttttttgagacagagtctcgctctgttgcccgggttggagtgcagtggcgtgatctcygctcactgcaagctccgccccccgggttcatgccactctcctgcctcagcctcccgagtagctgggactacaggcgcccaccacctcgcccagctaattt

SEQ ID NO: 67554 - DNA, 201 bp, Homo sapiens
accataagaggaagagctatttttcataacctcaaaagtcagtggagtatgtgatctaacaatgaatcagtgaccctgatgagatacaatgacagcaaggraggacagatccactggcacacactaatttaagtgaaaattcaaattataatatgaaattagtagattttagaaaagggccttctaacagcaagctctggc

SEQ ID NO: 67555 - DNA, 201 bp, Homo sapiens
aagtgatttaaaacttttaaaactcatttataataatctattacatctgttatgaatttttttttgagacaggatcttgctctgttgctcaggctggagtrtagtggtacaatcttggctcactgcagcctcaacctcccaggctcaagtgaccctcccagctcagcctcccgagtagctaggaccacaagtgcacaccac

SEQ ID NO: 67556 - DNA, 201 bp, Homo sapiens
gcaagcccctcccctttcgaggtgtcctgagagccaaaaatgccagcaccagctgaggcttcatcactggaaacccagcgtccggcaccaggtgaaacgcygtagccccgctgtgctccgctcagccatgccacctgcagactgtcctgcagttctggaggccaccacagccacacgtgaagaaacagtgatgagttgcag

SEQ ID NO: 67557 - DNA, 201 bp, Homo sapiens
caggagaattgcttgaacctggggggcagagtttgcagtgagccaggattgtgccactgcactccaccctgggcgacagagtgagtctccatctcaaaaawaataataataatacctaaggaccagacacggtggtggcacgcacctgtagtcccctgctactcggtggctgaggtgggaggatcacttaagcccaggagt

SEQ ID NO: 67558 - DNA, 201 bp, Homo sapiens
agaagaaaataagaatgtttaacctgggaagaaacacacttacaagcctctgctggtgaactttgtcccattgagagcaattgtatgggagggttgttccttttttttttgttttttgttttttgtttttgagacggagtcttgctctgtcgccaggctggagttcagtggcgcgatctcggctcactgcaacctccgcct

SEQ ID NO: 67559 - DNA, 201 bp, Homo sapiens
accaatgcctaagattattttccatctaaattaccatatgtgtgtgaaaggactgaactgtaaagctgtaaagttctacacaaacgcggatagaaaaaccyaccccatctaaatccaatgtggtaacctggaaaaagtacattagtgaaaaaaccgggctgctctgcctacggagtggccattctgataaggggaaaaaaa

SEQ ID NO: 67560 - DNA, 201 bp, Homo sapiens
atgttaatttcttagttttgacaaatgctctagttatgtaagatgctggctgggcgcggtggctcacacctgtaatcccagcactttgggaggccgaggcrggcagatcatgaggtcaagagatcgagaccatcctggccaacgtggtgaaacctcgtctctaccgaaaatacaaaaagtagctgggcatggtggtgcgca

SEQ ID NO: 67561 - DNA, 201 bp, Homo sapiens
tttaagactctccatcaatcaaatcactgtctcattttgacatttatgttcattaagtatttgaataattggatcttacccttgaagcccaagacatttascaggtcccaagaggttccgagactgctcccaattacctaagttatctgcggggaatatcctacagtcttaagctactctaaaacttcagccctagagcgt

SEQ ID NO: 67562 - DNA, 201 bp, Homo sapiens
aggtcaggagttcgagaccagcctggccaatacggtaaaaccccgtctctactaaaaatacaaaaattagctgggcgtgatggtgcgtgcctgtagtcccrgctactcgggaggctgaggcagaagaatcgcttgaaccagagacgcagaggttgcggtgagccaaggtcacgccactgcactccagcctgggtgacagag

SEQ ID NO: 67563 - DNA, 201 bp, Homo sapiens
atccgccagccttggcctcccgaggtgccgggattgcagacggagtctcgttcactcagtgctcaatggtgcccaggctggagtgcagtggcgtgatctcrgctcactacaacctacacctcccagccgcctgccttggcctcccaaagtgccgagattgcagcctctgcccggccgccaccccgtctgggaagtgaggag

SEQ ID NO: 67564 - DNA, 201 bp, Homo sapiens
tgctcatttgtccttgataaaagaagctgcaaacttcaagctcaaatatgggcgggaggaggcaattagtgacctagaacagctatggaaacaaaatccaraagatattcataccctggcacagtttatttctgcttactcacttgcagatccagagaaaggcacagctcttagtaaacatttgccatcatcagatagtat

SEQ ID NO: 67565 - DNA, 201 bp, Homo sapiens
tcaaaaaacaatatctccctcacagtgctgttgaaataatcaaataaaatatgtaaattatatgcctggcacacaagaggtgctcagtcaaaaaataatayttgggccgagcacagtggctcatgcctgtattcccagtactttgggaggccaaggcaggtggatcacctgtgatcatgagttcaagaccagcctgaccaa

SEQ ID NO: 67566 - DNA, 201 bp, Homo sapiens
gtcatcccagctacttgtgaggctgaggcaggagaatcacttgaacccaggaggcagaggttgcagtgagccgagatcatgccactgcactccaccctggragacacagcgagactctctctcaaataataatagtaataagccgggtgcggtggctcacgcctgtaatctcagcactttgggaggccaaggtgggcggat

SEQ ID NO: 67567 - DNA, 201 bp, Homo sapiens
ctcaaatagtgatccccttaaatgctttggtcttatctgtcgtgtagaatctgttctatctggttttgtgtttgtgttcaccaccacttggaagaactaaytgagacttctgaagaatagacggtcacatggcctgggttctcatctgtgccgccacctgggcacaccactacatctctccagcctccatttcagagtcta

SEQ ID NO: 67568 - DNA, 201 bp, Homo sapiens
gggactacaggtgcataccaccatgcccagccaatatttgtatttttagtagagacggggtttcaccatgttggccagatggtctggatctcttgacctcrtgatccacccgcctcggacccccaaaatgctgggattacaggtgtgagccatcacgcccggcccggttgttcccttttgattatttattgagcttctact

SEQ ID NO: 67569 - DNA, 201 bp, Homo sapiens
tgcttttgttttgttttgtttttgagacagagtctcactctgtcacccaggctggagtgcagtggcgcaatctcagctcactgcaacctccacctcctggrttcaagtgattctcctgactcagcctcctgagtagctgggactacaggcacctgacaccatgcccagttaatttttgtacttttagtagagacagggttt

SEQ ID NO: 67570 - DNA, 201 bp, Homo sapiens
ctcagccttccgagtagctctgattacaggtgcctgccaccaagcccagctaataatttttctatttttagtagagacggagtttcgccatgttggccagkctggtctcgaactcctgatctcaggtgatccgcccaccttggcctcccaaagtgctgggattaaaggcatgagccaccatgctcggcacattctgtcttc

SEQ ID NO: 67571 - DNA, 201 bp, Homo sapiens
tttcttagttttgacaaatgctctagttatgtaagatgctggctgggcgcggtggctcacacctgtaatcccagcactttgggaggccgaggcgggcagawcatgaggtcaagagatcgagaccatcctggccaacgtggtgaaacctcgtctctaccgaaaatacaaaaagtagctgggcatggtggtgcgcacgtttag

SEQ ID NO: 67572 - DNA, 201 bp, Homo sapiens
attttttttttttttttgagatggagtctcactttgtcgcccaggctggagtgcagtggtgcgatctcagctcactgcaagctccgcctcctgggttcackccattctcctgcctcagcctcctgagtagctgggactacaggcgcctgccaccacgcccggctaatccttttttgtatttttagtagagactgggtttca

SEQ ID NO: 67573 - DNA, 201 bp, Homo sapiens
tggctcatgcctgtaatcccagcactttgggaggcggaggcaggcagatcacaaggtcaggagttcgagaccagcctggccaatacggtaaaaccccgtcwctactaaaaatacaaaaattagctgggcgtgatggtgcgtgcctgtagtcccggctactcgggaggctgaggcagaagaatcgcttgaaccagagacgca

SEQ ID NO: 67574 - DNA, 201 bp, Homo sapiens
tctgagatgtggggagcgcctctgccccgccgccccctctgggacgtgaggagcgcctctgcccggccgagaccccgtctgggaggtgaggagcgtctctrcccggccgccccatctgagaagtgaggagaccctctgcctggcaaccaccccgtctgagaagtgaggagcccctccgcccggcagctgccctgactgaga

SEQ ID NO: 67575 - DNA, 201 bp, Homo sapiens
ggggcgcctctgcccggccgcccctactgggaagtgaggagcccctctgcccggccagccgcccggtccgggagggaggtgggggagtcagccccccgccyggccagccgccccgtccgggaggtgaggggcgcctctgcccggccacccctactgggaagtgaggagcccctctgcccggccagccgccccgtccgggag

SEQ ID NO: 67576 - DNA, 201 bp, Homo sapiens
aaccatgaaaaatacttatacacctaagaggtaacacagtaaactccataaacttaaaaaaatgaaatgctacaggcctagatgctctatctgctacaacygcttcacacatttcaaaaccgtccaaactcacattcagaatctccttcaactacatgttttgtcccaaccatccaaaccctctgggttctctgcagcctg

SEQ ID NO: 67577 - DNA, 201 bp, Homo sapiens
atattcataccctggcacagtttatttctgcttactcacttgcagatccagagaaaggcacagctcttagtaaacatttgccatcatcagatagtatgtcwctaaaagtagatgttgaggctcttgaaaattctcctggtgctacatacatttggaagggtggaaaagttactagagatagtcaaccaaaggaacaaggaa

SEQ ID NO: 67578 - DNA, 201 bp, Homo sapiens
agagaaagtggagcttcaatgcagctaacctctgtttaatctgactattcctaaccaaaatcttctagaatctaaaacctttcctctttgagctcagtatrtcaagcttagctacttggtgcctacaatagtgatctggtcaaaccagaagtgggggtcctgagaaaagactaaggagtacaaagactctgcactgtcaaa

SEQ ID NO: 67579 - DNA, 201 bp, Homo sapiens
tacacacacatacatacacacaaatatatactgcagtcaaggagtattgattggatatctgatgatactaagaaaaaatttttaaggtaagataatagtaytgtaattattttaaggggtctttttcttttggagacatgtactaaaatatttacagacaaaattatatgacagcttgatttgctttaaaataatccaagt

SEQ ID NO: 67580 - DNA, 201 bp, Homo sapiens
gagtacaggctcaacagaattgagaatgtcttgaagacagtagaaagtaccaaccggcagacagacaaactgaaggagctttatggataagtgttacaccrtttggaacactatgatgaatgcttagtggcataaagagatctcgtccgaaactcccacgatgcttatgatgaggagaggaaaacaaacccttcagcagtt

SEQ ID NO: 67581 - DNA, 201 bp, Homo sapiens
agacccacaggcaggactggccatcacttatggtcagatggcctatattctgcagcttcagggtcaaacagaggaggctctgcaactttacaatcaaatamtactactaaaaccaacggatgtagggttactagatgtaattgcaaataacatcattaccattaacaaggaccaaaatgtctttgactccaagaagaaagt

SEQ ID NO: 67582 - DNA, 201 bp, Homo sapiens
atccagagaaaggcacagctcttagtaaacatttgccatcatcagatagtatgtctctaaaagtagatgttgaggctcttgaaaattctcctggtgctacrtacatttggaagggtggaaaagttactagagatagtcaaccaaaggaacaaggaaagggagatttgaaaaagaaaaagaagggaaaattgcctaagaatt

SEQ ID NO: 67583 - DNA, 201 bp, Homo sapiens
tcaggaagatgtgctggaatgtcatcatccatatagaagggaagtgataggacccagcaaggatttaacacacgtactggttttatcccccatgggtcctyattttaaagagtttctatgcattaaacaataacgaatttgttttaactaatttaattaatttaatttgttttaataaaataagtgttctataacttctaa

SEQ ID NO: 67584 - DNA, 201 bp, Homo sapiens
aactctgaggctaaagatggtgaaagagaaaggcggaggaatcctggaaccctgatcagcaggagccatgcaaccagcccacgcccaccagcctccagacygctacatgaacagtcaacattcattttgtatgagccgcctgagttttctgttacatgcagctgaaccctgcacgttaaagaaattcatatccctcgcctt

SEQ ID NO: 67585 - DNA, 201 bp, Homo sapiens
cacacctgtaatcccagcactttgggaggccgaggcgggcagatcatgaggtcaagagatcgagaccatcctggccaacgtggtgaaacctcgtctctacygaaaatacaaaaagtagctgggcatggtggtgcgcacgtttagtcccagccacttgggaggctgagacaggagaatcgcttgaacccaggaggcgaaggc

SEQ ID NO: 67586 - DNA, 201 bp, Homo sapiens
tctgtgagaaacacccaagaattatcaataaaaaaataaatttaaaaaaaaaaaaaaaacaatttaacaaggcattacttgctatgtacacaaaccaggcsgaacaatgcctcaaaatatctgccagtttacattcccaaagtcccgagcatctctcacctatgttaacccaaggtgcccagctctgcgtgaaaagcagca

SEQ ID NO: 67587 - DNA, 201 bp, Homo sapiens
ttacttgctatgtacacaaaccaggccgaacaatgcctcaaaatatctgccagtttacattcccaaagtcccgagcatctctcacctatgttaacccaagstgcccagctctgcgtgaaaagcagcacacaaaagcaatagagctgcttcaggaattttcagatcagcatcaagaaaatgcaattgaaattaagctgacca

SEQ ID NO: 67588 - DNA, 201 bp, Homo sapiens
tgacctccctgggctcaagtgatcctcccacctcagcctcccacctagctgggaccacaggcacttgccaccacaccgggctaattttttacattagttgyagtgatgaagtaggtctagctatgttgcccaggctggtctccaactcttgggctcaagcaatccttccacctaaacctgtcaacgtgctgggattacatg

SEQ ID NO: 67589 - DNA, 201 bp, Homo sapiens
attcagtttttagaaggacaggaattcggctgggcgtggtggctcatgcctgtaaaccaagcacttcgggaggcctagctgggaggactgcttgagcccargagttcaagaccagcctgggcaacatagtgagaccttgtctctagaaacaacagcaagaacaaaaggatgcaaatgctgacacatgctataacatggatg

SEQ ID NO: 67590 - DNA, 201 bp, Homo sapiens
ccaggtagcatgaagacttgcaattggtatctgccatgagagcagccttgcagaactcatgtctgacattcagttcaggtggttggtgtcagaaccgagtwgaagtgacaccaagctggtgttagagcactggtgtcaaagcattatgacctcttagccactgttcggatatttagttaatagtggttcaaaactgcgata

SEQ ID NO: 67591 - DNA, 201 bp, Homo sapiens
cattcagttcaggtggttggtgtcagaaccgagttgaagtgacaccaagctggtgttagagcactggtgtcaaagcattatgacctcttagccactgttckgatatttagttaatagtggttcaaaactgcgataaataaatgatgctttcaattcaccttggattactgcatacaggttcacaattcacacagaatattc

SEQ ID NO: 67592 - DNA, 201 bp, Homo sapiens
ttttgttttttgtttttgagacggagtcttgctctgtcgccaggctggagttcagtggcgcgatctcggctcactgcaacctccgcctcccgggttctagygattctcctgcctcagcttcccaagtagctgggactacaggtgcataccaccatgcccagccaatatttgtatttttagtagagacggggtttcaccatg

SEQ ID NO: 67593 - DNA, 201 bp, Homo sapiens
gcgcggcttgcgcgccgtctgaacttcgtttgagccggaagtggacgtcccagtcccattatgtcttacagggaaagccgccgggagcacagaagcgctgkcaccaccgacccgcgcagctccccgggaaaacggtcacccgagtggccgcgatggtaacatcccagaggatctcttcttcagttgtccatggagaaagga

SEQ ID NO: 67594 - DNA, 201 bp, Homo sapiens
cggctcactgcaacctccgcctcccgggttctagcgattctcctgcctcagcttcccaagtagctgggactacaggtgcataccaccatgcccagccaatwtttgtatttttagtagagacggggtttcaccatgttggccagatggtctggatctcttgacctcatgatccacccgcctcggacccccaaaatgctggga

SEQ ID NO: 67595 - DNA, 201 bp, Homo sapiens
cggggtttcaccatgttggccagatggtctggatctcttgacctcatgatccacccgcctcggacccccaaaatgctgggattacaggtgtgagccatcaygcccggcccggttgttcccttttgattatttattgagcttctactttaaaccaggcagtgtccaaatgagaacaagtgtgtgggaacctatgaaggggct

SEQ ID NO: 67596 - DNA, 201 bp, Homo sapiens
aaagcttccccacctcttgtgtagaagtgttccctggggccggacacggtggctcatgcctgtaatcccaacactttgggaggctgaggtgggtggattayctgaggtcaggagttcgagaccagcctggccaacatggtgaaacccccatctctactaaaaatacaaaaaaaattagctgggtgtggtggcacgcacctg

SEQ ID NO: 67597 - DNA, 201 bp, Homo sapiens
acactgtgaggaactctgaggctaaagatggtgaaagagaaaggcggaggaatcctggaaccctgatcagcaggagccatgcaaccagcccacgcccaccwgcctccagaccgctacatgaacagtcaacattcattttgtatgagccgcctgagttttctgttacatgcagctgaaccctgcacgttaaagaaattcata

SEQ ID NO: 67598 - DNA, 201 bp, Homo sapiens
tcaagagatcgagaccatcctggccaacgtggtgaaacctcgtctctaccgaaaatacaaaaagtagctgggcatggtggtgcgcacgtttagtcccagcyacttgggaggctgagacaggagaatcgcttgaacccaggaggcgaaggctgcagtgagctgagatcataccactgcactccagcctgggtgacagagcga

SEQ ID NO: 67599 - DNA, 201 bp, Homo sapiens
ccactgcactccagcctgggtgacagagcgagactccacctaaaaaagtaaataaacaaaagcttataaaaaaattaaaaatacccaacatctgctcaagaaaaaaaaaaaaagaaaaaacattctatgggaaaaagactttctaaaaaatcaaggtagaaacaatggaaaaaagatcgataggtttgactacacagaata

SEQ ID NO: 67600 - DNA, 201 bp, Homo sapiens
cactgcactccagcctgggtgacagagcgagactccacctaaaaaagtaaataaacaaaagcttataaaaaaattaaaaatacccaacatctgctcaagaaaaaaaaaaaaagaaaaaacattctatgggaaaaagactttctaaaaaatcaaggtagaaacaatggaaaaaagatcgataggtttgactacacagaataa

SEQ ID NO: 67601 - DNA, 201 bp, Homo sapiens
agacttctctattttacaataaatttatagaaagctgattccaaagcacctcataaacattattgcttctatatctctctctaaagaaaagcattttggcrccaggtatagtggctcatgcctgtaatcccagcactttgggaggccaaggcaggcagatcacgaggtcaagagatcgagatcatcctggccaacatggtg

SEQ ID NO: 67602 - DNA, 201 bp, Homo sapiens
atggtaaaggctcaaatcacttgtaaggcctggaaaaggtgacctcagtgtcaaccgcattcatcttatgggcttctcctatgacccaacctcttttttcttttttttttttttttgagacagggtctcactctgtcacccagccttgacctccctgggctcaagtgatcctcccacctcagcctcccacctagctgggac

SEQ ID NO: 67603 - DNA, 201 bp, Homo sapiens
ggggtctagctcatctggaagatgagtcctttgcccttcccaccctctcttttcctcctgcctggtcatggtgtgattattgagctccagcagccatcatrcactgtgaggaactctgaggctaaagatggtgaaagagaaaggcggaggaatcctggaaccctgatcagcaggagccatgcaaccagcccacgcccacca

SEQ ID NO: 67604 - DNA, 201 bp, Homo sapiens
taaagagatggttaaaaggaaaagaaagcatttatttatcagagtttgcagtcattttatagagatgtgattaatgtttctgagcaaataatgtatttaattttttttttttttttgagatggagtctcactttgtcgcccaggctggagtgcagtggtgcgatctcagctcactgcaagctccgcctcctgggttcacgc

SEQ ID NO: 67605 - DNA, 201 bp, Homo sapiens
gcacacatgagctgtgctaaacactgcatgtgcactgatagaccacggccagctgaaccaggccatgaacatcctacaaaaagctgaaggtctttgccacmattcattatcagaagacactgatgagactgaggaagacccacaggcaggactggccatcacttatggtcagatggcctatattctgcagcttcagggtca

SEQ ID NO: 67606 - DNA, 201 bp, Homo sapiens
acacatgagctgtgctaaacactgcatgtgcactgatagaccacggccagctgaaccaggccatgaacatcctacaaaaagctgaaggtctttgccaccattcattatcagaagacactgatgagactgaggaagacccacaggcaggactggccatcacttatggtcagatggcctatattctgcagcttcagggtcaaa

SEQ ID NO: 67607 - DNA, 201 bp, Homo sapiens
gtctcaagacttctgcttaacatctcatgactacaggcaaatctcagccttagttttctcataaaatacaaaaatatgtgcttgacatattgtgcaaggtkgctgtgaagaccaaatgaaatggcatatgtggaaaaatactttgtaaactaggggttaaacataagtaagcaatgattatcacttacagtggaaaaagtc

SEQ ID NO: 67608 - DNA, 201 bp, Homo sapiens
tttctcataaaatacaaaaatatgtgcttgacatattgtgcaaggtggctgtgaagaccaaatgaaatggcatatgtggaaaaatactttgtaaactaggkgttaaacataagtaagcaatgattatcacttacagtggaaaaagtcacaaaccattcaaaaaaactccttggagaaaaggccaacactcttatctggcca

SEQ ID NO: 67609 - DNA, 201 bp, Homo sapiens
agttgaagtgacaccaagctggtgttagagcactggtgtcaaagcattatgacctcttagccactgttcggatatttagttaatagtggttcaaaactgcrataaataaatgatgctttcaattcaccttggattactgcatacaggttcacaattcacacagaatattcaatcccaactgaattccatagagttctcaaa

SEQ ID NO: 67610 - DNA, 201 bp, Homo sapiens
tcaggaattttttgattgttgtttctgtgtgtttttaaatgtacaaagagaccagagaattagaagagacagtgtacttctttcaaatgtccctatatataaaaaatagtttatattaagtctaagttagaatcatattaaaaatattagttatattaagaattaagaggcagaagcttgtaaatctcacatgacaatgaa

SEQ ID NO: 67611 - DNA, 201 bp, Homo sapiens
atccatatgtataagagtgagagcagatcttatatcaaatctaaaggaaaacttttggaaatgctaaaaagttcaatttcagacatattaatacatcctcmacattttatttacaataagaccaccaatcttgtttttataaccgccaacaggtttcttggtttctcggctgcaacttttttattgaagtgatcaaagact

SEQ ID NO: 67612 - DNA, 201 bp, Homo sapiens
gttgaagtgacaccaagctggtgttagagcactggtgtcaaagcattatgacctcttagccactgttcggatatttagttaatagtggttcaaaactgcgrtaaataaatgatgctttcaattcaccttggattactgcatacaggttcacaattcacacagaatattcaatcccaactgaattccatagagttctcaaaa

SEQ ID NO: 67613 - DNA, 201 bp, Homo sapiens
gccaagagaaagccccctccagcaacacctgcagggggattcataaacatgacaggatccatgcagagggaggccacagggtgggggtgagggagtaagasaagggacacagagtttttctgttgcttttgttttgttttgtttttgagacagagtctcactctgtcacccaggctggagtgcagtggcgcaatctcagct

SEQ ID NO: 67614 - DNA, 201 bp, Homo sapiens
atcccaactgaattccatagagttctcaaaatcacagaagatatctatgtgcataaccaaacaaccataagaggaagagctatttttcataacctcaaaastcagtggagtatgtgatctaacaatgaatcagtgaccctgatgagatacaatgacagcaagggaggacagatccactggcacacactaatttaagtgaaa

SEQ ID NO: 67615 - DNA, 201 bp, Homo sapiens
ctactctaaaacttcagccctagagcgtgatggctgaaaggaaaaagtgtacttgtagcgcttatgcttcttaacccactgaccatgtcctcaaatcaaaytgcactgtacaaaatggtagtcactagccacatatggttaaattaagtacaattaaacaaaaatataaattatgtttctcagttgccttagctgcatttc

SEQ ID NO: 67616 - DNA, 201 bp, Homo sapiens
gccttctaacagcaagctctggctgaagtgcaatggcgcaacctcggctcactgcaacctctacctcccgggttcaagcgattatcctgtctcagcctctsgagtagctgggattacaggcacgcaccaccacccttggctaatttttgtattttcagtagaggtggggtttcaccatattggccaggctgttctcgaact

SEQ ID NO: 67617 - DNA, 201 bp, Homo sapiens
tgataaattttatggtatgtacattttaccacaaaaaattagtatgtttagtatgttacaatttagtaactaaattaacattatctcagccaaattaaaasacatttgacattttaattacatattccatgaagtctcactaaagacaaatgtacaatttctgtaaggcttttggtaatactgaaatgctgcacagaatgc

SEQ ID NO: 67618 - DNA, 201 bp, Homo sapiens
aagtgcaatggcgcaacctcggctcactgcaacctctacctcccgggttcaagcgattatcctgtctcagcctctcgagtagctgggattacaggcacgcrccaccacccttggctaatttttgtattttcagtagaggtggggtttcaccatattggccaggctgttctcgaactcctgacctcaggtgatccacccgcc

SEQ ID NO: 67619 - DNA, 201 bp, Homo sapiens
ttgttttgaaagaggcaagatagaaacctacaggtggttgactgaacccagcagagtcctagagccaaaaagagatcagccaccccttggaacctgctccygtggcagggcttagaccacagaaccctaacttgcagctccacaccaggccactgcagcgctccacagcaactttctggtaggcccttgggccacagactt

SEQ ID NO: 67620 - DNA, 201 bp, Homo sapiens
gtcactagccacatatggttaaattaagtacaattaaacaaaaatataaattatgtttctcagttgccttagctgcatttcaactgctcaacagcctccaygtgcctggtagctaccttactgcacaacaatatagatggtttttatcatgccagaaaattctcctggagagcactgatctagaaatacacttttcagccg

SEQ ID NO: 67621 - DNA, 201 bp, Homo sapiens
cagctccacaccaggccactgcagcgctccacagcaactttctggtaggcccttgggccacagacttaactcctccagccaacctaccaactaatgctagrttaaaggggaaatgagttgttctctatttcgtaccgctgctttgagagtataatatgggggagacaaagtaaagttttcaggataccatcagagacaaca

SEQ ID NO: 67622 - DNA, 201 bp, Homo sapiens
aaatcaaacccagaagaaatgtgggcacagcacctccattcacctaatcaactcctacaggaaagaagtaaatgcaagctgcaaaaccaaagggacatcayattagagaaaacatgctgatgattcatcatacagaagaagcaaccgttatttttaaagtccatgaaagcacctggttgaaacatgacacaccatggcggc

SEQ ID NO: 67623 - DNA, 201 bp, Homo sapiens
actgcactccagcctggtgacagagcgacactccgtctcaaaacaaaaaaaaaaaaaagaaaagaaaagaaatgcattttaactaggaatggtggctcatktctctaatcccagcactttgggaggccaaggtggaaggatcacttgagtcagggaaatcaaggtgcagcgagctatgattgtgccactgtactccagcct

SEQ ID NO: 67624 - DNA, 201 bp, Homo sapiens
gaagtaaatgcaagctgcaaaaccaaagggacatcatattagagaaaacatgctgatgattcatcatacagaagaagcaaccgttatttttaaagtccatsaaagcacctggttgaaacatgacacaccatggcggctgcacaacaatataaatgttgtttaatggccctgaactgtacattgaaaaatgattacaataat

SEQ ID NO: 67625 - DNA, 201 bp, Homo sapiens
tcatacagaagaagcaaccgttatttttaaagtccatgaaagcacctggttgaaacatgacacaccatggcggctgcacaacaatataaatgttgtttaayggccctgaactgtacattgaaaaatgattacaataatatattttgttatgtatattttaccacacttttttaaaaagacacatcataagagtttgagaca

SEQ ID NO: 67626 - DNA, 201 bp, Homo sapiens
atcattaccattaacaaggaccaaaatgtctttgactccaagaagaaagtgaaattaaccaatgcggaaagagtagagtttaagctttccaagaaacaackacaagctatagaatttaacaaagctggcctggcgcggtggctcatgcctgtaatcccagcactttgggaggcggaggcaggcagatcacaaggtcaggag

SEQ ID NO: 67627 - DNA, 201 bp, Homo sapiens
caactttacaatcaaatactactactaaaaccaacggatgtagggttactagatgtaattgcaaataacatcattaccattaacaaggaccaaaatgtctytgactccaagaagaaagtgaaattaaccaatgcggaaagagtagagtttaagctttccaagaaacaactacaagctatagaatttaacaaagctggcctg

SEQ ID NO: 67628 - DNA, 201 bp, Homo sapiens
gcggaggaatcctggaaccctgatcagcaggagccatgcaaccagcccacgcccaccagcctccagaccgctacatgaacagtcaacattcattttgtatsagccgcctgagttttctgttacatgcagctgaaccctgcacgttaaagaaattcatatccctcgcctttattttttaagactctccatcaatcaaatcac

SEQ ID NO: 67629 - DNA, 201 bp, Homo sapiens
attcttctgccttgggatcctgttgatctgtgaccttacccccaaccctgtgctctctgaaacatgtgctgtgtccactcagggttaaatggattaagggyggtgcaagatgtgctttgttaaacagatgcttgaaggcagcatgctccttaagagtcatcaccaatccctaatctcaagtaatcagggacacaaacactg

SEQ ID NO: 67630 - DNA, 201 bp, Homo sapiens
agaccgctacatgaacagtcaacattcattttgtatgagccgcctgagttttctgttacatgcagctgaaccctgcacgttaaagaaattcatatccctcscctttattttttaagactctccatcaatcaaatcactgtctcattttgacatttatgttcattaagtatttgaataattggatcttacccttgaagccca

SEQ ID NO: 67631 - DNA, 201 bp, Homo sapiens
tgtgctctctgaaacatgtgctgtgtccactcagggttaaatggattaagggcggtgcaagatgtgctttgttaaacagatgcttgaaggcagcatgctcsttaagagtcatcaccaatccctaatctcaagtaatcagggacacaaacactgcggaaggccgcagggtcctctgcctaggaaaaccagagacctttgttc

SEQ ID NO: 67632 - DNA, 201 bp, Homo sapiens
gagggggcaggggttgtcaaacaaagtaggcatcttctgaaatgagtaacaacaaaaactcactccacagtccattttctccaacctactaacctggttgsagatcaggctactaagcctgatcagcacggtcttaacattactaatttctaaatatttcaacataaatggaacagttcctcactcctcagaaatcactgc

SEQ ID NO: 67633 - DNA, 201 bp, Homo sapiens
cttgtttatctgctgaccttccctccactattgtcccatgaccctgccaaatccccctctgtgagaaacacccaagaattatcaataaaaaaataaatttaaaaaaaaaaaaaaaacaatttaacaaggcattacttgctatgtacacaaaccaggccgaacaatgcctcaaaatatctgccagtttacattcccaaagtc

SEQ ID NO: 67634 - DNA, 201 bp, Homo sapiens
ttgtcaaacaaagtaggcatcttctgaaatgagtaacaacaaaaactcactccacagtccattttctccaacctactaacctggttggagatcaggctackaagcctgatcagcacggtcttaacattactaatttctaaatatttcaacataaatggaacagttcctcactcctcagaaatcactgctggtttcctatca

SEQ ID NO: 67635 - DNA, 201 bp, Homo sapiens
gggtgtggtggcacgcacctgtagtcccagctactcgggtggctgaggcagaatcgcttgaaactgggaggcggaggttgcagtgagccgagatggggccmctgcactccagcctgggtgacagagcaagaccctatctcaaaaaaaaaaaaaaaaaaaaaaaaaaaaaaaaaaaagaaaagaattgggcatttacccatc

SEQ ID NO: 67636 - DNA, 201 bp, Homo sapiens
atgttggccagtctggtctcgaactcctgatctcaggtgatccgcccaccttggcctcccaaagtgctgggattaaaggcatgagccaccatgctcggcasattctgtcttctatatggaaaggtagggcagtggcgttctgtaggtcagaaaatgttaagaaaatcaaaaaaagtgttttagttagaaagaggggagatt

SEQ ID NO: 67637 - DNA, 201 bp, Homo sapiens
ttgtaaatggaattttcttaaagaggcagtggcatgattagacttttatttcaggaatatactctgacatttttgtggaggatggtttggaggaaagtctrgtaaaacatacactaagattaattattctgtcaatgatgataaaaggccagaactagggttgtaaaatgaaaggtaatgaataaatttgggtaatatcta

SEQ ID NO: 67638 - DNA, 201 bp, Homo sapiens
tcagagtataagttttgcatttcttttgttaaatttattcctaagtattttaccttttttgatacttttgtaaatggaattttcttaaagaggcagtggcrtgattagacttttatttcaggaatatactctgacatttttgtggaggatggtttggaggaaagtctagtaaaacatacactaagattaattattctgtca

SEQ ID NO: 67639 - DNA, 201 bp, Homo sapiens
tagaaagaatgcaaaatcagtaggagccactggtatgcactggatgtcaagaaacccatcactgcaaagccgagatcacgccactgcactccaacctgggsgacagagcgactctttctcataaaaaaaaaaaaaaaaaaaaaaaaaaggactcatcactgcaattgtagctgctgtactgtccacagagggcccagaatg

SEQ ID NO: 67640 - DNA, 201 bp, Homo sapiens
gaaaattacataatttttatgtgacgggaatttagaggatatatttgtaactaaggcataagtccatttgtgcacattttggagtttgagtttgtggttaygatactttctattagaagtcaggatacaaaactgcaaggagaaatccctgtttcattctcactaaagacccagtctgttaggactggcttcttctcttgt

SEQ ID NO: 67641 - DNA, 201 bp, Homo sapiens
ccttgatgactgaacggcaaaccccagtgaaacccaaaactaatctcttacacggaggcagcaccttcccctttgtcatgagctttcaccagcgctatagyacttgattctcacagacctgagccaggcggggaaagtgtgatgattgcttagaaagggcagggaactgaatggaatgaaggctctggggtctgaacccag

SEQ ID NO: 67642 - DNA, 201 bp, Homo sapiens
ttgagatgagttgttgggacatgcaaataaaatgaagaatgaactttcgtgtctttttgtttcttgttgtgggctcgtttacatagcttcatgataatgaraaagaaaaccaaagtgggatgaaaagtgcagagggaaacctgttctattaaataactggggaagttgccttaatgtcttgaccttgatttcctcatctat

SEQ ID NO: 67643 - DNA, 201 bp, Homo sapiens
gggtgagcaaccatttcccatctctattagggcgataagaggaatttggtaatgtgaggtttaagttaggttttgtgacaagaagtcccacgtagtcctgyttggtcttctgtaccttgtacactgctccaccgtggagcagataaactggccaatcagcgccaggaactgctcggtgtaccgggaatggaactgcttcag

SEQ ID NO: 67644 - DNA, 201 bp, Homo sapiens
gattctgacaggaaaggcaatcaagggctttataagttccactgtatagcaacatttataaggcagcccaggatgacatcaagaaacagtgagtgaacaartaagcacttgtaatacccggcataataccttaaaatccgttaggatttactgagtttatctatagtaaatttgaagagactatggatgttcaaagggtat

SEQ ID NO: 67645 - DNA, 201 bp, Homo sapiens
gggtgagcaaccatttcccatctctattagggcgataagaggaatttggtaatgtgaggtttaagttaggttttgtgacaagaagtcccacgtagtcctgrttggtcttctgtaccttgtacactgctccaccgtggagcagataaactggccaatcagcgccaggaactgctcggtgtaccgggaatggaactgcttcag

SEQ ID NO: 67646 - DNA, 201 bp, Homo sapiens
aagcttgttttttgcctatggatttatccatatgttctggtctgtgggagccaggaataattgagaaattttaatttaagaattagtttcattgaagtacrgggacttatacaacccagtattagttttgagcgtacagacatatgtggaactattcttggaaagtctacaaagtgaaatctatcgagttatttctcattt

SEQ ID NO: 67647 - DNA, 201 bp, Homo sapiens
aggcattgtatttcaaaggcataaagactcgaatttcataaacataaatttaactaagaaaagatctcatatccgacataggcattctatacaaaaagctytttagttaaatgttaatctgttggtattgttactcattgcaaataataaatgttatacgtacccagatttttgttgtattgaagttttggcaactgagcg

SEQ ID NO: 67648 - DNA, 201 bp, Homo sapiens
ctgttgggctgctttctgtgtaagttgtgatggcacagaggatacaaacctgccagattttcttaggactgttcagttgatgaattactgcaaatctttcytccttacacattttgatattttattatctgttagtatcccaatgagaaggtggcccaaagaaatgaagaaacgcaatatttagtactgttttctttctag

SEQ ID NO: 67649 - DNA, 201 bp, Homo sapiens
ttgctctgaaggtgattttttattttttttgtaaatgataaacataaggcaatattacttgcagatagtccttagaaggataagtatcagtttgaggggaytataaacatcagtttgtgcttttttatccttaccatataataaatgagctatttcttttttaggccaaaaaatcattttactgggcaagaaaaacatctc

SEQ ID NO: 67650 - DNA, 201 bp, Homo sapiens; identical to SEQ ID NO: 67647

SEQ ID NO: 67651 - DNA, 201 bp, Homo sapiens
tttctatatccttgacctttgggagtttgattattaaatggcttgaactagtcttgtttggattaaatcaatcaccaatccttgcttggtgttctgtagcyttcttgtgcttgaatattgatatctttctctagatttgggaagttctctgttattttttcttcaaataaactttctaccctcatctttctctatctcctt

SEQ ID NO: 67652 - DNA, 201 bp, Homo sapiens
cttggaaagtctacaaagtgaaatctatcgagttatttctcatttgcaaagtgatcctttgagtcatttctcataatctataatctgaatgttaatactgrtatttttaaaagccctacatcccaacagaccaggccatctagatatttcagcgtggtgtctcaggatgagtaaacaaacagctaaaaatatatgacttat

SEQ ID NO: 67653 - DNA, 201 bp, Homo sapiens; identical to SEQ ID NO: 67643

SEQ ID NO: 67654 - DNA, 201 bp, Homo sapiens
ctcttggctaagaccagcactggatctaatgaagcaccagaggcccttcaaggaatgtctggatggattcccataccccaacctaaaaataccccaaagtctatgattcacaaagtgatctattaatgttcagttgttcatgtatcaaagatgtcttttttgaagctatatttttaaccttttggaataagtgctccaaat

SEQ ID NO: 67655 - DNA, 201 bp, Homo sapiens
ttttcttttttccaatccagaggttaattggagtagagtgccctgaaattatggagagaaaccattggtaggtttatattaatattagttagattaccaarattctactccttaatatgaatggaataatttttaacagaggcttctgctcctctattcccagatcacactgggaattgtatgacagttcattttctatat

SEQ ID NO: 67656 - DNA, 201 bp, Homo sapiens
gccacttttgaagctttcagatggggaaattatgaatatttatgaaaagggtcatccattacctgatatttttagcatttatttttcttttattgtaaatrtggtggtttttcttttttttttcttttttccaatccagaggttaattggagtagagtgccctgaaattatggagagaaaccattggtaggtttatattaa

SEQ ID NO: 67657 - DNA, 201 bp, Homo sapiens
tggcagaacaggtttactcaggagaggattatggtttatttcatgttgcattttctttctgaagttgaagtggaattacagacctgaaatagttatgttgytatctttaaatgatattacagatttgctaagactctcattgacttccagaagcattcacagtttctgaaatagttacattagttttgttcagttctccag

SEQ ID NO: 67658 - DNA, 201 bp, Homo sapiens
caacatgtacatggaaacatttcaataaattttcatttagttaagccacttttgaagctttcagatggggaaattatgaatatttatgaaaagggtcatcsattacctgatatttttagcatttatttttcttttattgtaaatgtggtggtttttcttttttttttcttttttccaatccagaggttaattggagtagag

SEQ ID NO: 67659 - DNA, 201 bp, Homo sapiens
tggcagaacaggtttactcaggagaggattatggtttatttcatgttgcattttctttctgaagttgaagtggaattacagacctgaaatagttatgttgktatctttaaatgatattacagatttgctaagactctcattgacttccagaagcattcacagtttctgaaatagttacattagttttgttcagttctccag

SEQ ID NO: 67660 - DNA, 201 bp, Homo sapiens
gaagggaaaccctcattgtcaattatgatatgattagagtaataggaaactatttttggtatgagtacattttgtttaaatattccgtttttttcaagttwttttttaaactaagtgaaaccactttagtaacaaattattaacagaaatgaagtgaaatgaagtgggcaaacttagattttaaataatgacattttcaac

SEQ ID NO: 67661 - DNA, 201 bp, Homo sapiens
gaaacaagcttaataggaacagctgcctgtacatcaacatcttctcagaatgacccagaagttatcatcgtgggagctggcgtgcttggctctgctttggyagctgtgctttccagagatggaagaaaggtgacagtcattgagagagacttaaaagagcctgacagaatagttggagaattcctgcagccgggtggttat

SEQ ID NO: 67662 - DNA, 201 bp, Homo sapiens
attttgagttaaattttgtgtctgttgagaggaaggggtccagcttgatttgtttgtgtgtggatattcagttgtcccagtatcatttgttgaaaagactrtttgttccccagtgaattttcttgcccttgtggtcaaaattcccttgactgaaaggtaagggtttctttcaacaatattttgtagttttcagagtataag

SEQ ID NO: 67663 - DNA, 201 bp, Homo sapiens
ctgatttgcatttctctcatagataatgatgttgaacatcttttcatatgcatataggccatttgttgtttggagaaatgtatatttagactttgcatatwtttttaattgggcagatttaaaatttatgtattgttgagtttcaagagtcctttatatattttaggtacaagtcccttattagatatgtgatttgcaaaa

SEQ ID NO: 67664 - DNA, 201 bp, Homo sapiens
gtagagacggggtttcgccatgttggccaggctggtctcaaactcctgacctcaggtgatccacccacctcagcctcccaaagtcctgggattacaggcaygagccaccatgcctggcctgttactcctatattttcttctaagagttttatagttttacctcttaaatttagctctttgatccattttgagttaaatttt

SEQ ID NO: 67665 - DNA, 201 bp, Homo sapiens
ttgagtttcaagagtcctttatatattttaggtacaagtcccttattagatatgtgatttgcaaaatttttctcattctgtgggttttctttccattcttmttaatggtttccattgaagtacacatggtttaaattttcatgtttattttttctttcgttgcttgtgcttttgatgtcatatttaggaaggctttgtcca

SEQ ID NO: 67666 - DNA, 201 bp, Homo sapiens
tatccgtggcaaggaagcctgtaaattcagaccttccacccaaaaataacttaaaagagtaagaactgaagaaactggggtgcgtagataataaacaatcyaagcccacggatggctgtttcaaaccctggcacttacttattgagattctccagagcagctgccagatgtttagaatcaaaccgacaagaataatttaat

SEQ ID NO: 67667 - DNA, 201 bp, Homo sapiens
cctcggcttttgtttgtctgggaaagtctttatttctccttcatgtttgaaggatattttcactggatatactattgtagcataaaagttcttttccttcrgcactttcagtgtgtcttgcccctctctcctggcctgtaagatttccactaagtctactgccagacatactagagctccattgtttgttgtttcctttct

SEQ ID NO: 67668 - DNA, 201 bp, Homo sapiens
tgagtatctcttatctgaaatgctagggatcagaagtgtttcagattttttatttttttcagatgtttgcattatacttaccagttgagcatctctaatcygaaaatctgaaatttgaaatgatctaatgagtattttgtttgtcacattactgctcaaaaagttttggatttcagatttttggattagagatactcagcc

SEQ ID NO: 67669 - DNA, 201 bp, Homo sapiens
tttgcctacctcttgtaggcttttgatttgaaattaccaggaagcttgcaggtcatatcttataaccgattattttaaactgatgacaactgattccacaracgagcagagaaaactaataaaaactctacactttatcctccttgctttttaacttttgtgagttttgtaccttcatgtaattgcttactgctcgttaag

SEQ ID NO: 67670 - DNA, 201 bp, Homo sapiens
gaaggtaattttctctggtagtatgttttaatttcttgcttttaatttttttgcctacctcttgtaggcttttgatttgaaattaccaggaagcttgcagrtcatatcttataaccgattattttaaactgatgacaactgattccacaaacgagcagagaaaactaataaaaactctacactttatcctccttgcttttt

SEQ ID NO: 67671 - DNA, 201 bp, Homo sapiens
gaatcatccatacatgtttttgtccattactattggcgtcttaatatttttccagtggtttttaatgagtaaattttattatatatacatgtattaatctyttgttctatttcatatgtctttcccaaagtattgttttagtttttatttttaaaattaattttttaactttctaattttcggttggcactttaaaaatgt

SEQ ID NO: 67672 - DNA, 201 bp, Homo sapiens
catcccttcattttcagtctctttgtggctttataggtgaagtgtgtttattttaggcagcagatcgttggttctttttttaaatccattcagccacttaygcctttcgagtggagtttagtccatctacattgaatgttattattggtaagtgcgtactattgccattttgtttttgttttctgattgttttgctgtctt

SEQ ID NO: 67673 - DNA, 201 bp, Homo sapiens
ttaaatttatactgttacgaataacttctgggacagatagtttgtcactgtggattagtgcattattaataccaaaattagttttatgatctatttagttrttaacattgagtgtatacaagtattgtgctagtcagggaaacaacaggtaaaaaactgaccttgacctagagaaggcctttttctttttttctttttttt

SEQ ID NO: 67674 - DNA, 201 bp, Homo sapiens
ttgtcttgaaatctattttactgatgtaaatatcactatgctcttttttggtttccatttgcatggaatatctttttccatcccttcattttcagtctctktgtggctttataggtgaagtgtgtttattttaggcagcagatcgttggttctttttttaaatccattcagccacttacgcctttcgagtggagtttagtc

SEQ ID NO: 67675 - DNA, 201 bp, Homo sapiens
gccaggctccttatagagctaacgttccttcttgtttacatcaaaaggagtttttaggtgttaaaacgatttccaattcctgtaccaattggcattttctrattaacaaataacttttagtactattaatacattactggttaatttcgctgatgaactttgctttttgaatgggttaagaatgactgtacctggaaaaat

SEQ ID NO: 67676 - DNA, 201 bp, Homo sapiens
aaagtacatgccaggctccttatagagctaacgttccttcttgtttacatcaaaaggagtttttaggtgttaaaacgatttccaattcctgtaccaattgrcattttctgattaacaaataacttttagtactattaatacattactggttaatttcgctgatgaactttgctttttgaatgggttaagaatgactgtacc

SEQ ID NO: 67677 - DNA, 201 bp, Homo sapiens
tttctgaagttgaagtggaattacagacctgaaatagttatgttgttatctttaaatgatattacagatttgctaagactctcattgacttccagaagcattcacagtttctgaaatagttacattagttttgttcagttctccagatttgaaggcagagactcatttttgatgtgtgtgtgtcttctttggttcttagtt

SEQ ID NO: 67678 - DNA, 201 bp, Homo sapiens
tattggggtctgtctccttagctctaataatatttcctttatatatctgagtgctccggtattgggtgcatatgtaattgttacatcctcttgctgaattracccctttatcattatctaatgaccttctttgcctctttttatagtttttgtcttgaaatctattttactgatgtaaatatcactatgctcttttttggt

SEQ ID NO: 67679 - DNA, 201 bp, Homo sapiens
ggaatacagcaaagtacatgccaggctccttatagagctaacgttccttcttgtttacatcaaaaggagtttttaggtgttaaaacgatttccaattcctrtaccaattggcattttctgattaacaaataacttttagtactattaatacattactggttaatttcgctgatgaactttgctttttgaatgggttaagaa

SEQ ID NO: 67680 - DNA, 201 bp, Homo sapiens
tgtatgaaaatggaaaaatcggccaggtgcggtggctcatgcctgtaatcccagcactttgggaggctgaggtgggcagatcacgaggtcaggagttcaaraccagcctggccaatatggtgaaaccccgtctctactaaaaataagaaaaaattagccaggcgtggtagcacgcacctgcagtcccagctacttgggagg

SEQ ID NO: 67681 - DNA, 201 bp, Homo sapiens
tttcaaaaggtaggaaaaagctcagcgagtgaaacatccagagacacaggttctaataatcacaatcaggaactttctaatgagaacaagacttagccagyggactgtgctgcctggagaggtagcacaagccccctcggtgagagtgttccagcagtggctgcatgactacctgtcaaggatgtcctagagctcattcat

SEQ ID NO: 67682 - DNA, 201 bp, Homo sapiens
aaaaatacaaaattagccgagtgtggtggtgcatgcctgtaatcccagctactcaggaggctgaggcagaagaatcgcttgaacgggaggcagaggttgtrgtgagccgagatcgtgccattgcactccagcctgggcaacaagagcgaaactccgtctcaaaaaaaaaaaaaagttttgatatgtttttgtcacataata

SEQ ID NO: 67683 - DNA, 201 bp, Homo sapiens
tgctttaatttgcaatttaaaatgaaggggttaaataagttagacatttaaaagaaatgattgttaccataaattagtgctaatgctgaggagaactacastttttcttttgaatttagtatttgagatgagttgttgggacatgcaaataaaatgaagaatgaactttcgtgtctttttgtttcttgttgtgggctcgtt

SEQ ID NO: 67684 - DNA, 201 bp, Homo sapiens
tttggaactggcttttcatttagcacaatgtttttgaggttcattcatgttgtagcatgtttcagttcttcatttgtttttatggccaaataatcttccaytgtgtggctatattacattttgtttagccattcatcaattgatagatatttgggttgtttctactttttggttattacaagcaatgctgctatgaacatc

SEQ ID NO: 67685 - DNA, 201 bp, Homo sapiens
gaataacttctgggacagatagtttgtcactgtggattagtgcattattaataccaaaattagttttatgatctatttagttgttaacattgagtgtatasaagtattgtgctagtcagggaaacaacaggtaaaaaactgaccttgacctagagaaggcctttttctttttttctttttttttttttttttttttttttt

SEQ ID NO: 67686 - DNA, 201 bp, Homo sapiens
attcacaaagtgatctattaatgttcagttgttcatgtatcaaagatgtcttttttgaagctatatttttaaccttttggaataagtgctccaaatttagyagctgctgtgagaagtcttacttacttccttttatttatcctaaatggaactttctcaagctctaggaatgccatttcacactagtattctcaaattggg

SEQ ID NO: 67687 - DNA, 201 bp, Homo sapiens
aaaagagcttccaaagtattttgcatcacttaatgaattaacagcaaaatcaaggaagtaccttttaaacaactcttccaagacctaaatattagtagttwtttactaacagaaaaaagtttattcatatttatattactctccataatgctgattatggaattcagaagaaatcctggttgttgaaattctaggactaga

SEQ ID NO: 67688 - DNA, 201 bp, Homo sapiens
atgattagacttttatttcaggaatatactctgacatttttgtggaggatggtttggaggaaagtctagtaaaacatacactaagattaattattctgtcaatgatgataaaaggccagaactagggttgtaaaatgaaaggtaatgaataaatttgggtaatatctaggatgtagaatgtaaaaaacgtgatgatttgga

SEQ ID NO: 67689 - DNA, 201 bp, Homo sapiens
aatccagggttcttaattttttttgtgtgtctgatatggtttggctgtgcccccacccaaatttcatcttgaattgtagttcccataatccccatgtgtcrtgggagggacccagtgggaggtaattgaattatgggggtggttacctccatactgttctcgtaatagtggatgagttctcacgagatctgatggttttat

SEQ ID NO: 67690 - DNA, 201 bp, Homo sapiens
acaggaaaaaaaataaggatttcctgaactgatctcttggctaagaccagcactggatctaatgaagcaccagaggcccttcaaggaatgtctggatggaytcccataccccaacctaaaaataccccaaagtctatgattcacaaagtgatctattaatgttcagttgttcatgtatcaaagatgtcttttttgaagcta

SEQ ID NO: 67691 - DNA, 201 bp, Homo sapiens
tttatagatataaggaattattatttatcgctactcacagctctcttcacttgataatttactgcttagttagagatactggttggacatcttagagactrggaatttggtttctagaattgtgttaaaaagagcttccaaagtattttgcatcacttaatgaattaacagcaaaatcaaggaagtaccttttaaacaact

SEQ ID NO: 67692 - DNA, 201 bp, Homo sapiens
tgattagacttttatttcaggaatatactctgacatttttgtggaggatggtttggaggaaagtctagtaaaacatacactaagattaattattctgtcaatgatgataaaaggccagaactagggttgtaaaatgaaaggtaatgaataaatttgggtaatatctaggatgtagaatgtaaaaaacgtgatgatttggat

SEQ ID NO: 67693 - DNA, 201 bp, Homo sapiens
aaaaatacaaaaatattagatgggcgtggtagtacgtgcctgtaatcccagctacctgggaggctgaggcaggagaatcgcttgaacctgcgaggcagagrctgcagtgagctgagaccacgccatcgcgctccagcctgggcaataagaacaaaactccatctcaaaaataaataaataaataaataaaaataagaataa

SEQ ID NO: 67694 - DNA, 201 bp, Homo sapiens
gattagacttttatttcaggaatatactctgacatttttgtggaggatggtttggaggaaagtctagtaaaacatacactaagattaattattctgtcaatgatgataaaaggccagaactagggttgtaaaatgaaaggtaatgaataaatttgggtaatatctaggatgtagaatgtaaaaaacgtgatgatttggata

SEQ ID NO: 67695 - DNA, 201 bp, Homo sapiens
cactgtctagggctgggcacaatggctcacgcctgtaatctcagccctttagttgccgaggcaggtggatcgcttgagcctaggagtttgaaaccagtctsggcaacatggcaaaaccctgttgctacaaaaaatacaaaaaaattagctgggcatggcggtgtgcacctatagtcccagctactcaggaggctgaggtgg

SEQ ID NO: 67696 - DNA, 201 bp, Homo sapiens
aagtctttatttctccttcatgtttgaaggatattttcactggatatactattgtagcataaaagttcttttccttcagcactttcagtgtgtcttgcccctctctcctggcctgtaagatttccactaagtctactgccagacatactagagctccattgtttgttgtttcctttctcttgttgctcttaggatcttttc

SEQ ID NO: 67697 - DNA, 201 bp, Homo sapiens
tactttgttgattttaaatccactgtctagggctgggcacaatggctcacgcctgtaatctcagccctttagttgccgaggcaggtggatcgcttgagccyaggagtttgaaaccagtctcggcaacatggcaaaaccctgttgctacaaaaaatacaaaaaaattagctgggcatggcggtgtgcacctatagtcccagc

SEQ ID NO: 67698 - DNA, 201 bp, Homo sapiens
tatgtatgtttatattaatgttctcttagattccttagtcattccttggcattaacagctaagtgcttaatgaataattttattaatgaaataattagttyttgatttatcacaagggatatatgtaacaaccataacagatgtatagtaggcatttgtttatacttgataagaaaatatgtgatactttgaaattgaagt

SEQ ID NO: 67699 - DNA, 201 bp, Homo sapiens
agtctttatttctccttcatgtttgaaggatattttcactggatatactattgtagcataaaagttcttttccttcagcactttcagtgtgtcttgcccctctctcctggcctgtaagatttccactaagtctactgccagacatactagagctccattgtttgttgtttcctttctcttgttgctcttaggatcttttct

SEQ ID NO: 67700 - DNA, 201 bp, Homo sapiens
acaatgaacccttactgaggtagaccatactttgttgattttaaatccactgtctagggctgggcacaatggctcacgcctgtaatctcagccctttagtwgccgaggcaggtggatcgcttgagcctaggagtttgaaaccagtctcggcaacatggcaaaaccctgttgctacaaaaaatacaaaaaaattagctgggc

SEQ ID NO: 67701 - DNA, 201 bp, Homo sapiens
gacaatgaacccttactgaggtagaccatactttgttgattttaaatccactgtctagggctgggcacaatggctcacgcctgtaatctcagccctttagktgccgaggcaggtggatcgcttgagcctaggagtttgaaaccagtctcggcaacatggcaaaaccctgttgctacaaaaaatacaaaaaaattagctggg

SEQ ID NO: 67702 - DNA, 201 bp, Homo sapiens
ttagctggatacaaagtttgaaggcagaggaaacactttgttatctattatgtaactacaaaaatattctgacgaatgacaaaaataaattagggttataktcctggagagaacagacatattgaaaggctttggtgtctcttgtttgtacagaatattctgacatacaatcatacataaagtattaaatgttcatgtata

SEQ ID NO: 67703 - DNA, 201 bp, Homo sapiens
aaacaaactcccaaattaataaaaaaaagtttcgggccgggcacagtaggtcatgcctgtaatcccaccactttgggaggctgaggtgggcagatcacctraggttgggagttcaagaccagcctgaccaacatggagaaaccccgtctctactaaaaatacaaaattagccgagtgtggtggtgcatgcctgtaatccca

SEQ ID NO: 67704 - DNA, 201 bp, Homo sapiens
atttggattaatttgtttttgaagttttttgtatataaatatgtaaatacatgctttaatttgcaatttaaaatgaaggggttaaataagttagacatttraaagaaatgattgttaccataaattagtgctaatgctgaggagaactacagtttttcttttgaatttagtatttgagatgagttgttgggacatgcaaat

SEQ ID NO: 67705 - DNA, 201 bp, Homo sapiens; identical to SEQ ID NO: 67657

SEQ ID NO: 67706 - DNA, 201 bp, Homo sapiens
ttagtttctgagtcttaccaatatgtatttttttctattacagattgtctcctaaccctctagttttaattggacacttctttgctgttgcaatctatgcygtgtatttttgctttaagtcagaaccttggattacaaaacctcgagcccttctcagtagtggtgctgtattgtacaaagcgtgttctgtaatatttcctc

SEQ ID NO: 67707 - DNA, 201 bp, Homo sapiens
acagtttcttcaatagtattatcttcaactactctctataatgctatctgataatatatctaaatctcttcacgcacattttttaagaatggctttttttrctgtgtgtttctgactactaaactgagtagtcttcatttctgttataggaactccatgctccactgactgttgttgcagatgggcttttctccaagttca

SEQ ID NO: 67708 - DNA, 201 bp, Homo sapiens
gttgggattacaggcttgagccactgtgcccagccgctttgattcgttttttacattatagtggcaaaaatgaccaagcaaacatgacagcaaaggttatktagccaggctgaccctttaggatagcagagaaggaggcacaggacccagcatctcatggaaataacttttttttctttatcccagaaaagccacatttag

SEQ ID NO: 67709 - DNA, 201 bp, Homo sapiens
gtagcataaaagttcttttccttcagcactttcagtgtgtcttgcccctctctcctggcctgtaagatttccactaagtctactgccagacatactagagctccattgtttgttgtttcctttctcttgttgctcttaggatcttttctatatccttgacctttgggagtttgattattaaatggcttgaactagtcttgt

SEQ ID NO: 67710 - DNA, 201 bp, Homo sapiens
tagcataaaagttcttttccttcagcactttcagtgtgtcttgcccctctctcctggcctgtaagatttccactaagtctactgccagacatactagagctccattgtttgttgtttcctttctcttgttgctcttaggatcttttctatatccttgacctttgggagtttgattattaaatggcttgaactagtcttgtt

SEQ ID NO: 67711 - DNA, 201 bp, Homo sapiens
actatgaagagttctcctttgactaaatgaaaattacataatttttatgtgacgggaatttagaggatatatttgtaactaaggcataagtccatttgtgyacattttggagtttgagtttgtggttacgatactttctattagaagtcaggatacaaaactgcaaggagaaatccctgtttcattctcactaaagaccca

SEQ ID NO: 67712 - DNA, 201 bp, Homo sapiens
cataccacttataaagtggaaactcttggaccaagatttggattaatttgtttttgaagttttttgtatataaatatgtaaatacatgctttaatttgcartttaaaatgaaggggttaaataagttagacatttaaaagaaatgattgttaccataaattagtgctaatgctgaggagaactacagtttttcttttgaat

SEQ ID NO: 67713 - DNA, 201 bp, Homo sapiens
tcttccccaaaccagagaagcctaaacaagtgatcctgaataacctaacctaggccttggcaattcagaacatggaggaagaatcctaacaggactcagtwtggagaaataatcctttccaggtggaaagcaagagtgatgttaacaacaaacacttctacaactagcactacaccacgaagcttctttcttcaaacacag

SEQ ID NO: 67714 - DNA, 201 bp, Homo sapiens
ctcagaacgtctgatgtttcccataatagacagaaaaaatgcagttgtatgagcaactgagtttcttttcatcttcaaattcatttgtgatggtgggaagrtctaaggacaatccttccattgaagaagtaggaaaaacagttacagcactgttctgaactcatcaaaaatgaaattaggcacatgtgcttcagcaacctg

SEQ ID NO: 67715 - DNA, 201 bp, Homo sapiens
ggaaacctgttctattaaataactggggaagttgccttaatgtcttgaccttgatttcctcatctatccagtgaagcaatttgataaggttattttctttaaaaaaaattacttatttatttatttattttattttggggctgtgactcagatttgaaccgaaaggttctttgctgagttctctgaaaatatcagattctg

SEQ ID NO: 67716 - DNA, 201 bp, Homo sapiens
atatatacatacgatggaatgctacgcagccataaaaaagaatgaattaacagcatttgcagtgacccggatgagactggagattattcttacaagtgaartaactcaggaatggaaaaccaaacatcgtatattcctactgatatgtgggagctaagctatgaggacgcaaaggcataagaattatacaatggactttgg

SEQ ID NO: 67717 - DNA, 201 bp, Homo sapiens
gagattgaagagctgcatccaagagtgcagaggaacagggctgcactttcttccccatggtagttactattcatggtcctgagtcactcctggaaaatcamtgtgagtagaccggatggagttcccctggcagggtgactaaggatggacacacctgtaattgctctaaacaaggaggtatgccctgacttgctttacaga

SEQ ID NO: 67718 - DNA, 201 bp, Homo sapiens
cagaactgcttgaacccaggaggtggaggttgcagtgggccgagattacgctactgcacttcagcctgggtgacagagtgagactctgtttcagaaaaaawaaaagaatggctaaaatgaaaatgactgacgccaccaaataatggcgaggatgtggactacacatatactcactcttggtgagagtgtaactggcacaac

SEQ ID NO: 67719 - DNA, 201 bp, Homo sapiens
attgctttctaaaatctgtgcaagtatctagcagtgtctggtgtgtctctcactcgctctctctaatgaattcatttgttcagcagacatgtattgaatcmtgtgatcagtacctgtctgctgaatacacgaatccattagagagagtgagtgagagacagagataaacggagggacaatactgaggaaagaggctccgaa

SEQ ID NO: 67720 - DNA, 201 bp, Homo sapiens
gacatgtattgaatcatgtgatcagtacctgtctgctgaatacacgaatccattagagagagtgagtgagagacagagataaacggagggacaatactgaggaaagaggctccgaagacagatttgattatccgtggcaaggaagcctgtaaattcagaccttccacccaaaaataacttaaaagagtaagaactgaagaa

SEQ ID NO: 67721 - DNA, 201 bp, Homo sapiens
gctgaggtatgagaaacacttgaacccaggaggtagaggttgcagtgagccaagattgtgccactgcactccagcccaggcgacagagtgagactgtctcaaaaaaaaaagaaaaggagggtggccttctctaagaatgagcaaaagttacttagctaaatggagcttgtaatggtcaaaagtattaaatgacctcagatg

SEQ ID NO: 67722 - DNA, 201 bp, Homo sapiens
gtattttcaggagcccaccccatagggtaaatgtgagcttctctatacggtttccatgggcgtttacaacacgatccctgctatctatccagactcatctycctctgtttacatgattcaatacctagcaggtcccatactttcccatccctgcacacttttttttttttttttttgcgacagacttttcactcttgtagc

SEQ ID NO: 67723 - DNA, 201 bp, Homo sapiens
atgacagttcattttctatataagtagcacagaaatttaaagcttgtttggaagtatctcagagatgagctgatcaaaccatttcatttttatagatgaakaaattgaagctcagagaggtagggctggcctcgaattccttttctagtgtacataccctcctgctgtttgtgaattggtagtgtatttcatctgattatt

SEQ ID NO: 67724 - DNA, 201 bp, Homo sapiens
atatttgattattttacaattttattttagattccctgcatcaactaagaaaagcctgttttctttatttcaaacttggtggcgaatgtgttgcgggtccygttgggctgctttctgtgtaagttgtgatggcacagaggatacaaacctgccagattttcttaggactgttcagttgatgaattactgcaaatctttctt

SEQ ID NO: 67725 - DNA, 201 bp, Homo sapiens
aatcaacctcaatcaaatgcattcaccattcaaattttcatgtattgactgaactgttcttaatacctgctttgtcaaaagcactgacttggtgagtgagmagcacagattatttatctgtaagtaggcagcctcaaatgacagcaggttgctggtgaggcggaggatatgagttccctctaggacaggcctccataacca

SEQ ID NO: 67726 - DNA, 201 bp, Homo sapiens
ctcgaatttcataaacataaatttaactaagaaaagatctcatatccgacataggcattctatacaaaaagctatttagttaaatgttaatctgttggtaytgttactcattgcaaataataaatgttatacgtacccagatttttgttgtattgaagttttggcaactgagcgatcaaaaatagaaagtttacaattgga

SEQ ID NO: 67727 - DNA, 201 bp, Homo sapiens
ttaaattgattttgaccaatatatagaaagggactcagcacctgttgggcactcagtttgcggtgacttggccaaagtcacataggtgataagtggtgaarccagattccaaacacacattggttccctccctcctacagcaagtattgtttgaggagatcatgctctgccttctgtgacaatcacaggcattgtcatgga

SEQ ID NO: 67728 - DNA, 201 bp, Homo sapiens
atggccctttaaattgattttgaccaatatatagaaagggactcagcacctgttgggcactcagtttgcggtgacttggccaaagtcacataggtgataaktggtgaagccagattccaaacacacattggttccctccctcctacagcaagtattgtttgaggagatcatgctctgccttctgtgacaatcacaggcatt

SEQ ID NO: 67729 - DNA, 201 bp, Homo sapiens
acaagttagtgatttgtccagaaataaaaatgttacctgagtttgctaactcccaagttggtagttttttaaaattccattttgagcaatagttgtagttktagttttagtttggaaggtagtggaatttccttagacaacattaatagcaatgcctcagtaacatattcattattttgaattcctctggtgcagactaga

SEQ ID NO: 67730 - DNA, 201 bp, Homo sapiens
ttcagtttgccctcataatgttgtctgcatcataaggtcaacagcacactctaactttttctgcctataaatgtcttcttttctactcggacaaagtattmctaaaagactggcaaaggggagtgagggaggtggggagaggagggaagacagtattataatgcaagcagcaataaggtggaaataaatgcatttcctctg

SEQ ID NO: 67731 - DNA, 201 bp, Homo sapiens
tctaaatttgaatattatgtaacacttgattgctatgggccacttagctcatagtggttgtaaatttagcttcagtgtcatataacccattgctctgaagktgattttttattttttttgtaaatgataaacataaggcaatattacttgcagatagtccttagaaggataagtatcagtttgaggggattataaacatca

SEQ ID NO: 67732 - DNA, 201 bp, Homo sapiens
ctgtaatcccagatacttggaaggctgaggtatgagaaacacttgaacccaggaggtagaggttgcagtgagccaagattgtgccactgcactccagcccrggcgacagagtgagactgtctcaaaaaaaaaagaaaaggagggtggccttctctaagaatgagcaaaagttacttagctaaatggagcttgtaatggtca

SEQ ID NO: 67733 - DNA, 201 bp, Homo sapiens
ctccatactgttctcgtaatagtggatgagttctcacgagatctgatggttttataagaggcttttctccttttgattatatttctctttcctgttgccaygtgaagaaggacatgtttgcttccacttccaccatggttgtaagtttcctgaggcctccacagccatgctgaactgtgagtcaatcgaacctctttcctt

SEQ ID NO: 67734 - DNA, 201 bp, Homo sapiens
gttcccatcaggagtataaactcctcgagggcctaggtcatatgttcatctttgtttctccagcatctggaaatgtgcttggcatgtactgcatatttgasggtatcaaataaatacagcatctagcaatttttcatatgggattttactcatgtattcattcattcagcaactacagtgccaagcactgttccagagctg

SEQ ID NO: 67735 - DNA, 201 bp, Homo sapiens
tggcatgaacttaactgtgcttgctgtgggaaccaggtcagtggagagagaaagaacaaaccaccatgattatttctttcctctggccacttaaggaatcyctcctggcttgcctatttcacttaactcctgaaccagatgagttgctgacaggagtacatggtggagaggaagaagaggcgggaggggcattgtgttaaa

SEQ ID NO: 67736 - DNA, 201 bp, Homo sapiens
aatttgaatattatgtaacacttgattgctatgggccacttagctcatagtggttgtaaatttagcttcagtgtcatataacccattgctctgaaggtgaytttttattttttttgtaaatgataaacataaggcaatattacttgcagatagtccttagaaggataagtatcagtttgaggggattataaacatcagttt

SEQ ID NO: 67737 - DNA, 201 bp, Homo sapiens
ctggatggttttgatgactgtggatgttcaccaatgtctgggcattgatgagttaggtatttattgtggtcttcggagtctgggcttgtttgtacccatcyttcttgggaacgcttttgaagtattcaaagggaagtgagtgttgtgatctaagtctttggtcatagcagccgtatctgtattaaggggcaccccaagtcc

SEQ ID NO: 67738 - DNA, 201 bp, Homo sapiens
tctgaaagctcacatctctgttactctgggattggtcactggtgccttatttattattgttaatttagtgagttcatgttttcctggatggttttgatgastgtggatgttcaccaatgtctgggcattgatgagttaggtatttattgtggtcttcggagtctgggcttgtttgtacccatccttcttgggaacgctttt

SEQ ID NO: 67739 - DNA, 201 bp, Homo sapiens
tagtgggttggataaataaaatgtagttcatatgaaccatgaaatactatgcagccaaaaagaatgaaataatgttctttgcagcattgtaggtggagtcrgaaataataatcctaagcgaattaatgcagaaacaaaaagccaagtgctacatattctcagttataagtgggagctatacgttgaacacacatgaacata

SEQ ID NO: 67740 - DNA, 201 bp, Homo sapiens
tattgtctaaatattttaaatactctaatattcttttctgttgtccctttagattcaaagacaattcaagtaaattatcaggcatagaaaggaacagaacrggctacagagtttcttagagacatagtttaattcatgattttttaccttgatttctttcaatgttttatagcattctctaggaaacatatttttaaaact

SEQ ID NO: 67741 - DNA, 201 bp, Homo sapiens
tctgactgaaaaagaatgctgttggttttttgttattctgtattttttatatctatattctagtagaaatcctgatatttgctaaataggttttacattgrcagttttatatttattgccttgatcattagactaattgacaaataaaagagtcaattacttgcccaatttttggaatctgggaaggggaagccttactta

SEQ ID NO: 67742 - DNA, 201 bp, Homo sapiens
ttgaaagggaagaaatactccacaactcattctataaagtcaaacttacccgatctcaaaaccaaaggcattacaaaagaaagaaagaaaagaaataaagmaagcaagaaggaagatattgatgcggatacagtatgggataacatctaaaattatttgtgacaaaaattctcagcaatttaataacaaaaggaatctctt

SEQ ID NO: 67743 - DNA, 201 bp, Homo sapiens
aaatgatatggtttgtctgtgtgcccacccaaatctcactttgaattgtaataatcccaacatgtcaagggcaggaccaggtggggataattgaatcgtayggacagtttcccccatgatgttctcatgatagtgaatgagttctcacaagatcagatcattttataagggacgtccccctttgcttggcacttccttcta

SEQ ID NO: 67744 - DNA, 201 bp, Homo sapiens
cagcataactcggcttacccttgaggatgtagaaattggtatacagataggcaatgcttctataaaataatcaattgcttattatttggcaagaagagcamaagctataattgaatgattgaagaatgaaatatgtataatgtagtgacaaaacctttggtaaatagtgagctacaatagtgttataagcaaataatgtag

SEQ ID NO: 67745 - DNA, 201 bp, Homo sapiens
aaaatgaatcagaagtttctgtcccaattagatctttttcaaattttgcttggttaaaactataaattaactctgtctttttatgtatgtatgtatgtatrtatgtatgtatgtatgtatgtatgtatgtatttatttatttattttttgagatggagtttcactcttgttgcccaggctggagtgcagtggtgtgatctc

SEQ ID NO: 67746 - DNA, 201 bp, Homo sapiens
attttgagatttacccactttgttgcctacttgaatagttcattcctttttattgctgggtatcccattgtatgcatatgccacaatttatgtatccattygcttcttaacatacatttgggttgctttcaggttttggctattacaaataaagttgctatgaacattcacatacaagtctttggatggacatctgcttta

SEQ ID NO: 67747 - DNA, 201 bp, Homo sapiens
tattgtaaatttcatgaagcctccccagcaatgtggaactgtgagtccattaaaattctttccctttaaattacccagtctcgggtatttctgcatagcarcacgagatcagactaatacagtaaattggaactaaaagggtgatgtgcttctataaagatacctgaaaatgtggcagtgactttggaactgggtaacagg

SEQ ID NO: 67748 - DNA, 201 bp, Homo sapiens
aagtagaatgaataatcatagtgattattctcttcaaacctttcaaatttgtaagaaaatcctatgtttaataagctaatttattaaatattagtgtaatsagcattttgtttaattgaattgtgacttcgccatgccttatggtattaacagtctggctccaggtctacatggaacctgatgtctgccccatattcattc

SEQ ID NO: 67749 - DNA, 201 bp, Homo sapiens
taggaagctgacaaaaatagtatctgtcaataagaaaataatgaccggtatttttccatatttaatctaatttaacgttaaaaatttttattaagagttakccatattgatttccaagtaaaaatgatagtgggaagcgtagttctagattcactacacagcatgcatacttaaataactcaagcatgaaaaataagtaaa

SEQ ID NO: 67750 - DNA, 201 bp, Homo sapiens
caatcagacaagccgagaagtcccatgaaattctatcttccagttggagaacagggaaggctggtgatgtaattcagttcaaggcccaggagatgcagtgrtgtaactctcagtctgaggccaaaggtgggagaaccagggagcctgctgatgtaatttctggagtctgaatgcctaaaaacctgaaaatctgatttctaa

SEQ ID NO: 67751 - DNA, 201 bp, Homo sapiens
aaagtaaaaacattcactagcaaaacagtctcaagattcaagattcctttttagagaaacagaatgtttggtttagccttgaaattatttgtcttttaacragaagatgaaatataacctttgatttccaaatctcccaactatctagactgaaagttaatttgttgcactatctgagcaaatttctctgaaatgtattcc

SEQ ID NO: 67752 - DNA, 201 bp, Homo sapiens
tgtcttttctttctaattttcctttcgtcttttaaaatgaagcataatgtattaatctgtcaatgtgtatgactcagtgaatatttcagaaagtactcttytgacataaaattttaatccagtgattcataattttataagtgaaatatgacacattttaaattctaaaaatagtaggttatatattaaatgtaagatcta

SEQ ID NO: 67753 - DNA, 201 bp, Homo sapiens
cattttatctattctggatgtcgatgtggaagctgtgagttttaagtcaggtcaaaaaaagaagaagaaagaaaaaaagatatttcttaaaagaaagaatmtaggccacatttggcttcaaaaggcttctttgctcatctatttgattgttgtcctaaatttaaaaagtcaaatttcaaataaaatagtttttctctgtgt

SEQ ID NO: 67754 - DNA, 201 bp, Homo sapiens
tgaggcaggagaatggtgtgaacccgggaggcagaggttgcagtgagctgagatcacaccattgcacttcagcttgggccacagagcaagactccatctcaaaaaaaaaaaaaaaaaaaaagaaaagaaaaaaaaaagaaatacatttttgctgctacaagtcactaagattttgaattttttattactacagcataactc

SEQ ID NO: 67755 - DNA, 201 bp, Homo sapiens
ctctcactttacttgtaacacgttccctaccctagcctttatggttctgtaaattttatccctatgagaaaaagaaaatagaaaagaagaaagaaaggatmcaatgaaagatcttatctttttcctctttctatgataacctacataattttctaatcatgattttttcctaatattttcttgctatcatgaaatgttaat

SEQ ID NO: 67756 - DNA, 201 bp, Homo sapiens
agatatggtcttgtggcctattatgtccaacttgacaaatgacttttctggtattactaggaaagacagttttaggaaagtctaggacttacagactgggrtaatccagattgtgatagaataatcagtcatatcctagactagtcattgtgatttgggctctgtgtccccacccaaatctcaccttaagttgtaataatt

SEQ ID NO: 67757 - DNA, 201 bp, Homo sapiens
agccatttggaactgtgagtcaattaaacctctttcctttataagttactgagtctcaggtatttcttcatagcagtgtgagaacagactaatacagcagsctaagatcagaggccttccatatcacaggaggaggaattatttttttcttcctaaatataatgtaaattacagaatataattatagaactggcatgggcc

SEQ ID NO: 67758 - DNA, 201 bp, Homo sapiens
tactcgggaggctgaggcaggagaaaggcatgaacctgggaggtggaacttgcagtgagctgagatcacgccactgcactccagcatgggcaacagagcgmgactccatctcaaaaaaataaaaaaatttggttacaaaatccagaccttgccaaatgtcttccaggggtaaaaaattgcctttattaaaaactactatta

SEQ ID NO: 67759 - DNA, 201 bp, Homo sapiens
ttaaaattgtattttacataacaatataagaaagatgataaaaattcatgcaataataaatgcacaacaaataaaatatttatgaataaaagattttttayaggcttcagaaccatatgaaagcatcatgtcaacaaaaagctcttgttttgacatttctgtgtaatgtaacaaaatctcaatgaaactggagcaagaaat

SEQ ID NO: 67760 - DNA, 201 bp, Homo sapiens
tcatccctccaaaatttgtcatatccctctctactgcctctctccacccattctgatcactggcaagcactgataagctttcagttgctttaaattagttygtgttttctgtaatttcatataaatagaatcatacaatatgtactctatctgacgtcttcaacttagcataattattttgagatttacccactttgttgc

SEQ ID NO: 67761 - DNA, 201 bp, Homo sapiens
tcaaaatattttcagttaacgactgtagactagaaaaaattctgtgaatatttataaagacacaaaattacccagcccataccaaggtaaaattcacaatmtttgctatttaattttagctattttttaaagaattccagttatgcacagaatcaagaaaataaaattcaaaatattgagataaatcaatcaaaaattact

SEQ ID NO: 67762 - DNA, 201 bp, Homo sapiens
gtttattcatatcttctgcatagtccctctgggttggaaatcttctggttagctgagatattttgatcttgattttatgtctctttttttatcatttattytaagttcaggggtacatgtgcaggtttgttatataggtaaatgtttgtcttgggcatttgttgtacaaattatttcatcactcaggtattaagcccagta

SEQ ID NO: 67763 - DNA, 201 bp, Homo sapiens
ttaaagagcttctgcatggcaaatgaaactatcaacagggtaaatagacaaccttcagaaatgaagaaaatattcacaatctatgcaactgacaaaatcckaatactcagaatctataaggtacttaaactaatcagttagcaaaaaccacatagccccataaagaatggtaaaagacatcaacagacactccttataaga

SEQ ID NO: 67764 - DNA, 201 bp, Homo sapiens
aagtcttggtggcatacacgtggtgttgagcctgttggtgagaagaaatcaacaattaaggcttagaaatctctgcctaatttcagaggatgtatggaaaygcctggatatccaggcagaagtttgctgcaggggcggagccctcagggaaaaacctctgctaggacagtgcagaagggaaatgtggagacggagccatca

SEQ ID NO: 67765 - DNA, 201 bp, Homo sapiens
cagggttttttttttttccttttgtgggggagggttggtagggtttttgttttgtttctgctactgattcaatttcagagtttttgtctattcaggttttyggcatcttcttgattcaatcttgaggaactgtgtgttgccagaaatgtatccctttcctctagattttctaatttgtgtgcatagagttgttcatagtat

SEQ ID NO: 67766 - DNA, 201 bp, Homo sapiens
gcagaggaactcctccagttctgagtattgatcgacacttccacatgcttttgacaagcgtgtttgtggcgcagcatagacacacaagtaaagatacgatrtgatagcacctggctcttacagggatccaaacctagtactggtcttacaaaccatactaaagaaattcacgttgctcaagacattgagtagaatatacaa

SEQ ID NO: 67767 - DNA, 201 bp, Homo sapiens
tttatatattagggagatcagaatatatattgggaagtctgagaatggactttttgacaaagtaatgtggagtgtaccagaaaaagtctatcatacgtcaygcacttatggtgaaatggacattgaaagatacacccgaagaatagttagtgaatggagagcagcccaagatgagtctagagatagggaggcagcaggtca

SEQ ID NO: 67768 - DNA, 201 bp, Homo sapiens
taatgctagagaaaaagtcaactggcacttcatcaggccaattgatgaatacagttgcttctataagtgaattatggttgtaagaggtataaaattttctaaaaaaaatctttccagtgaattagaaagctcttcaaagtgtctattatttgacctgggtctcaaaatacaaagaagtattcattaacatcagtaaaggaa

SEQ ID NO: 67769 - DNA, 201 bp, Homo sapiens
aggcaggaggagaattgcttgaacccaagaggcggaagttgtggtgagctgagatcacgccactgcactccagcctgggtgacagagtgagactctgtctaaaaaaaaaaaaaacaaaaacaaaaggaattaaaaaaatgaaaaggatatttagaacttagaaaagtctggcatggaagaatatataatttaagaaatagg

SEQ ID NO: 67770 - DNA, 201 bp, Homo sapiens
caagtttttactaattccaaaaatatgtggttttgtgatattaaccacatctattcaattgacaacaatttggtttcttttttattttatttttttagttraagggtacaatgttaagattttaaccaaatcagtgaactacattagtaaatgaaaatatgatgaaaatataaaaacattacagaggtgtgattttctaat

SEQ ID NO: 67771 - DNA, 201 bp, Homo sapiens
ctgggtaacaggtaaaggatggaacagattgggggctcagaagaaaacaggaagatgtgggaaagtttggaacttcctagaggcttgttgaatggctttgrccaaaatgctgatagtgacatggacaatgaagtccaggctgatgtggtctcagatacagatgaaaaacttattgagaactagagcaaaggtgactcttgc

SEQ ID NO: 67772 - DNA, 16 bp, Homo sapiens
cacgtccggctaaagg

SEQ ID NO: 67773 - DNA, 16 bp, Homo sapiens
cacgtccggctaaagc

SEQ ID NO: 67774 - DNA, 21 bp, Homo sapiens
tgtagacaagcaccagaacac

SEQ ID NO: 67775 - DNA, 16 bp, Homo sapiens
tccaatgtcctgcacg

SEQ ID NO: 67776 - DNA, 18 bp, Homo sapiens
actccaatgtcctgcaca

SEQ ID NO: 67777 - DNA, 21 bp, Homo sapiens
cttggccacttgagaaattac

SEQ ID NO: 67778 - DNA, 16 bp, Homo sapiens
gggtgctccacctggt

SEQ ID NO: 67779 - DNA, 15 bp, Homo sapiens
ggtgctccacctggc

SEQ ID NO: 67780 - DNA, 23 bp, Homo sapiens
ggagttcgaacctaaagacgtat

SEQ ID NO: 67781 - DNA, 29 bp, Homo sapiens
tgagttatagatgttttctaatttagttt

SEQ ID NO: 67782 - DNA, 29 bp, Homo sapiens
tgagttatagatgttttctaatttagttc

SEQ ID NO: 67783 - DNA, 21 bp, Homo sapiens
tgaaatccagcaaagaatcat

SEQ ID NO: 67784 - DNA, 19 bp, Homo sapiens
tctcaccttcctgcacaac

SEQ ID NO: 67785 - DNA, 19 bp, Homo sapiens
tctcaccttcctgcacaat

SEQ ID NO: 67786 - DNA, 21 bp, Homo sapiens
ggcctacctggaaattgtaac

SEQ ID NO: 67787 - DNA, 24 bp, Homo sapiens
taaagaatgcataaattagtgtgg

SEQ ID NO: 67788 - DNA, 25 bp, Homo sapiens
ttaaagaatgcataaattagtgtgt

SEQ ID NO: 67789 - DNA, 25 bp, Homo sapiens
gatcctaattggatttgaagactta

SEQ ID NO: 67790 - DNA, 24 bp, Homo sapiens
attccttacatgtataaggtttcc

SEQ ID NO: 67791 - DNA, 25 bp, Homo sapiens
cattccttacatgtataaggtttct

SEQ ID NO: 67792 - DNA, 25 bp, Homo sapiens
ttcatacaggagagaaactttacaa

SEQ ID NO: 67793 - DNA, 15 bp, Homo sapiens
atcgcccatgtgctg

SEQ ID NO: 67794 - DNA, 16 bp, Homo sapiens
catcgcccatgtgctt

SEQ ID NO: 67795 - DNA, 20 bp, Homo sapiens
tcaaaccaggaaccctatct

SEQ ID NO: 67796 - DNA, 21 bp, Homo sapiens
tttccttcctctttgtttttg

SEQ ID NO: 67797 - DNA, 22 bp, Homo sapiens
ttttccttcctctttgtttttc

SEQ ID NO: 67798 - DNA, 24 bp, Homo sapiens
tcatcttcaacatgtttttctttc

SEQ ID NO: 67799 - DNA, 15 bp, Homo sapiens
ggtgctgggcattca

SEQ ID NO: 67800 - DNA, 15 bp, Homo sapiens
ggtgctgggcattcg

SEQ ID NO: 67801 - DNA, 22 bp, Homo sapiens
gggaataaacccttttcaaact

SEQ ID NO: 67802 - DNA, 22 bp, Homo sapiens
gaaaaggaggatgaagatgtct

SEQ ID NO: 67803 - DNA, 20 bp, Homo sapiens
aaaggaggatgaagatgtcg

SEQ ID NO: 67804 - DNA, 19 bp, Homo sapiens
caccatgctctgcaaagac

SEQ ID NO: 67805 - DNA, 21 bp, Homo sapiens
catccaaactctcagtcttcg

SEQ ID NO: 67806 - DNA, 22 bp, Homo sapiens
ccatccaaactctcagtcttct

SEQ ID NO: 67807 - DNA, 24 bp, Homo sapiens
ggagaaatttgatgatgagaactt

SEQ ID NO: 67808 - DNA, 24 bp, Homo sapiens
agagatcaggaaactttttgtgta

SEQ ID NO: 67809 - DNA, 22 bp, Homo sapiens
agatcaggaaactttttgtgtg

SEQ ID NO: 67810 - DNA, 24 bp, Homo sapiens
gccaaatttggacttctttttata

SEQ ID NO: 67811 - DNA, 22 bp, Homo sapiens
gccacaatttatgtatccattc

SEQ ID NO: 67812 - DNA, 22 bp, Homo sapiens
gccacaatttatgtatccattt

SEQ ID NO: 67813 - DNA, 23 bp, Homo sapiens
gatgtccatccaaagacttgtat

SEQ ID NO: 67814 - DNA, 17 bp, Homo sapiens
tccttccggggtttatc

SEQ ID NO: 67815 - DNA, 17 bp, Homo sapiens
tccttccggggtttatt

SEQ ID NO: 67816 - DNA, 20 bp, Homo sapiens
gtagaagaggcagcattcag

SEQ ID NO: 67817 - DNA, 17 bp, Homo sapiens
aaggatggcctcatcag

SEQ ID NO: 67818 - DNA, 17 bp, Homo sapiens
aaggatggcctcatcaa

SEQ ID NO: 67819 - DNA, 20 bp, Homo sapiens
ccaggatggagatgaagaga

SEQ ID NO: 67820 - DNA, 20 bp, Homo sapiens
agaggcagagccattattgt

SEQ ID NO: 67821 - DNA, 19 bp, Homo sapiens
gaggcagagccattattga

SEQ ID NO: 67822 - DNA, 22 bp, Homo sapiens
cccaaattcctctaattctcat

SEQ ID NO: 67823 - DNA, 20 bp, Homo sapiens
tgatggggatgaagactgta

SEQ ID NO: 67824 - DNA, 19 bp, Homo sapiens
gatggggatgaagactgtg

SEQ ID NO: 67825 - DNA, 26 bp, Homo sapiens
tgttagaagtggattttattttcaga

SEQ ID NO: 67826 - DNA, 19 bp, Homo sapiens
tccaggtaacagattggca

SEQ ID NO: 67827 - DNA, 18 bp, Homo sapiens
ccaggtaacagattggcg

SEQ ID NO: 67828 - DNA, 19 bp, Homo sapiens
cggcatcatttgttcttga

SEQ ID NO: 67829 - DNA, 16 bp, Homo sapiens
ggttgcgatggcgatt

SEQ ID NO: 67830 - DNA, 16 bp, Homo sapiens
ggttgcgatggcgatc

SEQ ID NO: 67831 - DNA, 16 bp, Homo sapiens
cggcgtccccatcact

SEQ ID NO: 67832 - DNA, 17 bp, Homo sapiens
ggaggacgacctcgaag

SEQ ID NO: 67833 - DNA, 17 bp, Homo sapiens
ggaggacgacctcgaaa

SEQ ID NO: 67834 - DNA, 19 bp, Homo sapiens
cgtctcttgggcttttgat

SEQ ID NO: 67835 - DNA, 22 bp, Homo sapiens
cactacctccctctaggagaaa

SEQ ID NO: 67836 - DNA, 22 bp, Homo sapiens
cactacctccctctaggagaag

SEQ ID NO: 67837 - DNA, 21 bp, Homo sapiens
gatctcatggcttctgttcag

SEQ ID NO: 67838 - DNA, 22 bp, Homo sapiens
tctttaaagtattcctttgccc

SEQ ID NO: 67839 - DNA, 24 bp, Homo sapiens
gttctttaaagtattcctttgcct

SEQ ID NO: 67840 - DNA, 23 bp, Homo sapiens
gtgggttagaatcacctagagaa

SEQ ID NO: 67841 - DNA, 19 bp, Homo sapiens
cagacccttcaccaaagat

SEQ ID NO: 67842 - DNA, 19 bp, Homo sapiens
cagacccttcaccaaagac

SEQ ID NO: 67843 - DNA, 18 bp, Homo sapiens
cttcaccagccctctttc

SEQ ID NO: 67844 - DNA, 22 bp, Homo sapiens
tgaatcctgtacagccttactt

SEQ ID NO: 67845 - DNA, 22 bp, Homo sapiens
tgaatcctgtacagccttactc

SEQ ID NO: 67846 - DNA, 23 bp, Homo sapiens
cagttgagcagtttctaatgtga

SEQ ID NO: 67847 - DNA, 16 bp, Homo sapiens
gggaagctgttgcagg

SEQ ID NO: 67848 - DNA, 17 bp, Homo sapiens
agggaagctgttgcaga

SEQ ID NO: 67849 - DNA, 22 bp, Homo sapiens
cccgtatgactttgaaacagta

SEQ ID NO: 67850 - DNA, 16 bp, Homo sapiens
aggcatggaaacgcta

SEQ ID NO: 67851 - DNA, 14 bp, Homo sapiens
gcatggaaacgctg

SEQ ID NO: 67852 - DNA, 16 bp, Homo sapiens
tggccaacgcttcagt

SEQ ID NO: 67853 - DNA, 23 bp, Homo sapiens
cgatctgctaactttcttttgat

SEQ ID NO: 67854 - DNA, 23 bp, Homo sapiens
cgatctgctaactttcttttgac

SEQ ID NO: 67855 - DNA, 21 bp, Homo sapiens
ggaaaaaggaagcactgtgta

SEQ ID NO: 67856 - DNA, 23 bp, Homo sapiens
cagttttccatgggttctactac

SEQ ID NO: 67857 - DNA, 23 bp, Homo sapiens
cagttttccatgggttctactat

SEQ ID NO: 67858 - DNA, 25 bp, Homo sapiens
ttatgaaatggtacagacaagtgat

SEQ ID NO: 67859 - DNA, 19 bp, Homo sapiens
gttccttcctattttcggc

SEQ ID NO: 67860 - DNA, 19 bp, Homo sapiens
gttccttcctattttcggg

SEQ ID NO: 67861 - DNA, 20 bp, Homo sapiens
cggtctctgctctcattgta

SEQ ID NO: 67862 - DNA, 15 bp, Homo sapiens
cggtgacggtgatgg

SEQ ID NO: 67863 - DNA, 16 bp, Homo sapiens
tcggtgacggtgatga

SEQ ID NO: 67864 - DNA, 22 bp, Homo sapiens
cggaaagatggtttgttctatc

SEQ ID NO: 67865 - DNA, 20 bp, Homo sapiens
gcagaaattctctgaaatgc

SEQ ID NO: 67866 - DNA, 21 bp, Homo sapiens
tgcagaaattctctgaaatga

SEQ ID NO: 67867 - DNA, 22 bp, Homo sapiens
ctgtgaaaagcagtggttagtt

SEQ ID NO: 67868 - DNA, 20 bp, Homo sapiens
cttgaaggtgctgtgtgttc

SEQ ID NO: 67869 - DNA, 20 bp, Homo sapiens
cttgaaggtgctgtgtgttt

SEQ ID NO: 67870 - DNA, 23 bp, Homo sapiens
tctctaccccagctcatatactc

SEQ ID NO: 67871 - DNA, 20 bp, Homo sapiens
cagaaagctacaactcccaa

SEQ ID NO: 67872 - DNA, 20 bp, Homo sapiens
cagaaagctacaactcccag

SEQ ID NO: 67873 - DNA, 19 bp, Homo sapiens
cagcagacgaaggaaacac

SEQ ID NO: 67874 - DNA, 16 bp, Homo sapiens
gggctgcagtctctgg

SEQ ID NO: 67875 - DNA, 17 bp, Homo sapiens
ggggctgcagtctctgt

SEQ ID NO: 67876 - DNA, 17 bp, Homo sapiens
ctcccgcgaggtctcta

SEQ ID NO: 67877 - DNA, 22 bp, Homo sapiens
caataggcctcttatcatcctg

SEQ ID NO: 67878 - DNA, 22 bp, Homo sapiens
caataggcctcttatcatcctc

SEQ ID NO: 67879 - DNA, 21 bp, Homo sapiens
caatggttctgagatgacaga

SEQ ID NO: 67880 - DNA, 19 bp, Homo sapiens
ttccacaaagactgcaatg

SEQ ID NO: 67881 - DNA, 21 bp, Homo sapiens
ttttccacaaagactgcaata

SEQ ID NO: 67882 - DNA, 24 bp, Homo sapiens
cctgtatagcaagtcatcttcaga

SEQ ID NO: 67883 - DNA, 20 bp, Homo sapiens
gattctggcaaagcctttat

SEQ ID NO: 67884 - DNA, 20 bp, Homo sapiens
gattctggcaaagcctttac

SEQ ID NO: 67885 - DNA, 24 bp, Homo sapiens
tgcagtgtgaattatctggtacat

SEQ ID NO: 67886 - DNA, 18 bp, Homo sapiens
gaaacggctggtttgtgt

SEQ ID NO: 67887 - DNA, 16 bp, Homo sapiens
aacggctggtttgtgc

SEQ ID NO: 67888 - DNA, 24 bp, Homo sapiens
tccaatctaccttttccttgtatt

SEQ ID NO: 67889 - DNA, 18 bp, Homo sapiens
gaaaccctggcaggaata

SEQ ID NO: 67890 - DNA, 16 bp, Homo sapiens
aaccctggcaggaatg

SEQ ID NO: 67891 - DNA, 19 bp, Homo sapiens
aatgtgcaggcgaatgtac

SEQ ID NO: 67892 - DNA, 16 bp, Homo sapiens
gtggttgcaactggtc

SEQ ID NO: 67893 - DNA, 16 bp, Homo sapiens
gtggttgcaactggtt

SEQ ID NO: 67894 - DNA, 23 bp, Homo sapiens
ttctcccatttgttttttttatc

SEQ ID NO: 67895 - DNA, 19 bp, Homo sapiens
cgctatgagcacccctcta

SEQ ID NO: 67896 - DNA, 18 bp, Homo sapiens
gctatgagcacccctctg

SEQ ID NO: 67897 - DNA, 20 bp, Homo sapiens
catccacaacgagaacatga

SEQ ID NO: 67898 - DNA, 27 bp, Homo sapiens
gtgaaaactctaatagtctctcttcac

SEQ ID NO: 67899 - DNA, 27 bp, Homo sapiens
gtgaaaactctaatagtctctcttcag

SEQ ID NO: 67900 - DNA, 25 bp, Homo sapiens
gaacctaagctcaatctgaaataga

SEQ ID NO: 67901 - DNA, 24 bp, Homo sapiens
ggagaactgagagctatttatcat

SEQ ID NO: 67902 - DNA, 24 bp, Homo sapiens
ggagaactgagagctatttatcac

SEQ ID NO: 67903 - DNA, 21 bp, Homo sapiens
aagcaggaacacatcaagagt

SEQ ID NO: 67904 - DNA, 18 bp, Homo sapiens
atcttccaccactttccg

SEQ ID NO: 67905 - DNA, 19 bp, Homo sapiens
aatcttccaccactttcca

SEQ ID NO: 67906 - DNA, 21 bp, Homo sapiens
ggtatcaggtggacctctatg

SEQ ID NO: 67907 - DNA, 23 bp, Homo sapiens
gagtcattccatcttcattacag

SEQ ID NO: 67908 - DNA, 23 bp, Homo sapiens
gagtcattccatcttcattacaa

SEQ ID NO: 67909 - DNA, 22 bp, Homo sapiens
aatttccccatgagtcttaaac

SEQ ID NO: 67910 - DNA, 17 bp, Homo sapiens
gggcagtaggctgactt

SEQ ID NO: 67911 - DNA, 17 bp, Homo sapiens
gggcagtaggctgactg

SEQ ID NO: 67912 - DNA, 16 bp, Homo sapiens
gccggagctcctgttt

SEQ ID NO: 67913 - DNA, 20 bp, Homo sapiens
agaagccagagaagatttcc

SEQ ID NO: 67914 - DNA, 21 bp, Homo sapiens
cagaagccagagaagatttct

SEQ ID NO: 67915 - DNA, 20 bp, Homo sapiens
gctcccagagagacagaatc

SEQ ID NO: 67916 - DNA, 19 bp, Homo sapiens
gacaattgtgaccagcaca

SEQ ID NO: 67917 - DNA, 18 bp, Homo sapiens
acaattgtgaccagcacg

SEQ ID NO: 67918 - DNA, 18 bp, Homo sapiens
cgctctcccctggactct

SEQ ID NO: 67919 - DNA, 20 bp, Homo sapiens
cagcctcaggagataacagt

SEQ ID NO: 67920 - DNA, 20 bp, Homo sapiens
cagcctcaggagataacaga

SEQ ID NO: 67921 - DNA, 21 bp, Homo sapiens
tcaacccttttccacatagat

SEQ ID NO: 67922 - DNA, 16 bp, Homo sapiens
gccagggtgacactgg

SEQ ID NO: 67923 - DNA, 16 bp, Homo sapiens
gccagggtgacactgc

SEQ ID NO: 67924 - DNA, 20 bp, Homo sapiens
gaggcgctgtctacaatctc

SEQ ID NO: 67925 - DNA, 16 bp, Homo sapiens
gccagggatggcttct

SEQ ID NO: 67926 - DNA, 15 bp, Homo sapiens
ccagggatggcttcc

SEQ ID NO: 67927 - DNA, 20 bp, Homo sapiens
ctcactttggcacagaatgt

SEQ ID NO: 67928 - DNA, 20 bp, Homo sapiens
cccacatggtttttacaagg

SEQ ID NO: 67929 - DNA, 20 bp, Homo sapiens
cccacatggtttttacaaga

SEQ ID NO: 67930 - DNA, 18 bp, Homo sapiens
acccccacgtctgactta

SEQ ID NO: 67931 - DNA, 19 bp, Homo sapiens
acaaacgtaccattgaggc

SEQ ID NO: 67932 - DNA, 21 bp, Homo sapiens
aaacaaacgtaccattgaggt

SEQ ID NO: 67933 - DNA, 21 bp, Homo sapiens
tccacgctgatctgaagatac

SEQ ID NO: 67934 - DNA, 20 bp, Homo sapiens
cacctgacacttaccgctac

SEQ ID NO: 67935 - DNA, 20 bp, Homo sapiens
cacctgacacttaccgctag

SEQ ID NO: 67936 - DNA, 22 bp, Homo sapiens
ggctggagctttaatttgtatc

SEQ ID NO: 67937 - DNA, 18 bp, Homo sapiens
atcactccccagcaagag

SEQ ID NO: 67938 - DNA, 18 bp, Homo sapiens
atcactccccagcaagac

SEQ ID NO: 67939 - DNA, 22 bp, Homo sapiens
ggctctcgatgaagaaactaga

SEQ ID NO: 67940 - DNA, 17 bp, Homo sapiens
ccatggctgtgtgttcg

SEQ ID NO: 67941 - DNA, 17 bp, Homo sapiens
ccatggctgtgtgttca

SEQ ID NO: 67942 - DNA, 22 bp, Homo sapiens
gggagctaaggaagctacctac

SEQ ID NO: 67943 - DNA, 14 bp, Homo sapiens
ggtagcgccggttg

SEQ ID NO: 67944 - DNA, 15 bp, Homo sapiens
gggtagcgccggtta

SEQ ID NO: 67945 - DNA, 19 bp, Homo sapiens
cggaaccgattactgtgaa

SEQ ID NO: 67946 - DNA, 20 bp, Homo sapiens
ccacaggacaaggtaaaaca

SEQ ID NO: 67947 - DNA, 21 bp, Homo sapiens
tccacaggacaaggtaaaact

SEQ ID NO: 67948 - DNA, 18 bp, Homo sapiens
tgcaggctgctggtaact

SEQ ID NO: 67949 - DNA, 22 bp, Homo sapiens
ggaaggaaaagtggttctacta

SEQ ID NO: 67950 - DNA, 22 bp, Homo sapiens
ggaaggaaaagtggttctactt

SEQ ID NO: 67951 - DNA, 22 bp, Homo sapiens
aacctgcattctcaatcaacta

SEQ ID NO: 67952 - DNA, 15 bp, Homo sapiens
gcacggccaggtagc

SEQ ID NO: 67953 - DNA, 16 bp, Homo sapiens
tgcacggccaggtagt

SEQ ID NO: 67954 - DNA, 19 bp, Homo sapiens
ctttggtgcctctttgaca

SEQ ID NO: 67955 - DNA, 14 bp, Homo sapiens
cgggattgcctccg

SEQ ID NO: 67956 - DNA, 14 bp, Homo sapiens
cgggattgcctcca

SEQ ID NO: 67957 - DNA, 20 bp, Homo sapiens
ggatgcctttgagcttaaca

SEQ ID NO: 67958 - DNA, 17 bp, Homo sapiens
ccctccttcctgctgct

SEQ ID NO: 67959 - DNA, 16 bp, Homo sapiens
cctccttcctgctgcc

SEQ ID NO: 67960 - DNA, 20 bp, Homo sapiens
tgaagctttgcagaaaagag

SEQ ID NO: 67961 - DNA, 25 bp, Homo sapiens
ttctaggttgtaaatatgtctcacc

SEQ ID NO: 67962 - DNA, 28 bp, Homo sapiens
tacttctaggttgtaaatatgtctcact

SEQ ID NO: 67963 - DNA, 22 bp, Homo sapiens
tcccctaatcttttctgaatct

SEQ ID NO: 67964 - DNA, 17 bp, Homo sapiens
tcagctgtctcaggcca

SEQ ID NO: 67965 - DNA, 16 bp, Homo sapiens
cagctgtctcaggccc

SEQ ID NO: 67966 - DNA, 19 bp, Homo sapiens
cccaaaatgacccaagatg

SEQ ID NO: 67967 - DNA, 20 bp, Homo sapiens
caaaaccttggatctttcag

SEQ ID NO: 67968 - DNA, 20 bp, Homo sapiens
caaaaccttggatctttcat

SEQ ID NO: 67969 - DNA, 20 bp, Homo sapiens
ccattttccctccttttctc

SEQ ID NO: 67970 - DNA, 22 bp, Homo sapiens
gattgttcgttagggacactac

SEQ ID NO: 67971 - DNA, 22 bp, Homo sapiens
gattgttcgttagggacactat

SEQ ID NO: 67972 - DNA, 23 bp, Homo sapiens
tcacaaggagattctcaatcact

SEQ ID NO: 67973 - DNA, 18 bp, Homo sapiens
ctggctctgctgaagcta

SEQ ID NO: 67974 - DNA, 17 bp, Homo sapiens
tggctctgctgaagctg

SEQ ID NO: 67975 - DNA, 19 bp, Homo sapiens
cactcagggttcgtgtgtt

SEQ ID NO: 67976 - DNA, 15 bp, Homo sapiens
gccgcccactgagct

SEQ ID NO: 67977 - DNA, 14 bp, Homo sapiens
ccgcccactgagcc

SEQ ID NO: 67978 - DNA, 18 bp, Homo sapiens
ccctttcccccaagactc

SEQ ID NO: 67979 - DNA, 22 bp, Homo sapiens
ttcactttcttcttggagtcaa

SEQ ID NO: 67980 - DNA, 22 bp, Homo sapiens
ttcactttcttcttggagtcag

SEQ ID NO: 67981 - DNA, 20 bp, Homo sapiens
agcttcagggtcaaacagag

SEQ ID NO: 67982 - DNA, 22 bp, Homo sapiens
ttcatagtggcaagtgatacaa

SEQ ID NO: 67983 - DNA, 22 bp, Homo sapiens
ttcatagtggcaagtgatacag

SEQ ID NO: 67984 - DNA, 25 bp, Homo sapiens
tgaaagttaggatggacaaaaatac

SEQ ID NO: 67985 - DNA, 17 bp, Homo sapiens
gaggctggatgctgacc

SEQ ID NO: 67986 - DNA, 18 bp, Homo sapiens
tgaggctggatgctgact

SEQ ID NO: 67987 - DNA, 17 bp, Homo sapiens
gcctcgtgcgaatcatt

SEQ ID NO: 67988 - DNA, 14 bp, Homo sapiens
ggtgatgccctccg

SEQ ID NO: 67989 - DNA, 15 bp, Homo sapiens
tggtgatgccctcca

SEQ ID NO: 67990 - DNA, 24 bp, Homo sapiens
gtgttttcccaagtgaaataaata

SEQ ID NO: 67991 - DNA, 19 bp, Homo sapiens
cagctctcagcaggtcttg

SEQ ID NO: 67992 - DNA, 19 bp, Homo sapiens
cagctctcagcaggtcttc

SEQ ID NO: 67993 - DNA, 18 bp, Homo sapiens
ggtgttgcggaggtgtag

SEQ ID NO: 67994 - DNA, 18 bp, Homo sapiens
ggtggtgatcccagtcac

SEQ ID NO: 67995 - DNA, 18 bp, Homo sapiens
ggtggtgatcccagtcat

SEQ ID NO: 67996 - DNA, 21 bp, Homo sapiens
tcttgttttggcaccatttac

SEQ ID NO: 67997 - DNA, 19 bp, Homo sapiens
tcaacacggagaagttgct

SEQ ID NO: 67998 - DNA, 18 bp, Homo sapiens
caacacggagaagttgcc

SEQ ID NO: 67999 - DNA, 17 bp, Homo sapiens
tcctggccacgtttttc

SEQ ID NO: 68000 - DNA, 18 bp, Homo sapiens
tcagttaccttcatgacg

SEQ ID NO: 68001 - DNA, 20 bp, Homo sapiens
catcagttaccttcatgact

SEQ ID NO: 68002 - DNA, 18 bp, Homo sapiens
gcggaccacctgttaatc

SEQ ID NO: 68003 - DNA, 16 bp, Homo sapiens
cagggccctcaatcat

SEQ ID NO: 68004 - DNA, 16 bp, Homo sapiens
cagggccctcaatcac

SEQ ID NO: 68005 - DNA, 15 bp, Homo sapiens
tgccccgagcattgt

SEQ ID NO: 68006 - DNA, 16 bp, Homo sapiens
tctccctcaaagccca

SEQ ID NO: 68007 - DNA, 15 bp, Homo sapiens
ctccctcaaagcccg

SEQ ID NO: 68008 - DNA, 17 bp, Homo sapiens
cctggcccagaaatgac

SEQ ID NO: 68009 - DNA, 16 bp, Homo sapiens
ccaaccgggtccttca

SEQ ID NO: 68010 - DNA, 15 bp, Homo sapiens
caaccgggtccttcg

SEQ ID NO: 68011 - DNA, 17 bp, Homo sapiens
tgctcagaggcgatggt

SEQ ID NO: 68012 - DNA, 24 bp, Homo sapiens
caaacatacagtgaatcccaatat

SEQ ID NO: 68013 - DNA, 24 bp, Homo sapiens
caaacatacagtgaatcccaatac

SEQ ID NO: 68014 - DNA, 27 bp, Homo sapiens
ccatgattctgtatttgtgttacttac

SEQ ID NO: 68015 - DNA, 20 bp, Homo sapiens
atgcacctcttactgcacac

SEQ ID NO: 68016 - DNA, 21 bp, Homo sapiens
tatgcacctcttactgcacat

SEQ ID NO: 68017 - DNA, 17 bp, Homo sapiens
attccgttcccatccag

SEQ ID NO: 68018 - DNA, 21 bp, Homo sapiens
cagaggtcagcacttacagtt

SEQ ID NO: 68019 - DNA, 21 bp, Homo sapiens
cagaggtcagcacttacagtc

SEQ ID NO: 68020 - DNA, 22 bp, Homo sapiens
caagcaagcatagaccagatat

SEQ ID NO: 68021 - DNA, 24 bp, Homo sapiens
acctaatccctaagaagtacattt

SEQ ID NO: 68022 - DNA, 24 bp, Homo sapiens
acctaatccctaagaagtacattc

SEQ ID NO: 68023 - DNA, 19 bp, Homo sapiens
tggcacagggtgttacttc

SEQ ID NO: 68024 - DNA, 17 bp, Homo sapiens
gccatgcttgccattac

SEQ ID NO: 68025 - DNA, 17 bp, Homo sapiens
gccatgcttgccattat

SEQ ID NO: 68026 - DNA, 15 bp, Homo sapiens
ccccagcccaaggaa

SEQ ID NO: 68027 - DNA, 17 bp, Homo sapiens
gtctgcaacccttgacg

SEQ ID NO: 68028 - DNA, 18 bp, Homo sapiens
agtctgcaacccttgaca

SEQ ID NO: 68029 - DNA, 19 bp, Homo sapiens
tccgaatgcagcaatctac

SEQ ID NO: 68030 - DNA, 21 bp, Homo sapiens
cgagataaaggtcatgtccat

SEQ ID NO: 68031 - DNA, 21 bp, Homo sapiens
cgagataaaggtcatgtccac

SEQ ID NO: 68032 - DNA, 20 bp, Homo sapiens
ccacggtctttctttttcag

SEQ ID NO: 68033 - DNA, 18 bp, Homo sapiens
ggtggtgggactttctgg

SEQ ID NO: 68034 - DNA, 18 bp, Homo sapiens
ggtggtgggactttctga

SEQ ID NO: 68035 - DNA, 19 bp, Homo sapiens
ggatctgggttccatctct

SEQ ID NO: 68036 - DNA, 19 bp, Homo sapiens
tttccaccttctttgatgg

SEQ ID NO: 68037 - DNA, 20 bp, Homo sapiens
ttttccaccttctttgatga

SEQ ID NO: 68038 - DNA, 20 bp, Homo sapiens
ctttccctccacaggataac

SEQ ID NO: 68039 - DNA, 17 bp, Homo sapiens
attgcagatgcgtgtca

SEQ ID NO: 68040 - DNA, 15 bp, Homo sapiens
tgcagatgcgtgtcg

SEQ ID NO: 68041 - DNA, 16 bp, Homo sapiens
ggacgcaggccatctc

SEQ ID NO: 68042 - DNA, 20 bp, Homo sapiens
aagattgaggatgagcaggt

SEQ ID NO: 68043 - DNA, 18 bp, Homo sapiens
gattgaggatgagcaggc

SEQ ID NO: 68044 - DNA, 23 bp, Homo sapiens
cctggagttccagatattgtgta

SEQ ID NO: 68045 - DNA, 20 bp, Homo sapiens
acgcccatgttctacaatta

SEQ ID NO: 68046 - DNA, 19 bp, Homo sapiens
cgcccatgttctacaattc

SEQ ID NO: 68047 - DNA, 19 bp, Homo sapiens
gccagttcccagtcatagg

SEQ ID NO: 68048 - DNA, 20 bp, Homo sapiens
tctttgctgggtaggttttc

SEQ ID NO: 68049 - DNA, 20 bp, Homo sapiens
tctttgctgggtaggttttt

SEQ ID NO: 68050 - DNA, 25 bp, Homo sapiens
ccaagggtatgtgttttaaaattac

SEQ ID NO: 68051 - DNA, 18 bp, Homo sapiens
ccctggattcagaaagca

SEQ ID NO: 68052 - DNA, 17 bp, Homo sapiens
cctggattcagaaagcg

SEQ ID NO: 68053 - DNA, 24 bp, Homo sapiens
gggctctcaacttgagtaatctat

SEQ ID NO: 68054 - DNA, 20 bp, Homo sapiens
tccagagaaggtgtttcatc

SEQ ID NO: 68055 - DNA, 21 bp, Homo sapiens
ctccagagaaggtgtttcatt

SEQ ID NO: 68056 - DNA, 19 bp, Homo sapiens
cctgcaccaaagtctcaag

SEQ ID NO: 68057 - DNA, 21 bp, Homo sapiens
gggctgacatctaaatctgat

SEQ ID NO: 68058 - DNA, 21 bp, Homo sapiens
gggctgacatctaaatctgac

SEQ ID NO: 68059 - DNA, 18 bp, Homo sapiens
tgcaccagcaaagatgat

SEQ ID NO: 68060 - DNA, 15 bp, Homo sapiens
gccctcagaacaggg

SEQ ID NO: 68061 - DNA, 15 bp, Homo sapiens
gccctcagaacagga

SEQ ID NO: 68062 - DNA, 17 bp, Homo sapiens
ccacgtgatggcgtatg

SEQ ID NO: 68063 - DNA, 19 bp, Homo sapiens
tggagtgggaagaagtgaa

SEQ ID NO: 68064 - DNA, 20 bp, Homo sapiens
ttggagtgggaagaagtgat

SEQ ID NO: 68065 - DNA, 23 bp, Homo sapiens
ccttagaaccctgaaggcttata

SEQ ID NO: 68066 - DNA, 15 bp, Homo sapiens
tctcagtgcgcacct

SEQ ID NO: 68067 - DNA, 13 bp, Homo sapiens
tcagtgcgcaccc

SEQ ID NO: 68068 - DNA, 17 bp, Homo sapiens
ggcacttcccccataac

SEQ ID NO: 68069 - DNA, 16 bp, Homo sapiens
cgagccacctctggat

SEQ ID NO: 68070 - DNA, 16 bp, Homo sapiens
cgagccacctctggaa

SEQ ID NO: 68071 - DNA, 16 bp, Homo sapiens
tggatggccgagaatg

SEQ ID NO: 68072 - DNA, 15 bp, Homo sapiens
gactcggcctctgcc

SEQ ID NO: 68073 - DNA, 15 bp, Homo sapiens
gactcggcctctgcg

SEQ ID NO: 68074 - DNA, 22 bp, Homo sapiens
ggaaacgcagtatgtggactat

SEQ ID NO: 68075 - DNA, 18 bp, Homo sapiens
tgcattccaggttgagag

SEQ ID NO: 68076 - DNA, 18 bp, Homo sapiens
tgcattccaggttgagaa

SEQ ID NO: 68077 - DNA, 19 bp, Homo sapiens
cgcacctggagtgatagac

SEQ ID NO: 68078 - DNA, 18 bp, Homo sapiens
tggtgatgaagccctctt

SEQ ID NO: 68079 - DNA, 18 bp, Homo sapiens
tggtgatgaagccctctc

SEQ ID NO: 68080 - DNA, 18 bp, Homo sapiens
cagccctggacagcatta

SEQ ID NO: 68081 - DNA, 18 bp, Homo sapiens
ctggcgtggacatctaca

SEQ ID NO: 68082 - DNA, 17 bp, Homo sapiens
tggcgtggacatctacg

SEQ ID NO: 68083 - DNA, 20 bp, Homo sapiens
ccacgatgatctccaaagtc

SEQ ID NO: 68084 - DNA, 15 bp, Homo sapiens
ccgggaccgcttcac

SEQ ID NO: 68085 - DNA, 15 bp, Homo sapiens
ccgggaccgcttcat

SEQ ID NO: 68086 - DNA, 20 bp, Homo sapiens
cgcgtaccttccaggtagaa

SEQ ID NO: 68087 - DNA, 17 bp, Homo sapiens
cacaatcaccacggtct

SEQ ID NO: 68088 - DNA, 16 bp, Homo sapiens
acaatcaccacggtcc

SEQ ID NO: 68089 - DNA, 20 bp, Homo sapiens
ccttctgcatcagcatcttc

SEQ ID NO: 68090 - DNA, 23 bp, Homo sapiens
ggcacattttgatcataatcata

SEQ ID NO: 68091 - DNA, 22 bp, Homo sapiens
gcacattttgatcataatcatg

SEQ ID NO: 68092 - DNA, 18 bp, Homo sapiens
agccaagccagatttcac

SEQ ID NO: 68093 - DNA, 20 bp, Homo sapiens
acctgccctaatggatgtac

SEQ ID NO: 68094 - DNA, 20 bp, Homo sapiens
acctgccctaatggatgtat

SEQ ID NO: 68095 - DNA, 22 bp, Homo sapiens
acttttcttccgcgaatactat

SEQ ID NO: 68096 - DNA, 19 bp, Homo sapiens
cttctgcagagaatggtga

SEQ ID NO: 68097 - DNA, 18 bp, Homo sapiens
ttctgcagagaatggtgg

SEQ ID NO: 68098 - DNA, 17 bp, Homo sapiens
gggccaaggaaagtgtc

SEQ ID NO: 68099 - DNA, 18 bp, Homo sapiens
cgcccactctcacctctt

SEQ ID NO: 68100 - DNA, 18 bp, Homo sapiens
cgcccactctcacctctc

SEQ ID NO: 68101 - DNA, 19 bp, Homo sapiens
gctctcgcagaacagcact

SEQ ID NO: 68102 - DNA, 19 bp, Homo sapiens
acaagggacatgaagtgaa

SEQ ID NO: 68103 - DNA, 19 bp, Homo sapiens
acaagggacatgaagtgac

SEQ ID NO: 68104 - DNA, 20 bp, Homo sapiens
gttagggctccaacgaaata

SEQ ID NO: 68105 - DNA, 17 bp, Homo sapiens
ggccaagatgatgtcca

SEQ ID NO: 68106 - DNA, 18 bp, Homo sapiens
aggccaagatgatgtcct

SEQ ID NO: 68107 - DNA, 21 bp, Homo sapiens
tcctgtccgtctctcagaata

SEQ ID NO: 68108 - DNA, 15 bp, Homo sapiens
tggcacacagtaggc

SEQ ID NO: 68109 - DNA, 16 bp, Homo sapiens
gtggcacacagtaggt

SEQ ID NO: 68110 - DNA, 24 bp, Homo sapiens
tctggagtctctacagtctcacat

SEQ ID NO: 68111 - DNA, 17 bp, Homo sapiens
ggccatggtctctgaca

SEQ ID NO: 68112 - DNA, 17 bp, Homo sapiens
ggccatggtctctgacg

SEQ ID NO: 68113 - DNA, 23 bp, Homo sapiens
cccaggattgtatttcctcttaa

SEQ ID NO: 68114 - DNA, 21 bp, Homo sapiens
gttgaaaatgtgaatcagcac

SEQ ID NO: 68115 - DNA, 21 bp, Homo sapiens
gttgaaaatgtgaatcagcag

SEQ ID NO: 68116 - DNA, 19 bp, Homo sapiens
tgcagagcttccaagtttt

SEQ ID NO: 68117 - DNA, 17 bp, Homo sapiens
ccacctcttgcatcgtc

SEQ ID NO: 68118 - DNA, 17 bp, Homo sapiens
ccacctcttgcatcgtt

SEQ ID NO: 68119 - DNA, 17 bp, Homo sapiens
gtggcccccattctatg

SEQ ID NO: 68120 - DNA, 18 bp, Homo sapiens
ctgtttctccccacagaa

SEQ ID NO: 68121 - DNA, 18 bp, Homo sapiens
ctgtttctccccacagag

SEQ ID NO: 68122 - DNA, 20 bp, Homo sapiens
actaaaccggcatcagattt

SEQ ID NO: 68123 - DNA, 16 bp, Homo sapiens
gctatggccatcggaa

SEQ ID NO: 68124 - DNA, 16 bp, Homo sapiens
gctatggccatcggag

SEQ ID NO: 68125 - DNA, 20 bp, Homo sapiens
cttgactgcggctgtctata

SEQ ID NO: 68126 - DNA, 17 bp, Homo sapiens
tgcaggggactggagtc

SEQ ID NO: 68127 - DNA, 17 bp, Homo sapiens
tgcaggggactggagtt

SEQ ID NO: 68128 - DNA, 18 bp, Homo sapiens
cccttgcagggcttctac

SEQ ID NO: 68129 - DNA, 21 bp, Homo sapiens
tttcaagctgtctcctaccat

SEQ ID NO: 68130 - DNA, 21 bp, Homo sapiens
tttcaagctgtctcctaccac

SEQ ID NO: 68131 - DNA, 22 bp, Homo sapiens
ggagagaagggaaggactaaag

SEQ ID NO: 68132 - DNA, 18 bp, Homo sapiens
ggggacctggatcatcac

SEQ ID NO: 68133 - DNA, 18 bp, Homo sapiens
ggggacctggatcatcat

SEQ ID NO: 68134 - DNA, 19 bp, Homo sapiens
gggaagaagggcgtctaag

SEQ ID NO: 68135 - DNA, 14 bp, Homo sapiens
cggcctcccattcc

SEQ ID NO: 68136 - DNA, 15 bp, Homo sapiens
gcggcctcccattct

SEQ ID NO: 68137 - DNA, 22 bp, Homo sapiens
ttaacagcagcacataattcaa

SEQ ID NO: 68138 - DNA, 20 bp, Homo sapiens
atcttcctcttggagctgtc

SEQ ID NO: 68139 - DNA, 20 bp, Homo sapiens
atcttcctcttggagctgtt

SEQ ID NO: 68140 - DNA, 16 bp, Homo sapiens
aaggcggcaaattgtg

SEQ ID NO: 68141 - DNA, 16 bp, Homo sapiens
ttccaccagggaacca

SEQ ID NO: 68142 - DNA, 15 bp, Homo sapiens
tccaccagggaaccg

SEQ ID NO: 68143 - DNA, 19 bp, Homo sapiens
gacccttggatgcactctt

SEQ ID NO: 68144 - DNA, 24 bp, Homo sapiens
tatcacagtttgaatataagctgg

SEQ ID NO: 68145 - DNA, 25 bp, Homo sapiens
ctatcacagtttgaatataagctga

SEQ ID NO: 68146 - DNA, 20 bp, Homo sapiens
aggcatcatggaaggaacta

SEQ ID NO: 68147 - DNA, 21 bp, Homo sapiens
aagataagcctgtcactggtc

SEQ ID NO: 68148 - DNA, 21 bp, Homo sapiens
aagataagcctgtcactggtt

SEQ ID NO: 68149 - DNA, 22 bp, Homo sapiens
caagccagcctaataaacataa

SEQ ID NO: 68150 - DNA, 23 bp, Homo sapiens
ggaggctgaactatattacactg

SEQ ID NO: 68151 - DNA, 24 bp, Homo sapiens
aggaggctgaactatattacactc

SEQ ID NO: 68152 - DNA, 20 bp, Homo sapiens
ggtcagaaagggtgcataga

SEQ ID NO: 68153 - DNA, 18 bp, Homo sapiens
ggatagcagctgcaggta

SEQ ID NO: 68154 - DNA, 17 bp, Homo sapiens
gatagcagctgcaggtg

SEQ ID NO: 68155 - DNA, 23 bp, Homo sapiens
agcaccttaccaggtatcactat

SEQ ID NO: 68156 - DNA, 16 bp, Homo sapiens
ttggcgtgacaacagc

SEQ ID NO: 68157 - DNA, 20 bp, Homo sapiens
attattggcgtgacaacagt

SEQ ID NO: 68158 - DNA, 21 bp, Homo sapiens
cgtggtcaccgtcttctatac

SEQ ID NO: 68159 - DNA, 21 bp, Homo sapiens
ctatttgcttttgaccaaaac

SEQ ID NO: 68160 - DNA, 22 bp, Homo sapiens
tctatttgcttttgaccaaaat

SEQ ID NO: 68161 - DNA, 27 bp, Homo sapiens
tttaaacaactcgtctgttaagatatt

SEQ ID NO: 68162 - DNA, 19 bp, Homo sapiens
gtggacagggcttaaaaaa

SEQ ID NO: 68163 - DNA, 19 bp, Homo sapiens
gtggacagggcttaaaaag

SEQ ID NO: 68164 - DNA, 18 bp, Homo sapiens
tggtttgcgaggtacaca

SEQ ID NO: 68165 - DNA, 27 bp, Homo sapiens
catatttacttaaagctccactcttta

SEQ ID NO: 68166 - DNA, 26 bp, Homo sapiens
atatttacttaaagctccactctttt

SEQ ID NO: 68167 - DNA, 25 bp, Homo sapiens
ttgcttacccagtacatattaaatc

SEQ ID NO: 68168 - DNA, 22 bp, Homo sapiens
ataaaggttcatttggacaaag

SEQ ID NO: 68169 - DNA, 22 bp, Homo sapiens
ataaaggttcatttggacaaaa

SEQ ID NO: 68170 - DNA, 23 bp, Homo sapiens
aactctgggaattcacaattaac

SEQ ID NO: 68171 - DNA, 17 bp, Homo sapiens
gacccagctcaccaacc

SEQ ID NO: 68172 - DNA, 17 bp, Homo sapiens
gacccagctcaccaaca

SEQ ID NO: 68173 - DNA, 17 bp, Homo sapiens
cttcctgccccaagaga

SEQ ID NO: 68174 - DNA, 23 bp, Homo sapiens
caatccatatgtttcagactcac

SEQ ID NO: 68175 - DNA, 23 bp, Homo sapiens
caatccatatgtttcagactcag

SEQ ID NO: 68176 - DNA, 24 bp, Homo sapiens
agcttgacaaatcaactttatgtt

SEQ ID NO: 68177 - DNA, 19 bp, Homo sapiens
tcattctgtgggaatgtga

SEQ ID NO: 68178 - DNA, 18 bp, Homo sapiens
cattctgtgggaatgtgg

SEQ ID NO: 68179 - DNA, 22 bp, Homo sapiens
gactcaccgaggtactgtatga

SEQ ID NO: 68180 - DNA, 13 bp, Homo sapiens
tgccatcctcgcg

SEQ ID NO: 68181 - DNA, 15 bp, Homo sapiens
attgccatcctcgca

SEQ ID NO: 68182 - DNA, 23 bp, Homo sapiens
tctgttggctcagacattctata

SEQ ID NO: 68183 - DNA, 16 bp, Homo sapiens
ctgctgccactggaga

SEQ ID NO: 68184 - DNA, 15 bp, Homo sapiens
tgctgccactggagc

SEQ ID NO: 68185 - DNA, 20 bp, Homo sapiens
cagcgcaatggtaggtaagt

SEQ ID NO: 68186 - DNA, 16 bp, Homo sapiens
ttgcgcaaactgactg

SEQ ID NO: 68187 - DNA, 17 bp, Homo sapiens
gttgcgcaaactgacta

SEQ ID NO: 68188 - DNA, 20 bp, Homo sapiens
ggaggcactgaacaagattc

SEQ ID NO: 68189 - DNA, 19 bp, Homo sapiens
gaactttttccagcaccac

SEQ ID NO: 68190 - DNA, 19 bp, Homo sapiens
gaactttttccagcaccat

SEQ ID NO: 68191 - DNA, 19 bp, Homo sapiens
tgaagggtgcagaaatctc

SEQ ID NO: 68192 - DNA, 21 bp, Homo sapiens
tgaggccaatcagagtgatat

SEQ ID NO: 68193 - DNA, 21 bp, Homo sapiens
tgaggccaatcagagtgatac

SEQ ID NO: 68194 - DNA, 23 bp, Homo sapiens
ttgtctttgccatctaaagttct

SEQ ID NO: 68195 - DNA, 22 bp, Homo sapiens
aaacacaagatcctgatgaagt

SEQ ID NO: 68196 - DNA, 20 bp, Homo sapiens
acacaagatcctgatgaagc

SEQ ID NO: 68197 - DNA, 24 bp, Homo sapiens
tggagaggaggagtaagaagtatc

SEQ ID NO: 68198 - DNA, 25 bp, Homo sapiens
ttattctgaattttagcatctgtta

SEQ ID NO: 68199 - DNA, 24 bp, Homo sapiens
tattctgaattttagcatctgttg

SEQ ID NO: 68200 - DNA, 22 bp, Homo sapiens
tcaggatgtttgtgtttgtctt

SEQ ID NO: 68201 - DNA, 25 bp, Homo sapiens
gggaagttctttcttgtatattcaa

SEQ ID NO: 68202 - DNA, 25 bp, Homo sapiens
gggaagttctttcttgtatattcag

SEQ ID NO: 68203 - DNA, 21 bp, Homo sapiens
tgctgtctttgcctcactaat

SEQ ID NO: 68204 - DNA, 24 bp, Homo sapiens
aagtccatagttacagaccttacg

SEQ ID NO: 68205 - DNA, 26 bp, Homo sapiens
gtaagtccatagttacagaccttaca

SEQ ID NO: 68206 - DNA, 21 bp, Homo sapiens
cctgaaaaccaagtcctgtag

SEQ ID NO: 68207 - DNA, 26 bp, Homo sapiens
gaaataaactttacttacttcaaacg

SEQ ID NO: 68208 - DNA, 27 bp, Homo sapiens
tgaaataaactttacttacttcaaaca

SEQ ID NO: 68209 - DNA, 24 bp, Homo sapiens
tattcaagcacttcaaaagacata

SEQ ID NO: 68210 - DNA, 19 bp, Homo sapiens
tacccttggtggtgatcat

SEQ ID NO: 68211 - DNA, 17 bp, Homo sapiens
cccttggtggtgatcag

SEQ ID NO: 68212 - DNA, 23 bp, Homo sapiens
ttcctatccattgtcctgtctat

SEQ ID NO: 68213 - DNA, 18 bp, Homo sapiens
cacgacgatcccttctga

SEQ ID NO: 68214 - DNA, 18 bp, Homo sapiens
cacgacgatcccttctgt

SEQ ID NO: 68215 - DNA, 15 bp, Homo sapiens
gggcgcagctgtctg

SEQ ID NO: 68216 - DNA, 20 bp, Homo sapiens
ttgtcagccagaacactgat

SEQ ID NO: 68217 - DNA, 20 bp, Homo sapiens
ttgtcagccagaacactgag

SEQ ID NO: 68218 - DNA, 22 bp, Homo sapiens
gctcactgtgcagaagtgatta

SEQ ID NO: 68219 - DNA, 17 bp, Homo sapiens
gaccctctggcaacatg

SEQ ID NO: 68220 - DNA, 18 bp, Homo sapiens
tgaccctctggcaacata

SEQ ID NO: 68221 - DNA, 25 bp, Homo sapiens
gaggcctaagaaaaaagtgtattat

SEQ ID NO: 68222 - DNA, 21 bp, Homo sapiens
gaatctcatgttcaggaaatg

SEQ ID NO: 68223 - DNA, 22 bp, Homo sapiens
cgaatctcatgttcaggaaata

SEQ ID NO: 68224 - DNA, 17 bp, Homo sapiens
gccatggcccataaaac

SEQ ID NO: 68225 - DNA, 17 bp, Homo sapiens
caagtgctggtggcata

SEQ ID NO: 68226 - DNA, 17 bp, Homo sapiens
caagtgctggtggcatt

SEQ ID NO: 68227 - DNA, 19 bp, Homo sapiens
gcgcaggtcttcttgaata

SEQ ID NO: 68228 - DNA, 19 bp, Homo sapiens
cagtgacagggatggagtg

SEQ ID NO: 68229 - DNA, 20 bp, Homo sapiens
ccagtgacagggatggagta

SEQ ID NO: 68230 - DNA, 23 bp, Homo sapiens
tgagtttgatgacagtgatgatg

SEQ ID NO: 68231 - DNA, 17 bp, Homo sapiens
gtccttccaagcagcaa

SEQ ID NO: 68232 - DNA, 17 bp, Homo sapiens
gtccttccaagcagcac

SEQ ID NO: 68233 - DNA, 16 bp, Homo sapiens
gggtgcggtcattgaa

SEQ ID NO: 68234 - DNA, 23 bp, Homo sapiens
atgtcctgaaatacacgtatgac

SEQ ID NO: 68235 - DNA, 23 bp, Homo sapiens
atgtcctgaaatacacgtatgag

SEQ ID NO: 68236 - DNA, 21 bp, Homo sapiens
tcccaacgtcaatttcatatt

SEQ ID NO: 68237 - DNA, 17 bp, Homo sapiens
cccaaaaagccagaaga

SEQ ID NO: 68238 - DNA, 17 bp, Homo sapiens
cccaaaaagccagaagc

SEQ ID NO: 68239 - DNA, 15 bp, Homo sapiens
gccccagccctaaca

SEQ ID NO: 68240 - DNA, 23 bp, Homo sapiens
aatatcattcaccctaaacttgg

SEQ ID NO: 68241 - DNA, 24 bp, Homo sapiens
aaatatcattcaccctaaacttga

SEQ ID NO: 68242 - DNA, 21 bp, Homo sapiens
ctcatttgcgcaataatacac

SEQ ID NO: 68243 - DNA, 21 bp, Homo sapiens
gttgctatagtgacgatccac

SEQ ID NO: 68244 - DNA, 21 bp, Homo sapiens
gttgctatagtgacgatccag

SEQ ID NO: 68245 - DNA, 20 bp, Homo sapiens
tagctttctggctgctacag

SEQ ID NO: 68246 - DNA, 21 bp, Homo sapiens
ggtgtacagtaagcattcacg

SEQ ID NO: 68247 - DNA, 22 bp, Homo sapiens
aggtgtacagtaagcattcaca

SEQ ID NO: 68248 - DNA, 23 bp, Homo sapiens
tccagtatgaattctctgatgag

SEQ ID NO: 68249 - DNA, 15 bp, Homo sapiens
ggaggccggctctga

SEQ ID NO: 68250 - DNA, 14 bp, Homo sapiens
gaggccggctctgg

SEQ ID NO: 68251 - DNA, 19 bp, Homo sapiens
tcctgtgggtcatctttga

SEQ ID NO: 68252 - DNA, 16 bp, Homo sapiens
ctctggttgcggctgt

SEQ ID NO: 68253 - DNA, 14 bp, Homo sapiens
ctggttgcggctgg

SEQ ID NO: 68254 - DNA, 19 bp, Homo sapiens
acctgggatgctgagaact

SEQ ID NO: 68255 - DNA, 15 bp, Homo sapiens
aggagctgctggacg

SEQ ID NO: 68256 - DNA, 16 bp, Homo sapiens
caggagctgctggaca

SEQ ID NO: 68257 - DNA, 22 bp, Homo sapiens
gggaaggatgatgaacagtaat

SEQ ID NO: 68258 - DNA, 24 bp, Homo sapiens
tgtctttttctgtagaagagacct

SEQ ID NO: 68259 - DNA, 22 bp, Homo sapiens
tctttttctgtagaagagaccg

SEQ ID NO: 68260 - DNA, 24 bp, Homo sapiens
cctttttcttggttctttgtattc

SEQ ID NO: 68261 - DNA, 17 bp, Homo sapiens
gggacaccagagcctga

SEQ ID NO: 68262 - DNA, 16 bp, Homo sapiens
ggacaccagagcctgc

SEQ ID NO: 68263 - DNA, 24 bp, Homo sapiens
gacccatacattcattcttgacta

SEQ ID NO: 68264 - DNA, 13 bp, Homo sapiens
gccgcgcctgttc

SEQ ID NO: 68265 - DNA, 13 bp, Homo sapiens
gccgcgcctgttg

SEQ ID NO: 68266 - DNA, 18 bp, Homo sapiens
tggcgggttgtcattaac

SEQ ID NO: 68267 - DNA, 17 bp, Homo sapiens
ccaggagcgtggtgact

SEQ ID NO: 68268 - DNA, 16 bp, Homo sapiens
caggagcgtggtgaca

SEQ ID NO: 68269 - DNA, 21 bp, Homo sapiens
cctctagggcacactctctct

SEQ ID NO: 68270 - DNA, 19 bp, Homo sapiens
aagagaggtcacacacacg

SEQ ID NO: 68271 - DNA, 20 bp, Homo sapiens
gaagagaggtcacacacact

SEQ ID NO: 68272 - DNA, 15 bp, Homo sapiens
gcgcagggcaaattg

SEQ ID NO: 68273 - DNA, 18 bp, Homo sapiens
cttttcctgaccactggg

SEQ ID NO: 68274 - DNA, 19 bp, Homo sapiens
acttttcctgaccactgga

SEQ ID NO: 68275 - DNA, 21 bp, Homo sapiens
agatcggagaaaaaccacttt

SEQ ID NO: 68276 - DNA, 16 bp, Homo sapiens
ccagcaactgaacggg

SEQ ID NO: 68277 - DNA, 16 bp, Homo sapiens
ccagcaactgaacggc

SEQ ID NO: 68278 - DNA, 22 bp, Homo sapiens
gaagttcaggcagttttcaagt

SEQ ID NO: 68279 - DNA, 24 bp, Homo sapiens
agataatcataagctggagaacac

SEQ ID NO: 68280 - DNA, 24 bp, Homo sapiens
agataatcataagctggagaacat

SEQ ID NO: 68281 - DNA, 25 bp, Homo sapiens
tgattatgcatcttctgtcttgtag

SEQ ID NO: 68282 - DNA, 22 bp, Homo sapiens
tttcaggcttctgtagattctg

SEQ ID NO: 68283 - DNA, 23 bp, Homo sapiens
ctttcaggcttctgtagattctt

SEQ ID NO: 68284 - DNA, 25 bp, Homo sapiens
cactattgcctttattttgtttaca

SEQ ID NO: 68285 - DNA, 17 bp, Homo sapiens
ccattggctcgcataag

SEQ ID NO: 68286 - DNA, 17 bp, Homo sapiens
ccattggctcgcataaa

SEQ ID NO: 68287 - DNA, 19 bp, Homo sapiens
tggctgcaccaattctaga

SEQ ID NO: 68288 - DNA, 19 bp, Homo sapiens
ccgtgtggtatgacatcat

SEQ ID NO: 68289 - DNA, 19 bp, Homo sapiens
ccgtgtggtatgacatcac

SEQ ID NO: 68290 - DNA, 20 bp, Homo sapiens
tgtctgcaggtcacactcat

SEQ ID NO: 68291 - DNA, 20 bp, Homo sapiens
gttggtggtgactgacagtt

SEQ ID NO: 68292 - DNA, 20 bp, Homo sapiens
gttggtggtgactgacagtc

SEQ ID NO: 68293 - DNA, 22 bp, Homo sapiens
ctgagtagcgagggtctagagt

SEQ ID NO: 68294 - DNA, 25 bp, Homo sapiens
gctatacttttaagcccaagtaaac

SEQ ID NO: 68295 - DNA, 25 bp, Homo sapiens
gctatacttttaagcccaagtaaat

SEQ ID NO: 68296 - DNA, 23 bp, Homo sapiens
tgccagagaaacttttcattatc

SEQ ID NO: 68297 - DNA, 24 bp, Homo sapiens
aaaatcaagagaactgaaaacatc

SEQ ID NO: 68298 - DNA, 24 bp, Homo sapiens
aaaatcaagagaactgaaaacatt

SEQ ID NO: 68299 - DNA, 21 bp, Homo sapiens
ggatgaggaaagcatgtattc

SEQ ID NO: 68300 - DNA, 15 bp, Homo sapiens
tgtgaaggcacacca

SEQ ID NO: 68301 - DNA, 14 bp, Homo sapiens
gtgaaggcacaccg

SEQ ID NO: 68302 - DNA, 19 bp, Homo sapiens
ggaacagggaatccatgat

SEQ ID NO: 68303 - DNA, 21 bp, Homo sapiens
tctcatccacaaagaaacttg

SEQ ID NO: 68304 - DNA, 22 bp, Homo sapiens
ctctcatccacaaagaaacttt

SEQ ID NO: 68305 - DNA, 20 bp, Homo sapiens
cccagagttgctctcttgaa

SEQ ID NO: 68306 - DNA, 17 bp, Homo sapiens
cagctggacgacgaaca

SEQ ID NO: 68307 - DNA, 16 bp, Homo sapiens
agctggacgacgaacg

SEQ ID NO: 68308 - DNA, 17 bp, Homo sapiens
ccggctctccttgatga

SEQ ID NO: 68309 - DNA, 17 bp, Homo sapiens
cagggtcaacctgccta

SEQ ID NO: 68310 - DNA, 16 bp, Homo sapiens
agggtcaacctgcctg

SEQ ID NO: 68311 - DNA, 21 bp, Homo sapiens
ggaaaccaaagcagacactat

SEQ ID NO: 68312 - DNA, 22 bp, Homo sapiens
caagaaacagtgagtgaacaaa

SEQ ID NO: 68313 - DNA, 22 bp, Homo sapiens
caagaaacagtgagtgaacaag

SEQ ID NO: 68314 - DNA, 23 bp, Homo sapiens
ataccctttgaacatccatagtc

SEQ ID NO: 68315 - DNA, 14 bp, Homo sapiens
ctccgccatggctg

SEQ ID NO: 68316 - DNA, 14 bp, Homo sapiens
ctccgccatggctt

SEQ ID NO: 68317 - DNA, 20 bp, Homo sapiens
tccttgcacggtaggtagtt

SEQ ID NO: 68318 - DNA, 17 bp, Homo sapiens
cacctcctcatcccaca

SEQ ID NO: 68319 - DNA, 16 bp, Homo sapiens
acctcctcatcccacg

SEQ ID NO: 68320 - DNA, 16 bp, Homo sapiens
cctccccctccacaag

SEQ ID NO: 68321 - DNA, 14 bp, Homo sapiens
ggcagcgccgtcat

SEQ ID NO: 68322 - DNA, 14 bp, Homo sapiens
ggcagcgccgtcac

SEQ ID NO: 68323 - DNA, 18 bp, Homo sapiens
ggcaagaggcagctctag

SEQ ID NO: 68324 - DNA, 20 bp, Homo sapiens
tctcaggtgagagaccatca

SEQ ID NO: 68325 - DNA, 19 bp, Homo sapiens
ctcaggtgagagaccatcg

SEQ ID NO: 68326 - DNA, 25 bp, Homo sapiens
cctttagctccattttcttgataat

SEQ ID NO: 68327 - DNA, 18 bp, Homo sapiens
ttggagtaggtgttctcg

SEQ ID NO: 68328 - DNA, 18 bp, Homo sapiens
ttggagtaggtgttctca

SEQ ID NO: 68329 - DNA, 21 bp, Homo sapiens
caggaaaagcttttgacatca

SEQ ID NO: 68330 - DNA, 22 bp, Homo sapiens
tttggctctgtagaactttcat

SEQ ID NO: 68331 - DNA, 22 bp, Homo sapiens
tttggctctgtagaactttcac

SEQ ID NO: 68332 - DNA, 20 bp, Homo sapiens
agccgtcagggatgtactat

SEQ ID NO: 68333 - DNA, 20 bp, Homo sapiens
caattactactcactggacg

SEQ ID NO: 68334 - DNA, 22 bp, Homo sapiens
ttcaattactactcactggaca

SEQ ID NO: 68335 - DNA, 16 bp, Homo sapiens
cccaccaccctcacct

SEQ ID NO: 68336 - DNA, 18 bp, Homo sapiens
cgtctatccagctgtctc

SEQ ID NO: 68337 - DNA, 18 bp, Homo sapiens
cgtctatccagctgtctt

SEQ ID NO: 68338 - DNA, 25 bp, Homo sapiens
gcacagagaaagagagagagaacta

SEQ ID NO: 68339 - DNA, 27 bp, Homo sapiens
cctagtatgtcaggagtattttaaatt

SEQ ID NO: 68340 - DNA, 27 bp, Homo sapiens
cctagtatgtcaggagtattttaaatc

SEQ ID NO: 68341 - DNA, 21 bp, Homo sapiens
gagccatgaccaagaagtaaa

SEQ ID NO: 68342 - DNA, 17 bp, Homo sapiens
ccttctccggggaactc

SEQ ID NO: 68343 - DNA, 17 bp, Homo sapiens
ccttctccggggaacta

SEQ ID NO: 68344 - DNA, 15 bp, Homo sapiens
gcgcagcgaaccatc

SEQ ID NO: 68345 - DNA, 16 bp, Homo sapiens
gctctgcccatggacg

SEQ ID NO: 68346 - DNA, 16 bp, Homo sapiens
gctctgcccatggacc

SEQ ID NO: 68347 - DNA, 16 bp, Homo sapiens
cgctgagcgaggagat

SEQ ID NO: 68348 - DNA, 15 bp, Homo sapiens
ccaccatgccctcca

SEQ ID NO: 68349 - DNA, 14 bp, Homo sapiens
caccatgccctccg

SEQ ID NO: 68350 - DNA, 21 bp, Homo sapiens
tggagtcagagacacagacaa

SEQ ID NO: 68351 - DNA, 16 bp, Homo sapiens
cggcttcaagctgggt

SEQ ID NO: 68352 - DNA, 15 bp, Homo sapiens
ggcttcaagctgggc

SEQ ID NO: 68353 - DNA, 20 bp, Homo sapiens
gggtcccacgtttattctac

SEQ ID NO: 68354 - DNA, 18 bp, Homo sapiens
catcagcctctagcttgc

SEQ ID NO: 68355 - DNA, 18 bp, Homo sapiens
catcagcctctagcttgg

SEQ ID NO: 68356 - DNA, 18 bp, Homo sapiens
catcccggccttctactt

SEQ ID NO: 68357 - DNA, 23 bp, Homo sapiens
atgcagcttagtacttcattagg

SEQ ID NO: 68358 - DNA, 24 bp, Homo sapiens
aatgcagcttagtacttcattaga

SEQ ID NO: 68359 - DNA, 21 bp, Homo sapiens
gatgtcccaggaaacagaata

SEQ ID NO: 68360 - DNA, 19 bp, Homo sapiens
aagtccatcacatctcccc

SEQ ID NO: 68361 - DNA, 20 bp, Homo sapiens
gaagtccatcacatctccct

SEQ ID NO: 68362 - DNA, 23 bp, Homo sapiens
ccgtttttgttttttgttttgta

SEQ ID NO: 68363 - DNA, 24 bp, Homo sapiens
ccctaagtatcgtacccataatct

SEQ ID NO: 68364 - DNA, 23 bp, Homo sapiens
cctaagtatcgtacccataatcc

SEQ ID NO: 68365 - DNA, 18 bp, Homo sapiens
ggcatcccagaacatcaa

SEQ ID NO: 68366 - DNA, 17 bp, Homo sapiens
gggaaccagggtaaggg

SEQ ID NO: 68367 - DNA, 17 bp, Homo sapiens
gggaaccagggtaagga

SEQ ID NO: 68368 - DNA, 17 bp, Homo sapiens
cgaggagcgcccatata

SEQ ID NO: 68369 - DNA, 21 bp, Homo sapiens
actgtgaccagcatagaaaga

SEQ ID NO: 68370 - DNA, 20 bp, Homo sapiens
ctgtgaccagcatagaaagg

SEQ ID NO: 68371 - DNA, 18 bp, Homo sapiens
catcgtccccacctacac

SEQ ID NO: 68372 - DNA, 22 bp, Homo sapiens
gcaactaaggtgccagctatac

SEQ ID NO: 68373 - DNA, 22 bp, Homo sapiens
gcaactaaggtgccagctatat

SEQ ID NO: 68374 - DNA, 17 bp, Homo sapiens
cccaaagccccaaattc

SEQ ID NO: 68375 - DNA, 19 bp, Homo sapiens
cctttccctttcttgggta

SEQ ID NO: 68376 - DNA, 18 bp, Homo sapiens
ctttccctttcttgggtg

SEQ ID NO: 68377 - DNA, 24 bp, Homo sapiens
cccaactaggaagtcaggtaagta

SEQ ID NO: 68378 - DNA, 16 bp, Homo sapiens
gaacacgctggagcca

SEQ ID NO: 68379 - DNA, 15 bp, Homo sapiens
aacacgctggagccg

SEQ ID NO: 68380 - DNA, 21 bp, Homo sapiens
caagcagaaagctgtcaaaga

SEQ ID NO: 68381 - DNA, 18 bp, Homo sapiens
gaagtccagcacatttgg

SEQ ID NO: 68382 - DNA, 19 bp, Homo sapiens
ggaagtccagcacatttga

SEQ ID NO: 68383 - DNA, 25 bp, Homo sapiens
ttcagtatggagatcatcttttaca

SEQ ID NO: 68384 - DNA, 16 bp, Homo sapiens
cattccttgggctcca

SEQ ID NO: 68385 - DNA, 15 bp, Homo sapiens
attccttgggctccg

SEQ ID NO: 68386 - DNA, 25 bp, Homo sapiens
aatgaacaacattctcttcattaag

SEQ ID NO: 68387 - DNA, 22 bp, Homo sapiens
gctacatctcactgcctcttag

SEQ ID NO: 68388 - DNA, 22 bp, Homo sapiens
gctacatctcactgcctcttac

SEQ ID NO: 68389 - DNA, 22 bp, Homo sapiens
ctttcccgataacccatactac

SEQ ID NO: 68390 - DNA, 17 bp, Homo sapiens
gcccttccttcctcatc

SEQ ID NO: 68391 - DNA, 17 bp, Homo sapiens
gcccttccttcctcatt

SEQ ID NO: 68392 - DNA, 22 bp, Homo sapiens
aggctctccattttctttgtag

SEQ ID NO: 68393 - DNA, 19 bp, Homo sapiens
ctcacacacctagctctgg

SEQ ID NO: 68394 - DNA, 20 bp, Homo sapiens
gctcacacacctagctctgt

SEQ ID NO: 68395 - DNA, 22 bp, Homo sapiens
cacatctgtggacgagaactat

SEQ ID NO: 68396 - DNA, 17 bp, Homo sapiens
cacacacctagctctgg

SEQ ID NO: 68397 - DNA, 19 bp, Homo sapiens
ctcacacacctagctctgt

SEQ ID NO: 68398 - DNA, 19 bp, Homo sapiens
tctgtggacgagaactatg

SEQ ID NO: 68399 - DNA, 18 bp, Homo sapiens
ccacctcatggtcttcct

SEQ ID NO: 68400 - DNA, 17 bp, Homo sapiens
cacctcatggtcttccc

SEQ ID NO: 68401 - DNA, 24 bp, Homo sapiens
aagaatggagcaagtacagtaaac

SEQ ID NO: 68402 - DNA, 15 bp, Homo sapiens
gccttggggcacatg

SEQ ID NO: 68403 - DNA, 15 bp, Homo sapiens
gccttggggcacatc

SEQ ID NO: 68404 - DNA, 24 bp, Homo sapiens
ggaatttatggcagttttaaacat

SEQ ID NO: 68405 - DNA, 19 bp, Homo sapiens
tcctaggacctcggaaagt

SEQ ID NO: 68406 - DNA, 18 bp, Homo sapiens
cctaggacctcggaaagc

SEQ ID NO: 68407 - DNA, 17 bp, Homo sapiens
tccccagcattgtcaca

SEQ ID NO: 68408 - DNA, 20 bp, Homo sapiens
ccttgatggtaccaggaaac

SEQ ID NO: 68409 - DNA, 20 bp, Homo sapiens
ccttgatggtaccaggaaat

SEQ ID NO: 68410 - DNA, 24 bp, Homo sapiens
catacctgctgttgacgtaatatc

SEQ ID NO: 68411 - DNA, 17 bp, Homo sapiens
gccccaacaccagagaa

SEQ ID NO: 68412 - DNA, 17 bp, Homo sapiens
gccccaacaccagagac

SEQ ID NO: 68413 - DNA, 18 bp, Homo sapiens
ccaccaccactcaccaga

SEQ ID NO: 68414 - DNA, 22 bp, Homo sapiens
atgtgaatctgtgctttaggat

SEQ ID NO: 68415 - DNA, 21 bp, Homo sapiens
tgtgaatctgtgctttaggaa

SEQ ID NO: 68416 - DNA, 20 bp, Homo sapiens
ctgagcagccacaaataaag

SEQ ID NO: 68417 - DNA, 17 bp, Homo sapiens
gggctccttcagaatga

SEQ ID NO: 68418 - DNA, 17 bp, Homo sapiens
gggctccttcagaatgg

SEQ ID NO: 68419 - DNA, 22 bp, Homo sapiens
tgatcgtctgactggtgttatc

SEQ ID NO: 68420 - DNA, 25 bp, Homo sapiens
aagatatcaatgtttctgtctgttc

SEQ ID NO: 68421 - DNA, 25 bp, Homo sapiens
aagatatcaatgtttctgtctgttt

SEQ ID NO: 68422 - DNA, 21 bp, Homo sapiens
atcactggttccttcaactgt

SEQ ID NO: 68423 - DNA, 20 bp, Homo sapiens
gtggttttcagattccacac

SEQ ID NO: 68424 - DNA, 20 bp, Homo sapiens
gtggttttcagattccacat

SEQ ID NO: 68425 - DNA, 20 bp, Homo sapiens
gtgcggcaataaattcagta

SEQ ID NO: 68426 - DNA, 18 bp, Homo sapiens
ttcacctcactgtgcagg

SEQ ID NO: 68427 - DNA, 18 bp, Homo sapiens
ttcacctcactgtgcagc

SEQ ID NO: 68428 - DNA, 21 bp, Homo sapiens
gcaaaggatgacaagaaagtc

SEQ ID NO: 68429 - DNA, 17 bp, Homo sapiens
aactgtcattctgccac

SEQ ID NO: 68430 - DNA, 17 bp, Homo sapiens
aactgtcattctgccat

SEQ ID NO: 68431 - DNA, 18 bp, Homo sapiens
gggtccaccaggatgact

SEQ ID NO: 68432 - DNA, 15 bp, Homo sapiens
ggccacctcaggagg

SEQ ID NO: 68433 - DNA, 15 bp, Homo sapiens
ggccacctcaggagc

SEQ ID NO: 68434 - DNA, 27 bp, Homo sapiens
tgtagaacagcatagagagatgtaagt

SEQ ID NO: 68435 - DNA, 16 bp, Homo sapiens
ttcggggatgtccaac

SEQ ID NO: 68436 - DNA, 16 bp, Homo sapiens
ttcggggatgtccaaa

SEQ ID NO: 68437 - DNA, 18 bp, Homo sapiens
catgaatgcagccatcaa

SEQ ID NO: 68438 - DNA, 13 bp, Homo sapiens
cgtgacccccgcc

SEQ ID NO: 68439 - DNA, 13 bp, Homo sapiens
cgtgacccccgcg

SEQ ID NO: 68440 - DNA, 19 bp, Homo sapiens
gggctctggtctttgattg

SEQ ID NO: 68441 - DNA, 21 bp, Homo sapiens
cctggagaacacatccattaa

SEQ ID NO: 68442 - DNA, 21 bp, Homo sapiens
cctggagaacacatccattag

SEQ ID NO: 68443 - DNA, 18 bp, Homo sapiens
gcctggctcacctttctt

SEQ ID NO: 68444 - DNA, 26 bp, Homo sapiens
tgtcaacatttaaatatcaagatttc

SEQ ID NO: 68445 - DNA, 27 bp, Homo sapiens
ctgtcaacatttaaatatcaagatttt

SEQ ID NO: 68446 - DNA, 22 bp, Homo sapiens
ggtttcactgtgtttcgatctc

SEQ ID NO: 68447 - DNA, 19 bp, Homo sapiens
gagcaccgaatgattgttc

SEQ ID NO: 68448 - DNA, 19 bp, Homo sapiens
gagcaccgaatgattgttt

SEQ ID NO: 68449 - DNA, 19 bp, Homo sapiens
ttgtttttggtggcaattt

SEQ ID NO: 68450 - DNA, 20 bp, Homo sapiens
cttgaagatgggactctcac

SEQ ID NO: 68451 - DNA, 20 bp, Homo sapiens
cttgaagatgggactctcat

SEQ ID NO: 68452 - DNA, 18 bp, Homo sapiens
gcagaggtggcaactttg

SEQ ID NO: 68453 - DNA, 18 bp, Homo sapiens
ggagctgctcactgcttt

SEQ ID NO: 68454 - DNA, 18 bp, Homo sapiens
ggagctgctcactgcttc

SEQ ID NO: 68455 - DNA, 22 bp, Homo sapiens
gggtcatggcaaatactatttc

SEQ ID NO: 68456 - DNA, 21 bp, Homo sapiens
tgctttcttccagtttcaaac

SEQ ID NO: 68457 - DNA, 21 bp, Homo sapiens
tgctttcttccagtttcaaat

SEQ ID NO: 68458 - DNA, 23 bp, Homo sapiens
tgtcaccaattttttccctatta

SEQ ID NO: 68459 - DNA, 22 bp, Homo sapiens
ccaataaaagtgactctcagca

SEQ ID NO: 68460 - DNA, 21 bp, Homo sapiens
caataaaagtgactctcagcg

SEQ ID NO: 68461 - DNA, 21 bp, Homo sapiens
ccaggtggtggattcttaagt

SEQ ID NO: 68462 - DNA, 23 bp, Homo sapiens
agcaacttaaaacaacaaacatt

SEQ ID NO: 68463 - DNA, 23 bp, Homo sapiens
agcaacttaaaacaacaaacatc

SEQ ID NO: 68464 - DNA, 23 bp, Homo sapiens
gagcaggcctataaagagactta

SEQ ID NO: 68465 - DNA, 23 bp, Homo sapiens
actaaaggtgaaaacagtctcaa

SEQ ID NO: 68466 - DNA, 23 bp, Homo sapiens
actaaaggtgaaaacagtctcag

SEQ ID NO: 68467 - DNA, 20 bp, Homo sapiens
ggtccagccattctcagtat

SEQ ID NO: 68468 - DNA, 15 bp, Homo sapiens
acgcgggagacttcc

SEQ ID NO: 68469 - DNA, 16 bp, Homo sapiens
aacgcgggagacttca

SEQ ID NO: 68470 - DNA, 18 bp, Homo sapiens
ccctcagggaggacttct

SEQ ID NO: 68471 - DNA, 25 bp, Homo sapiens
caatttgtataatctaaaggagcat

SEQ ID NO: 68472 - DNA, 25 bp, Homo sapiens
caatttgtataatctaaaggagcac

SEQ ID NO: 68473 - DNA, 16 bp, Homo sapiens
gggcccgccttatgta

SEQ ID NO: 68474 - DNA, 19 bp, Homo sapiens
cctaatttaacccagctcg

SEQ ID NO: 68475 - DNA, 20 bp, Homo sapiens
ccctaatttaacccagctca

SEQ ID NO: 68476 - DNA, 22 bp, Homo sapiens
agggactccatcttggttatta

SEQ ID NO: 68477 - DNA, 20 bp, Homo sapiens
cattgacccatcttcagaac

SEQ ID NO: 68478 - DNA, 20 bp, Homo sapiens
cattgacccatcttcagaat

SEQ ID NO: 68479 - DNA, 23 bp, Homo sapiens
agaaatgagctttgtcttctctc

SEQ ID NO: 68480 - DNA, 16 bp, Homo sapiens
ccctccacagacaccc

SEQ ID NO: 68481 - DNA, 16 bp, Homo sapiens
ccctccacagacacca

SEQ ID NO: 68482 - DNA, 25 bp, Homo sapiens
ctgatttctttgaagcatttactta

SEQ ID NO: 68483 - DNA, 22 bp, Homo sapiens
gaatgactggcaaagactattc

SEQ ID NO: 68484 - DNA, 23 bp, Homo sapiens
tgaatgactggcaaagactatta

SEQ ID NO: 68485 - DNA, 28 bp, Homo sapiens
gggaatatatctctatttgagaatagac

SEQ ID NO: 68486 - DNA, 20 bp, Homo sapiens
aaatcaggttggaggagaat

SEQ ID NO: 68487 - DNA, 20 bp, Homo sapiens
aaatcaggttggaggagaac

SEQ ID NO: 68488 - DNA, 21 bp, Homo sapiens
gctcaaggagcatccactata

SEQ ID NO: 68489 - DNA, 19 bp, Homo sapiens
gcattttcactccgaagtt

SEQ ID NO: 68490 - DNA, 19 bp, Homo sapiens
gcattttcactccgaagtc

SEQ ID NO: 68491 - DNA, 25 bp, Homo sapiens
catgactagctctcattttgattag

SEQ ID NO: 68492 - DNA, 17 bp, Homo sapiens
ggacatgggggagtcac

SEQ ID NO: 68493 - DNA, 17 bp, Homo sapiens
ggacatgggggagtcat

SEQ ID NO: 68494 - DNA, 20 bp, Homo sapiens
tctgtgcaagtcaggttgtc

SEQ ID NO: 68495 - DNA, 17 bp, Homo sapiens
gatcggtcgcttggtta

SEQ ID NO: 68496 - DNA, 15 bp, Homo sapiens
tcggtcgcttggttg

SEQ ID NO: 68497 - DNA, 20 bp, Homo sapiens
ttgtgactggctgtcagaat

SEQ ID NO: 68498 - DNA, 17 bp, Homo sapiens
gagaagtccgggaaacg

SEQ ID NO: 68499 - DNA, 18 bp, Homo sapiens
tgagaagtccgggaaaca

SEQ ID NO: 68500 - DNA, 19 bp, Homo sapiens
tgatggcagctcaactcaa

SEQ ID NO: 68501 - DNA, 15 bp, Homo sapiens
gccagcaaaacggaa

SEQ ID NO: 68502 - DNA, 15 bp, Homo sapiens
gccagcaaaacggag

SEQ ID NO: 68503 - DNA, 19 bp, Homo sapiens
ggcagaagggaagagacag

SEQ ID NO: 68504 - DNA, 25 bp, Homo sapiens
gtcagttcttccataaatgtactct

SEQ ID NO: 68505 - DNA, 23 bp, Homo sapiens
cagttcttccataaatgtactcc

SEQ ID NO: 68506 - DNA, 22 bp, Homo sapiens
aatgttcggcttcctaataaga

SEQ ID NO: 68507 - DNA, 27 bp, Homo sapiens
cctctattgtttcctttattctttact

SEQ ID NO: 68508 - DNA, 26 bp, Homo sapiens
ctctattgtttcctttattctttacc

SEQ ID NO: 68509 - DNA, 25 bp, Homo sapiens
tttaccaccagttctacaaacagta

SEQ ID NO: 68510 - DNA, 18 bp, Homo sapiens
ggttcccagagctgtctc

SEQ ID NO: 68511 - DNA, 18 bp, Homo sapiens
ggttcccagagctgtctt

SEQ ID NO: 68512 - DNA, 24 bp, Homo sapiens
gcttagttttcccgagtctactta

SEQ ID NO: 68513 - DNA, 20 bp, Homo sapiens
catgcacagataggatcacg

SEQ ID NO: 68514 - DNA, 21 bp, Homo sapiens
gcatgcacagataggatcact

SEQ ID NO: 68515 - DNA, 19 bp, Homo sapiens
cctggaaaccagccactag

SEQ ID NO: 68516 - DNA, 28 bp, Homo sapiens
agtaaaactgaccttttaaactttttat

SEQ ID NO: 68517 - DNA, 27 bp, Homo sapiens
gtaaaactgaccttttaaactttttag

SEQ ID NO: 68518 - DNA, 25 bp, Homo sapiens
aacgttgcagaaaatttctctatat

SEQ ID NO: 68519 - DNA, 21 bp, Homo sapiens
gaactcaggagggaatgtaac

SEQ ID NO: 68520 - DNA, 21 bp, Homo sapiens
gaactcaggagggaatgtaat

SEQ ID NO: 68521 - DNA, 19 bp, Homo sapiens
gcattgtgggtgttcatct

SEQ ID NO: 68522 - DNA, 19 bp, Homo sapiens
catcatggtgttcttgcct

SEQ ID NO: 68523 - DNA, 18 bp, Homo sapiens
atcatggtgttcttgccc

SEQ ID NO: 68524 - DNA, 26 bp, Homo sapiens
cattatctgaaatgtttcattgtaga

SEQ ID NO: 68525 - DNA, 20 bp, Homo sapiens
agttgtcaagatggaacctg

SEQ ID NO: 68526 - DNA, 21 bp, Homo sapiens
aagttgtcaagatggaacctc

SEQ ID NO: 68527 - DNA, 22 bp, Homo sapiens
cccagtctccagactcttattc

SEQ ID NO: 68528 - DNA, 19 bp, Homo sapiens
tggctgaggaaaaagagag

SEQ ID NO: 68529 - DNA, 19 bp, Homo sapiens
tggctgaggaaaaagagaa

SEQ ID NO: 68530 - DNA, 20 bp, Homo sapiens
gctgaaaatgctgtttgttc

SEQ ID NO: 68531 - DNA, 21 bp, Homo sapiens
gagccttgaagtgttcaccta

SEQ ID NO: 68532 - DNA, 19 bp, Homo sapiens
gccttgaagtgttcacctg

SEQ ID NO: 68533 - DNA, 20 bp, Homo sapiens
accccaggtcaatctgtatc
